US010335486B2

(12) United States Patent
Frederick et al.

(10) Patent No.: US 10,335,486 B2
(45) Date of Patent: Jul. 2, 2019

(54) MRNA COMBINATION THERAPY FOR THE TREATMENT OF CANCER

(71) Applicant: ModernaTX, Inc., Cambridge, MA (US)

(72) Inventors: Joshua P. Frederick, Boston, MA (US); Susannah Hewitt, Jamaica Plain, MA (US); Ailin Bai, Newton, MA (US); Stephen G. Hoge, Brookline, MA (US); Vladimir Presnyak, Cambridge, MA (US); Iain McFadyen, Arlington, MA (US); Kerry Benenato, Sudbury, MA (US); Ellalahewage Sathyajith Kumarasinghe, Harvard, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 15/996,146

(22) Filed: Jun. 1, 2018

(65) Prior Publication Data

US 2018/0369374 A1 Dec. 27, 2018

Related U.S. Application Data

(63) Continuation of application No. PCT/US2017/033425, filed on May 18, 2017.

(60) Provisional application No. 62/338,501, filed on May 18, 2016, provisional application No. 62/338,496, filed on May 18, 2016, provisional application No. 62/338,507, filed on May 18, 2016, provisional application No. 62/338,530, filed on May 19, 2016, provisional application No. 62/404,173, filed on Oct. 4, 2016, provisional application No. 62/338,506, filed on May 18, 2016, provisional application No. 62/338,467, filed on May 18, 2016, provisional application No. 62/338,505, filed on May 18, 2016, provisional application No. 62/338,483, filed on May 18, 2016.

(51) Int. Cl.

| | |
|---|---|
| ***A61K 39/39*** | (2006.01) |
| ***A61K 39/395*** | (2006.01) |
| ***C07K 14/54*** | (2006.01) |
| ***C07K 14/705*** | (2006.01) |
| ***C07K 16/28*** | (2006.01) |
| ***A61K 45/06*** | (2006.01) |
| ***A61K 31/713*** | (2006.01) |
| ***A61K 39/00*** | (2006.01) |
| *A61P 35/00* | (2006.01) |

(52) U.S. Cl.

CPC ...... *A61K 39/39558* (2013.01); *A61K 31/713* (2013.01); *A61K 39/0011* (2013.01); *A61K 39/39* (2013.01); *A61K 45/06* (2013.01); *C07K 14/54* (2013.01); *C07K 14/5434* (2013.01); *C07K 14/5443* (2013.01); *C07K 14/705* (2013.01); *C07K 14/70503* (2013.01); *C07K 14/70532* (2013.01); *C07K 14/70575* (2013.01); *C07K 14/70596* (2013.01); *C07K 16/2818* (2013.01); *A61K 2039/505* (2013.01); *A61K 2039/53* (2013.01); *A61K 2039/585* (2013.01); *A61P 35/00* (2018.01); *C07K 2317/76* (2013.01); *C07K 2319/30* (2013.01); *C07K 2319/32* (2013.01)

(58) Field of Classification Search

None

See application file for complete search history.

(56) References Cited

U.S. PATENT DOCUMENTS

| | | | |
|---|---|---|---|
| 2008/0025944 A1 | 1/2008 | Hoerr et al. |
| 2018/0318229 A1 | 11/2018 | Frederick et al. |

FOREIGN PATENT DOCUMENTS

| | | |
|---|---|---|
| WO | 200152874 A2 | 7/2001 |
| WO | 2009034172 A1 | 3/2009 |
| WO | 2013/053775 A1 | 4/2013 |
| WO | 2016170176 A1 | 10/2016 |
| WO | 2017201325 A1 | 11/2017 |
| WO | 2017201352 A1 | 11/2017 |

OTHER PUBLICATIONS

Andarini et al. (Cancer Research (2004) vol. 64, pp. 3281-3287). (Year: 2004).*

Andries et al. (Journal of Controlled Release (2015) vol. 217, pp. 337-344) (Year: 2015).*

Third Party Observation, filed in PCT/US2017/033425, dated Sep. 18, 2018, 2 pages.

(Continued)

*Primary Examiner* — J. E. Angell

(74) *Attorney, Agent, or Firm* — Nelson Mullins Riley & Scarborough LLP; Amy E. Mandragouras, Esq.; Ariana D. Harris

(57) ABSTRACT

The present disclosure relates to the use of nucleic acid (e.g., mRNA) combination therapies for the treatment of cancer. The disclosure provides compositions, and methods for their preparation, manufacture, and therapeutic use, wherein those compositions comprise at least two polynucleotides (e.g., mRNAs) in combination wherein the at least two polynucleotides are selected from the group consisting of (i) a polynucleotide encoding an immune response primer (e.g., IL23), (ii) a polynucleotide encoding an immune response co-stimulatory signal (e.g., OX40L), (iii) a polynucleotide encoding a checkpoint inhibitor (e.g., an anti CTLA-4 antibody), and, (iv) a combination thereof. The therapeutic methods disclosed herein comprise, e.g., the administration of a combination therapy disclosed herein for the treatment of cancer, e.g., by reducing the size of a tumor or inhibiting the growth of a tumor, in a subject in need thereof. In some aspects, the combination therapies disclosed herein disclosed are administered intratumorally.

23 Claims, 124 Drawing Sheets

Specification includes a Sequence Listing.

(56) References Cited

OTHER PUBLICATIONS

Charoensit, P. et al., "Enhanced growth inhibition of metastatic lung tumors by intravenous injection of ATRA-cationic liposome/IL-12 pDNA complexes in mice," Cancer Gene Therapy, vol. 17(7) 512-522 (2010).
Colombo, M. et al., "Interleukin-12 in anti-tumor immunity and immunotherapy," Cytokine and Growth Factor Reviews, vol. 13(2):155-I68 (2002).
Hara I. et al., "Effectiveness of cancer vaccine therapy using cells transduced with the interleukin-12 gene combined with systemic interleukin-18 administration," Cancer Gene Therapy, vol. 7(1):83-90 (2000).
Hu, D. et al., "Immunoglobulin Expression and Its Biological Significance in Cancer Cells," Cellular and Molecular Immunology, vol. 5(5): 319-324 (2008).
International Search Report and Written Opinion, PCT/US2017/033395, dated Sep. 1, 2017, 15 pages.
International Search Report and Written Opinion, PCT/US2017/033425, dated Jul. 25, 2017, 16 pages.
Karkada M. et al., "A liposome-based platform, VacciMae(R), and its modified water-free platform DepoVax(TM) enhance efficacy of in vivo nucleic acid delivery", Vaccine, vol. 28(38):6176-6182 (2010).
Linch S. et al., "0X40 agonists and combination immunotherapy: Putting the pedal to the metal," Frontiers in Oncology, Frontiers Research Foundation, vol. 5:1-14 (2015).
McNamara, M. et al., "RNA-Based Vaccines in Cancer Immunotherapy," Journal of Immunology Research, vol. 2015, pp. 1-9 (2015).
Melero, I. et al., "Evolving synergistic combinations of targeted immunotherapies to combat cancer," Nature Reviews, Cancer, vol. 15(8):457-472 (2015).
Mendiratta, S. et al., "Combination of Interleukin 12 and Interferon [alpha] Gene Therapy Induces a Synergistic Antitumor Response against Colon and Renal Cell Carcinoma", Human Gene Therapy, vol. 11(13):1851-1862 (2000).
Meraz, I. et al., "Adjuvant Cationic Liposomes Presenting MPL and IL-12 Induce Cell Death, Suppress Tumor Growth, and Alter the Cellular Phenotype of Tumors in a Murine Model of Breast Cancer," Molecular Pharmaceutics, vol. 11(10):3484-3491(2014).
Ngiow, S. et al."A balance of interleukin-12 and -23 in cancer," Trends in Immunology, vol. 34 (11):548-555 (2013).
Overwijk, W. W. et al., "Immunological and Antitumor Effects of IL-23 as a Cancer Vaccine Adjuvant," The Journal of Immunology, vol. 176 (9):5213-5222 (2006).
Sahin,U. et al., "mRNA-based therapeutics—developing a new class of drugs," Nature Reviews and Drug Discovery, vol. 13 (10):759-780 (2014).
Shim, G. et al., "Application of cationic liposomes for delivery of nucleic acids," Asian Journal of Pharmaceutical Sciences, vol. 8 (2):72-80 (2013).
Tugues, S. et al., "New insights into IL-12-mediated tumor suppression," Cell Death and Differentiation, vol. 22 (2):237-246 (2014).
Wang J. et al., "Synergistic anti-tumor effect by combinatorial gene-gun therapy using IL-23 and IL-18 cDNA", Journal of Dermatological, vol. 36 (1):66-68 (2004).
Wang X. et al., "IL-36[gamma] Transforms the Tumor Microenvironment and Promotes Type 1 Lymphocyte-Mediated Antitumor Immune Responses," Cancer Cell, vol. 28(3):296-306 (2015).
Weiss, J. et al., "Immunotherapy of cancer by IL-12-based cytokine combinations," Expert Opinion on Biological Therapy, vol. 7(11):1705-1721 (2007).
Wiltrout, R.H., "IL-12/IL-2 combination cytokine therapy for solid tumours: translation from bench to bedside," Expert Opinion on Biological Therapy, vol. 2 (5):513-524 (2002).
U.S. Appl. No. 15/995,889, filed Jun. 1, 2018, Joshua Frederick.
International Preliminary Report on Patentability, PCT/US2017/033395, dated Nov. 20, 2018, 9 pages.
International Preliminary Report on Patentability, PCT/US2017/033425, dated Nov. 29, 2018, 12 pages.
U.S. Appl. No. 16/184,282, filed Nov. 8, 2018, Joshua Frederick.
U.S. Appl. No. 16/219,418, filed Dec. 13, 2018, Joshua Frederick.
U.S. Appl. No. 16/222,155, filed Dec. 17, 2018, Joshua Frederick.
U.S. Appl. No. 15/995,889, dated Sep. 21, 2018.

* cited by examiner

Compare re-challenge of 6 CRs with 500,000 MC-38 cells to challenge of 9 naïve animals

| | Tumor Growth (Day 23) |
|---|---|
| OX40L Tx | 0/6 = 0% |
| Naïve | 6/9 = 67% |

FIG. 41A
FIG. 41B
Human OX40L
hOX40L
hOX40L_miR122
35,000
30,000
25,000
20,000
15,000
10,000
5,000
0
[hOX40L] (ng/6-well)
Mock
6
24
48
Human hepatocyte
Hep3B
HeLa
Mouse OX40L
mOX40L
mOX40L_miR122
3,500
3,000
2,500
2,000
1,500
1,000
500
0
[mOX40L] (ng/6-well)
Mock
6
24
48
Human hepatocyte
Hep3B
HeLa

| mRNA Name | Fold increase over WT | Rank |
|---|---|---|
| hIL12AB_004 miR122 | 1.95 | 1 |
| hIL12AB_018 miR122 | 1.83 | 2 |
| hIL12AB_001 miR122 | 1.7 | 3 |
| hIL12AB_011 miR122 | 1.69 | 4 |
| hIL12AB_014 miR122 | 1.61 | 5 |
| hIL12AB_017 miR122 | 1.54 | 6 |
| hIL12AB_019 miR122 | 1.51 | 7 |
| hIL12AB_012 miR122 | 1.34 | 8 |
| hIL12AB_002 miR122 | 1.32 | 9 |
| hIL12AB_007 miR122 | 1.24 | 10 |
| hIL12AB_010 miR122 | 1.05 | 11 |
| hIL12AB_013 miR122 | 0.57 | 12 |

FIG. 45

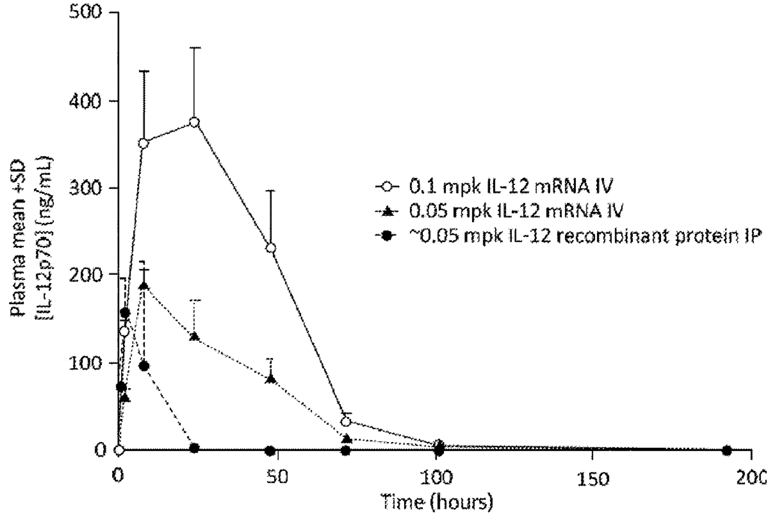
FIG. 47A
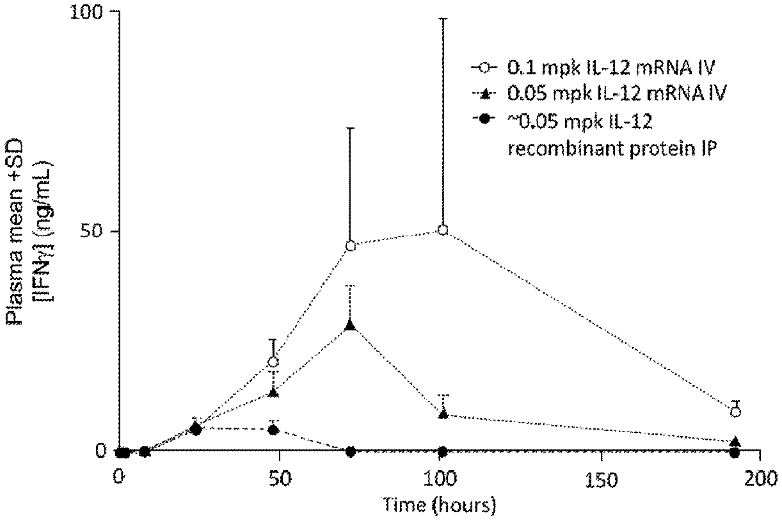
FIG. 47B
| Treatment | IL12 AUC (ng/mL)*hr 0.5-196 | IFNγ AUC (ng/mL)*hr 0.5-196 |
|---|---|---|
| 0.1 mpk IL12 mRNA | 18805 (↑10.4x) | 5290 (↑21.3x) |
| 0.05 mpk IL12 mRNA | 7500 (↑4.1x) | 1856 (↑7.5x) |
| ~0.05 mpk IL12 protein | 1801 | 248 |
FIG. 47C

| Route | IL12 mRNA in LNP (mg/kg) | Treatment tolerability outcome (to Day 20) | Plasma levels of IL12 24 hr post dose (ng/ml) |
|---|---|---|---|
| Intravenous | 0.2 | 3/12 viable | 1592 |
| Intratumoral | ~0.2 (4 μg fixed) | 9/10 viable | 89 |

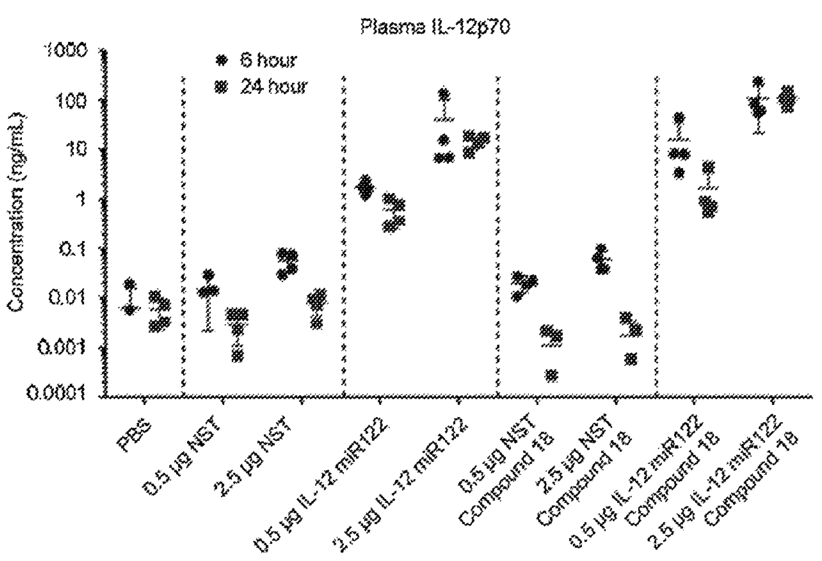
FIG. 59A
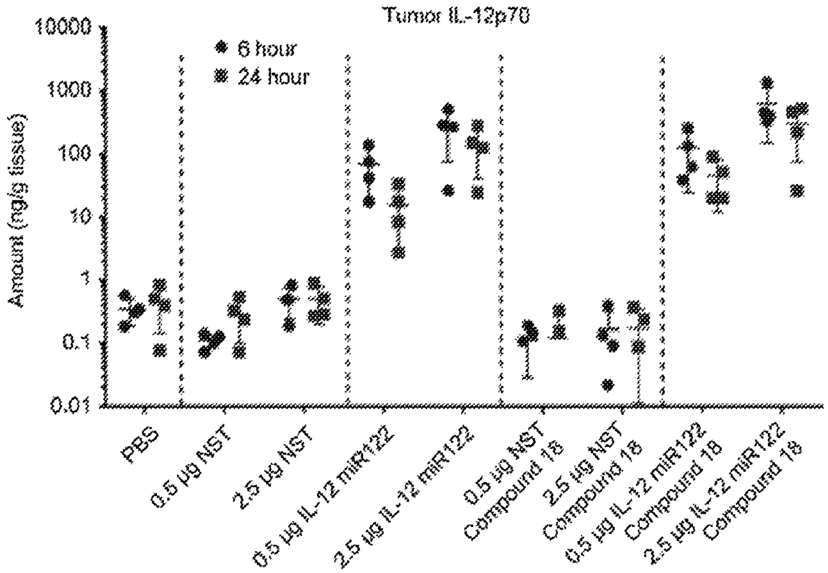
FIG. 59B
Fold increase of IL12 from Compound 18 compared to MC3
| | mRNA dose | 6 hr | 24 hr |
|---|---|---|---|
| *Plasma* | 0.5 μg | 9.3 | 2.8 |
| | 2.5 μg | 2.7 | 7.2 |
| Tumor | 0.5 μg | 1.8 | 2.9 |
| | 2.5 μg | 2.3 | 2.1 |
FIG. 59C . Human IL12B-Linker-
IL23A Fusion Protein Construct

| Protein (Treme VL) | Length | Theoretical Minimum U (%) | Theoretical Minimum U (abs) | Phe | |
|---|---|---|---|---|---|
| Treme_LC-VL | 107 | 11.21% | 36 | 5 | |
| Nucleic Acid | Length | U Content(abs) | U Content(%) | U Content v WT (%) | U Content v Theoretical Minimum (%) |
| Treme_LC-VL | 321 | 78 | 24.30% | 100.00% | 216.67% |
| | MAX | 59 | 18.38% | 75.64% | 163.89% |
| | MIN | 46 | 14.33% | 58.97% | 127.78% |
| | MEAN | 51.52 | 16.05% | 66.05% | 143.11% |
| | MEDIAN | 52 | 16.20% | 66.67% | 144.44% |
| | STD DEV | 2.63 | 0.82% | 3.37% | 7.31% |

FIG. 80A

| Protein | Length | Theoretical Maximum G (%) | Theoretical Maximum G (abs) | | |
|---|---|---|---|---|---|
| Treme_LC-VL | 107 | 37.38% | 120 | | |
| Nucleic Acid | Length | G Content(abs) | G Content(%) | G Content v WT (%) | G Content v Theoretical Maximum (%) |
| Treme_LC-VL | 321 | 68 | 21.18% | 100.00% | 56.67% |
| | MAX | 85 | 26.48% | 125.00% | 70.83% |
| | MIN | 73 | 22.74% | 107.35% | 60.83% |
| | MEAN | 77.84 | 24.25% | 114.47% | 64.87% |
| | MEDIAN | 78 | 24.30% | 114.71% | 65.00% |
| | STD DEV | 2.78 | 0.87% | 4.09% | 2.32% |

FIG. 80B

| Protein | Length | Theoretical Maximum C (%) | Theoretical Maximum C (abs) | | |
|---|---|---|---|---|---|
| Treme_LC-VL | 107 | 48.60% | 156 | | |
| Nucleic Acid | Length | C Content(abs) | C Content(%) | C Content v WT (%) | C Content v Theoretical Maximum (%) |
| Treme_LC-VL | 321 | 86 | 26.79% | 100.00% | 55.13% |
| | MAX | 127 | 39.56% | 147.67% | 81.41% |
| | MIN | 115 | 35.83% | 133.72% | 73.72% |
| | MEAN | 121.6 | 37.88% | 141.40% | 77.95% |
| | MEDIAN | 123 | 38.32% | 143.02% | 78.85% |
| | STD DEV | 3.42 | 1.06% | 3.97% | 2.19% |

FIG. 80C

| Protein | Length | Theoretical Maximum GC (%) | Theoretical Maximum GC (abs) | | |
|---|---|---|---|---|---|
| Treme_LC-VL | 307 | 66.36% | 213 | | |
| Nucleic Acid | Length | GC Content (abs) | GC Content(%) | GC Content v WT (%) | GC Content v Theoretical Maximum (%) |
| Treme_LC-VL | 321 | 154 | 47.98% | 100.00% | 72.30% |
| | MAX | 206 | 64.17% | 133.77% | 96.71% |
| | MIN | 191 | 59.50% | 124.03% | 89.67% |
| | MEAN | 199.44 | 62.13% | 129.51% | 93.63% |
| | MEDIAN | 200 | 62.31% | 129.87% | 93.90% |
| | STD DEV | 3.38 | 1.05% | 2.19% | 1.59% |

FIG. 80D

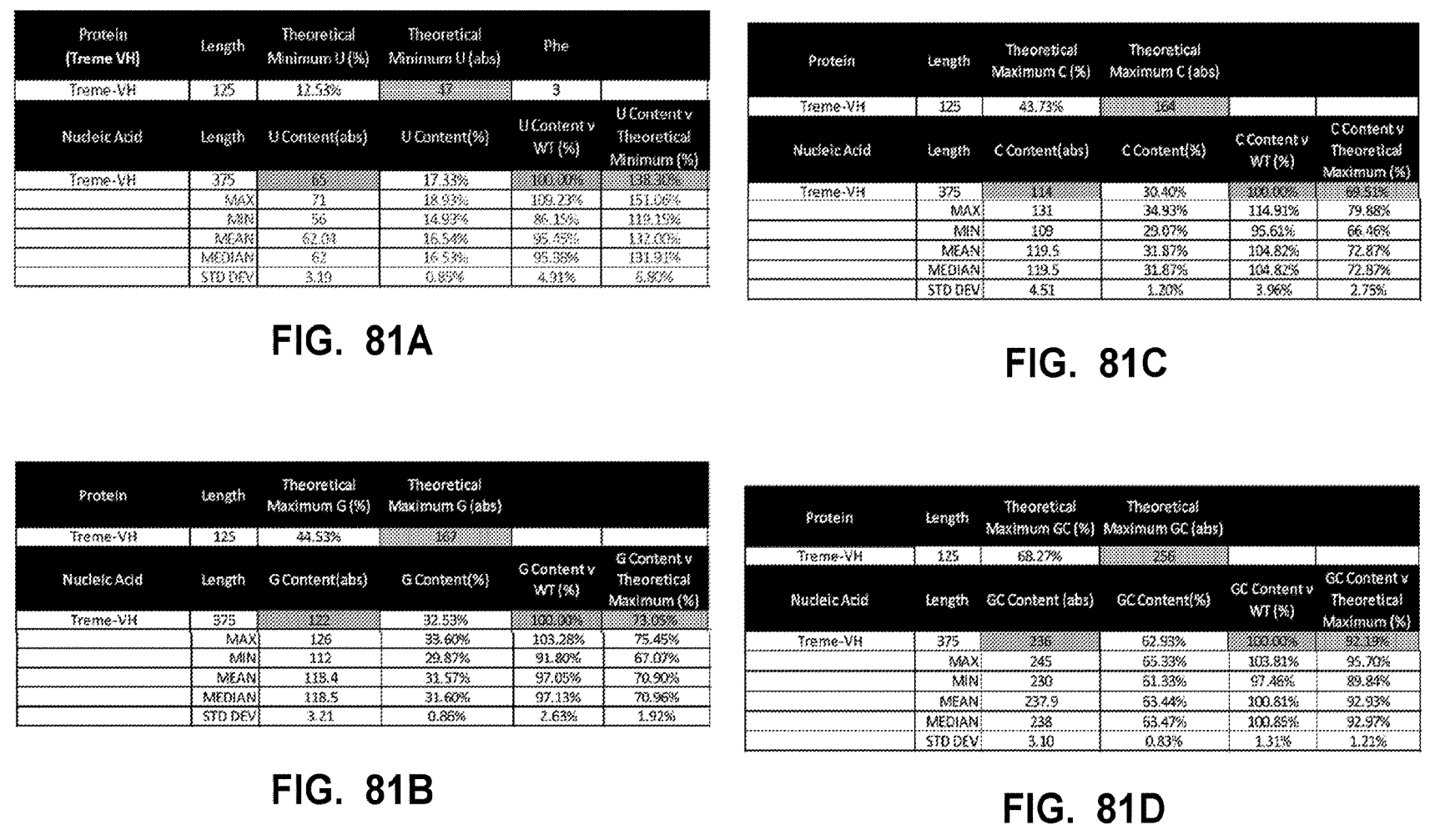

| Protein (Treme VH) | Length | Theoretical Minimum U (%) | Theoretical Minimum U (abs) | Phe | |
|---|---|---|---|---|---|
| Treme-VH | 125 | 12.53% | 47 | 3 | |
| **Nucleic Acid** | **Length** | **U Content(abs)** | **U Content(%)** | **U Content v WT (%)** | **U Content v Theoretical Minimum (%)** |
| Treme-VH | 375 | 65 | 17.33% | 100.00% | 138.30% |
| | MAX | 71 | 18.93% | 109.23% | 151.06% |
| | MIN | 56 | 14.93% | 86.15% | 119.15% |
| | MEAN | 62.03 | 16.54% | 95.45% | 132.00% |
| | MEDIAN | 62 | 16.53% | 95.38% | 131.91% |
| | STD DEV | 3.19 | 0.85% | 4.91% | 6.80% |

FIG. 81A

| Protein | Length | Theoretical Maximum G (%) | Theoretical Maximum G (abs) | | |
|---|---|---|---|---|---|
| Treme-VH | 125 | 44.53% | 167 | | |
| **Nucleic Acid** | **Length** | **G Content(abs)** | **G Content(%)** | **G Content v WT (%)** | **G Content v Theoretical Maximum (%)** |
| Treme-VH | 375 | 122 | 32.53% | 100.00% | 73.05% |
| | MAX | 126 | 33.60% | 103.28% | 75.45% |
| | MIN | 112 | 29.87% | 91.80% | 67.07% |
| | MEAN | 118.4 | 31.57% | 97.05% | 70.90% |
| | MEDIAN | 118.5 | 31.60% | 97.13% | 70.96% |
| | STD DEV | 3.21 | 0.86% | 2.63% | 1.92% |

FIG. 81B

| Protein | Length | Theoretical Maximum C (%) | Theoretical Maximum C (abs) | | |
|---|---|---|---|---|---|
| Treme-VH | 125 | 43.73% | 164 | | |
| **Nucleic Acid** | **Length** | **C Content(abs)** | **C Content(%)** | **C Content v WT (%)** | **C Content v Theoretical Maximum (%)** |
| Treme-VH | 375 | 114 | 30.40% | 100.00% | 69.51% |
| | MAX | 131 | 34.93% | 114.91% | 79.88% |
| | MIN | 109 | 29.07% | 95.61% | 66.46% |
| | MEAN | 119.5 | 31.87% | 104.82% | 72.87% |
| | MEDIAN | 119.5 | 31.87% | 104.82% | 72.87% |
| | STD DEV | 4.51 | 1.20% | 3.96% | 2.75% |

FIG. 81C

| Protein | Length | Theoretical Maximum GC (%) | Theoretical Maximum GC (abs) | | |
|---|---|---|---|---|---|
| Treme-VH | 125 | 68.27% | 256 | | |
| **Nucleic Acid** | **Length** | **GC Content (abs)** | **GC Content(%)** | **GC Content v WT (%)** | **GC Content v Theoretical Maximum (%)** |
| Treme-VH | 375 | 236 | 62.93% | 100.00% | 92.19% |
| | MAX | 245 | 65.33% | 103.81% | 95.70% |
| | MIN | 230 | 61.33% | 97.46% | 89.84% |
| | MEAN | 237.9 | 63.44% | 100.81% | 92.93% |
| | MEDIAN | 238 | 63.47% | 100.85% | 92.97% |
| | STD DEV | 3.10 | 0.83% | 1.31% | 1.21% |

FIG. 81D

| Protein (Ipi VL) | Length | Theoretical Minimum U (%) | Theoretical Minimum U (abs) | Phe | |
|---|---|---|---|---|---|
| IPI_LC-VL | 108 | 11.11% | 36 | 5 | |
| **Nucleic Acid** | **Length** | **U Content(abs)** | **U Content(%)** | **U Content v WT (%)** | **U Content v Theoretical Minimum (%)** |
| IPI_LC-VL | 324 | 70 | 21.60% | 100.00% | 194.44% |
| | MAX | 54 | 16.67% | 77.14% | 150.00% |
| | MIN | 45 | 13.89% | 64.29% | 125.00% |
| | MEAN | 49.52 | 15.28% | 70.74% | 137.56% |
| | MEDIAN | 49 | 15.12% | 70.00% | 136.11% |
| | STD DEV | 2.76 | 0.85% | 3.94% | 7.65% |

FIG. 82A

| Protein | Length | Theoretical Maximum G (%) | Theoretical Maximum G (abs) | | |
|---|---|---|---|---|---|
| IPI_LC-VL | 108 | 43.21% | 140 | | |
| **Nucleic Acid** | **Length** | **G Content(abs)** | **G Content(%)** | **G Content v WT (%)** | **G Content v Theoretical Maximum (%)** |
| IPI_LC-VL | 324 | 91 | 28.09% | 100.00% | 65.00% |
| | MAX | 99 | 30.56% | 107.61% | 70.71% |
| | MIN | 89 | 27.47% | 96.74% | 63.57% |
| | MEAN | 94.8 | 29.26% | 103.04% | 67.71% |
| | MEDIAN | 95 | 29.32% | 103.26% | 67.86% |
| | STD DEV | 2.38 | 0.73% | 2.59% | 1.70% |

FIG. 82B

| Protein | Length | Theoretical Maximum C (%) | Theoretical Maximum C (abs) | | |
|---|---|---|---|---|---|
| IPI_LC-VL | 108 | 48.77% | 158 | | |
| **Nucleic Acid** | **Length** | **C Content(abs)** | **C Content(%)** | **C Content v WT (%)** | **C Content v Theoretical Maximum (%)** |
| IPI_LC-VL | 324 | 89 | 27.47% | 100.00% | 67.41% |
| | MAX | 125 | 38.58% | 140.45% | 94.70% |
| | MIN | 111 | 34.26% | 124.72% | 84.09% |
| | MEAN | 118.72 | 36.64% | 133.39% | 89.94% |
| | MEDIAN | 118 | 36.42% | 132.58% | 89.39% |
| | STD DEV | 4.08 | 1.26% | 4.58% | 3.09% |

FIG. 82C

| Protein | Length | Theoretical Maximum GC (%) | Theoretical Maximum GC (abs) | | |
|---|---|---|---|---|---|
| IPI_LC-VL | 108 | 70.68% | 229 | | |
| **Nucleic Acid** | **Length** | **GC Content (abs)** | **GC Content(%)** | **GC Content v WT (%)** | **GC Content v Theoretical Maximum (%)** |
| IPI_LC-VL | 324 | 180 | 55.56% | 100.00% | 78.60% |
| | MAX | 220 | 67.90% | 122.22% | 96.07% |
| | MIN | 206 | 63.58% | 114.44% | 89.96% |
| | MEAN | 213.52 | 65.90% | 118.62% | 93.24% |
| | MEDIAN | 213 | 65.74% | 118.33% | 93.01% |
| | STD DEV | 3.33 | 1.03% | 1.85% | 1.45% |

FIG. 82D

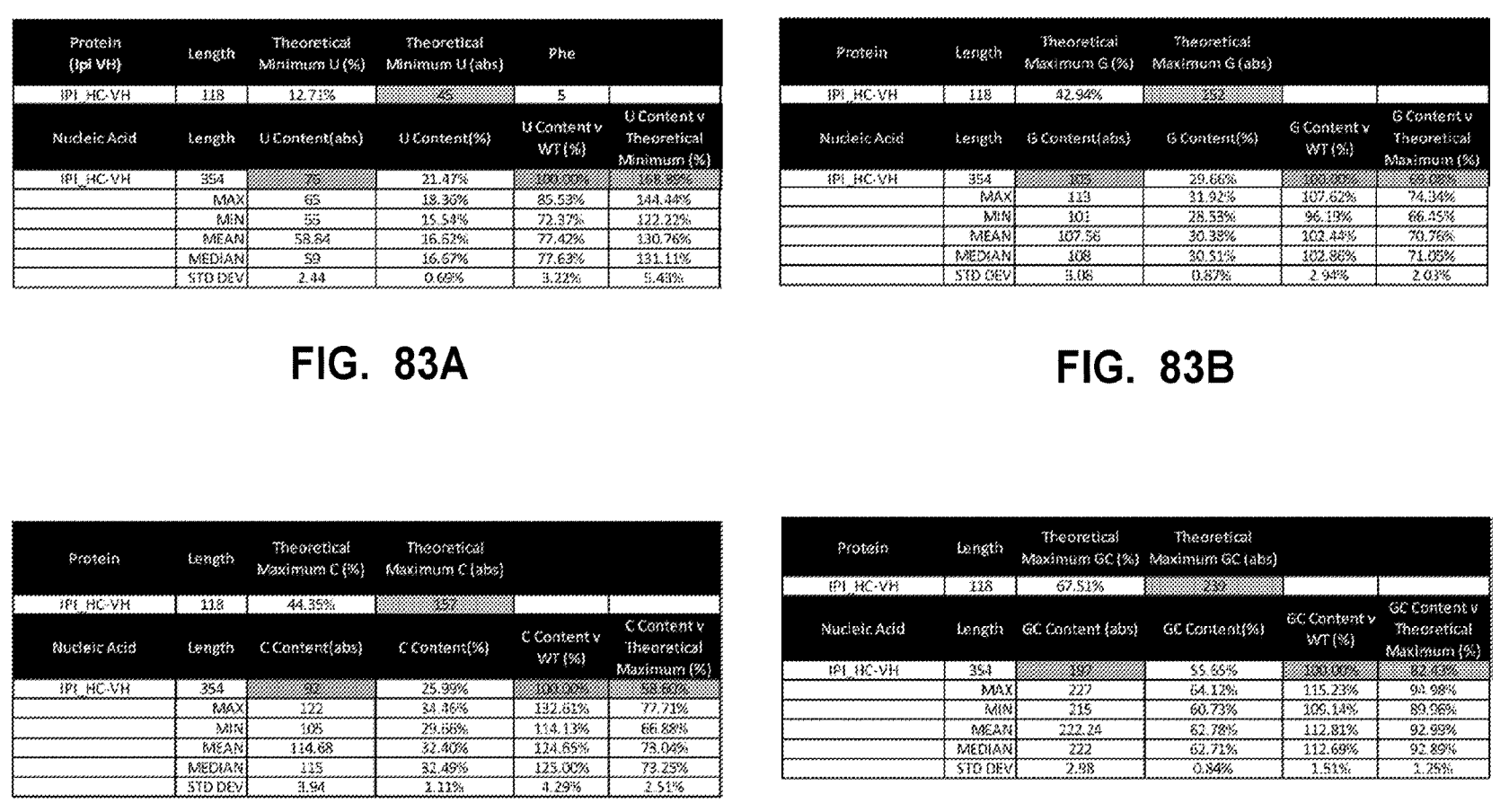

| Protein (Ipi VH) | Length | Theoretical Minimum U (%) | Theoretical Minimum U (abs) | Phe | |
|---|---|---|---|---|---|
| IPI_HC-VH | 118 | 12.71% | 45 | 5 | |
| **Nucleic Acid** | **Length** | **U Content(abs)** | **U Content(%)** | **U Content v WT (%)** | **U Content v Theoretical Minimum (%)** |
| IPI_HC-VH | 354 | 76 | 21.47% | 100.00% | 168.89% |
| | MAX | 65 | 18.36% | 85.53% | 144.44% |
| | MIN | 55 | 15.54% | 72.37% | 122.22% |
| | MEAN | 58.84 | 16.62% | 77.42% | 130.76% |
| | MEDIAN | 59 | 16.67% | 77.63% | 131.11% |
| | STD DEV | 2.44 | 0.69% | 3.21% | 5.43% |

FIG. 83A

| Protein | Length | Theoretical Maximum G (%) | Theoretical Maximum G (abs) | | |
|---|---|---|---|---|---|
| IPI_HC-VH | 118 | 42.94% | 152 | | |
| **Nucleic Acid** | **Length** | **G Content(abs)** | **G Content(%)** | **G Content v WT (%)** | **G Content v Theoretical Maximum (%)** |
| IPI_HC-VH | 354 | 105 | 29.66% | 100.00% | 69.08% |
| | MAX | 113 | 31.92% | 107.62% | 74.34% |
| | MIN | 101 | 28.53% | 96.19% | 66.45% |
| | MEAN | 107.56 | 30.38% | 102.44% | 70.76% |
| | MEDIAN | 108 | 30.51% | 102.86% | 71.05% |
| | STD DEV | 3.08 | 0.87% | 2.94% | 2.03% |

FIG. 83B

| Protein | Length | Theoretical Maximum C (%) | Theoretical Maximum C (abs) | | |
|---|---|---|---|---|---|
| IPI_HC-VH | 118 | 44.35% | 157 | | |
| **Nucleic Acid** | **Length** | **C Content(abs)** | **C Content(%)** | **C Content v WT (%)** | **C Content v Theoretical Maximum (%)** |
| IPI_HC-VH | 354 | 92 | 25.99% | 100.00% | 58.60% |
| | MAX | 122 | 34.46% | 132.61% | 77.71% |
| | MIN | 105 | 29.66% | 114.13% | 66.88% |
| | MEAN | 114.68 | 32.40% | 124.65% | 73.04% |
| | MEDIAN | 115 | 32.49% | 125.00% | 73.25% |
| | STD DEV | 3.94 | 1.11% | 4.29% | 2.51% |

FIG. 83C

| Protein | Length | Theoretical Maximum GC (%) | Theoretical Maximum GC (abs) | | |
|---|---|---|---|---|---|
| IPI_HC-VH | 118 | 67.51% | 239 | | |
| **Nucleic Acid** | **Length** | **GC Content (abs)** | **GC Content(%)** | **GC Content v WT (%)** | **GC Content v Theoretical Maximum (%)** |
| IPI_HC-VH | 354 | 197 | 55.65% | 100.00% | 82.43% |
| | MAX | 227 | 64.12% | 115.23% | 94.98% |
| | MIN | 215 | 60.73% | 109.14% | 89.96% |
| | MEAN | 222.24 | 62.78% | 112.81% | 92.99% |
| | MEDIAN | 222 | 62.71% | 112.69% | 92.89% |
| | STD DEV | 2.98 | 0.84% | 1.51% | 1.25% |

FIG. 83D

| Protein (Treme-Ipi CL) | Length | Theoretical Minimum U (%) | Theoretical Minimum U (abs) | Phe | |
|---|---|---|---|---|---|
| Treme-Ipi-CL | 107 | 9.97% | 32 | 4 | |
| **Nucleic Acid** | **Length** | **U Content(abs)** | **U Content(%)** | **U Content v WT (%)** | **U Content v Theoretical Minimum (%)** |
| Treme-Ipi-CL | 321 | 59 | 18.38% | 100.00% | 184.38% |
| | MAX | 55 | 17.13% | 93.22% | 171.88% |
| | MIN | 42 | 13.08% | 71.19% | 131.25% |
| | MEAN | 46.92 | 14.62% | 79.53% | 146.63% |
| | MEDIAN | 47 | 14.64% | 79.66% | 146.88% |
| | STD DEV | 2.93 | 0.91% | 4.97% | 9.17% |

FIG. 84A

| Protein | Length | Theoretical Maximum G (%) | Theoretical Maximum G (abs) | | |
|---|---|---|---|---|---|
| Treme-Ipi-CL | 107 | 39.56% | 127 | | |
| **Nucleic Acid** | **Length** | **G Content(abs)** | **G Content(%)** | **G Content v WT (%)** | **G Content v Theoretical Maximum (%)** |
| Treme-Ipi-CL | 321 | 82 | 25.55% | 100.00% | 64.57% |
| | MAX | 103 | 32.09% | 125.61% | 81.10% |
| | MIN | 87 | 27.10% | 106.10% | 68.50% |
| | MEAN | 95.42 | 29.73% | 116.37% | 75.13% |
| | MEDIAN | 96 | 29.91% | 117.07% | 75.59% |
| | STD DEV | 3.10 | 0.97% | 3.79% | 2.44% |

FIG. 84B

| Protein | Length | Theoretical Maximum C (%) | Theoretical Maximum C (abs) | | |
|---|---|---|---|---|---|
| Treme-Ipi-CL | 107 | 45.17% | 145 | | |
| **Nucleic Acid** | **Length** | **C Content(abs)** | **C Content(%)** | **C Content v WT (%)** | **C Content v Theoretical Maximum (%)** |
| Treme-Ipi-CL | 321 | 92 | 28.66% | 100.00% | 63.45% |
| | MAX | 113 | 35.20% | 122.83% | 96.58% |
| | MIN | 94 | 29.28% | 102.17% | 64.63% |
| | MEAN | 103.06 | 32.11% | 112.02% | 87.75% |
| | MEDIAN | 103 | 32.09% | 111.96% | 88.03% |
| | STD DEV | 3.89 | 1.21% | 4.23% | 4.61% |

FIG. 84C

| Protein | Length | Theoretical Maximum GC (%) | Theoretical Maximum GC (abs) | | |
|---|---|---|---|---|---|
| Treme-Ipi-CL | 107 | 55.73% | 211 | | |
| **Nucleic Acid** | **Length** | **GC Content (abs)** | **GC Content(%)** | **GC Content v WT (%)** | **GC Content v Theoretical Maximum (%)** |
| Treme-Ipi-CL | 321 | 174 | 54.21% | 100.00% | 82.46% |
| | MAX | 204 | 63.55% | 117.24% | 127.50% |
| | MIN | 192 | 59.81% | 110.34% | 92.42% |
| | MEAN | 198.48 | 61.83% | 114.07% | 123.46% |
| | MEDIAN | 198 | 61.68% | 113.79% | 123.75% |
| | STD DEV | 2.79 | 0.87% | 1.61% | 4.80% |

FIG. 84D

| Protein (Treme IgG2 CH) | Length | Theoretical Minimum U (%) | Theoretical Minimum U (abs) | Phe | |
|---|---|---|---|---|---|
| Treme_HC_IgG2 | 326 | 10.94% | 107 | 13 | |
| Nucleic Acid | Length | U Content(abs) | U Content(%) | U Content v WT (%) | U Content v Theoretical Minimum (%) |
| Treme_HC_IgG2 | 978 | 157 | 16.05% | 100.00% | 146.73% |
| | MAX | 161 | 16.46% | 102.55% | 150.47% |
| | MIN | 141 | 14.42% | 89.81% | 131.78% |
| | MEAN | 149.2 | 15.26% | 95.03% | 139.44% |
| | MEDIAN | 149 | 15.24% | 94.90% | 139.25% |
| | STD DEV | 4.96 | 0.51% | 3.16% | 4.63% |

FIG. 85A

| Protein | Length | Theoretical Maximum G (%) | Theoretical Maximum G (abs) | | |
|---|---|---|---|---|---|
| Treme_HC_IgG2 | 326 | 39.78% | 389 | | |
| Nucleic Acid | Length | G Content(abs) | G Content(%) | G Content v WT (%) | G Content v Theoretical Maximum (%) |
| Treme_HC_IgG2 | 978 | 258 | 26.38% | 100.00% | 66.32% |
| | MAX | 301 | 30.78% | 116.67% | 77.38% |
| | MIN | 272 | 27.81% | 105.43% | 69.92% |
| | MEAN | 284.6 | 29.10% | 110.31% | 73.16% |
| | MEDIAN | 285 | 29.14% | 110.47% | 73.26% |
| | STD DEV | 6.55 | 0.67% | 2.54% | 1.68% |

FIG. 85B

| Protein | Length | Theoretical Maximum C (%) | Theoretical Maximum C (abs) | | |
|---|---|---|---|---|---|
| Treme_HC_IgG2 | 326 | 45.91% | 449 | | |
| Nucleic Acid | Length | C Content(abs) | C Content(%) | C Content v WT (%) | C Content v Theoretical Maximum (%) |
| Treme_HC_IgG2 | 978 | 335 | 34.25% | 100.00% | 74.61% |
| | MAX | 344 | 35.17% | 102.69% | 76.61% |
| | MIN | 311 | 31.80% | 92.84% | 69.27% |
| | MEAN | 325.84 | 33.32% | 97.27% | 72.57% |
| | MEDIAN | 329 | 33.64% | 98.21% | 73.27% |
| | STD DEV | 7.74 | 0.79% | 2.31% | 1.72% |

FIG. 85C

| Protein | Length | Theoretical Maximum GC (%) | Theoretical Maximum GC (abs) | | |
|---|---|---|---|---|---|
| Treme_HC_IgG2 | 326 | 66.36% | 649 | | |
| Nucleic Acid | Length | GC Content (abs) | GC Content(%) | GC Content v WT (%) | GC Content v Theoretical Maximum (%) |
| Treme_HC_IgG2 | 978 | 593 | 60.63% | 100.00% | 91.37% |
| | MAX | 627 | 64.11% | 105.73% | 96.61% |
| | MIN | 602 | 61.55% | 101.52% | 92.76% |
| | MEAN | 610.44 | 62.42% | 102.94% | 94.06% |
| | MEDIAN | 609 | 62.27% | 102.70% | 93.84% |
| | STD DEV | 6.33 | 0.65% | 1.07% | 0.98% |

FIG. 85D

| Protein (Treme-Ipi IgG1 CH) | Length | Theoretical Minimum U (%) | Theoretical Minimum U (abs) | Phe | |
|---|---|---|---|---|---|
| Treme_Ipi_HC_IgG1 | 330 | 10.61% | 105 | 10 | |
| **Nucleic Acid** | **Length** | **U Content(abs)** | **U Content(%)** | **U Content v WT (%)** | **U Content v Theoretical Minimum (%)** |
| Treme_Ipi_HC_IgG1 | 990 | 159 | 16.06% | 100.00% | 151.43% |
| | MAX | 154 | 15.56% | 96.86% | 146.67% |
| | MIN | 134 | 13.54% | 84.28% | 127.62% |
| | MEAN | 146.04 | 14.75% | 91.85% | 139.09% |
| | MEDIAN | 146 | 14.75% | 91.82% | 139.05% |
| | STD DEV | 5.33 | 0.54% | 3.35% | 5.08% |

FIG. 86A

| Protein | Length | Theoretical Maximum G (%) | Theoretical Maximum G (abs) | | |
|---|---|---|---|---|---|
| Treme_Ipi_HC_IgG1 | 330 | 39.70% | 393 | | |
| **Nucleic Acid** | **Length** | **G Content(abs)** | **G Content(%)** | **G Content v WT (%)** | **G Content v Theoretical Maximum (%)** |
| Treme_Ipi_HC_IgG1 | 990 | 260 | 26.26% | 100.00% | 66.16% |
| | MAX | 299 | 30.20% | 115.00% | 76.08% |
| | MIN | 270 | 27.27% | 103.85% | 68.70% |
| | MEAN | 285.56 | 28.84% | 109.83% | 72.66% |
| | MEDIAN | 285 | 28.79% | 109.62% | 72.52% |
| | STD DEV | 6.10 | 0.62% | 2.35% | 1.55% |

FIG. 86B

| Protein | Length | Theoretical Maximum C (%) | Theoretical Maximum C (abs) | | |
|---|---|---|---|---|---|
| Treme_Ipi_HC_IgG1 | 330 | 46.26% | 458 | | |
| **Nucleic Acid** | **Length** | **C Content(abs)** | **C Content(%)** | **C Content v WT (%)** | **C Content v Theoretical Maximum (%)** |
| Treme_Ipi_HC_IgG1 | 990 | 338 | 34.14% | 100.00% | 73.80% |
| | MAX | 346 | 34.95% | 102.37% | 75.55% |
| | MIN | 316 | 31.92% | 93.49% | 69.00% |
| | MEAN | 332.02 | 33.54% | 98.23% | 72.49% |
| | MEDIAN | 331.5 | 33.48% | 98.08% | 72.38% |
| | STD DEV | 7.68 | 0.78% | 2.27% | 1.68% |

FIG. 86C

| Protein | Length | Theoretical Maximum GC (%) | Theoretical Maximum GC (abs) | | |
|---|---|---|---|---|---|
| Treme_Ipi_HC_IgG1 | 330 | 66.36% | 657 | | |
| **Nucleic Acid** | **Length** | **GC Content (abs)** | **GC Content(%)** | **GC Content v WT (%)** | **GC Content v Theoretical Maximum (%)** |
| Treme_Ipi_HC_IgG1 | 990 | 598 | 60.40% | 100.00% | 91.02% |
| | MAX | 632 | 63.84% | 105.69% | 96.19% |
| | MIN | 605 | 61.11% | 101.17% | 92.09% |
| | MEAN | 617.58 | 62.38% | 103.27% | 94.00% |
| | MEDIAN | 618 | 62.42% | 103.34% | 94.06% |
| | STD DEV | 6.68 | 0.68% | 1.12% | 1.02% |

FIG. 86D

| Protein | Length | Theoretical Minimum U (%) | Theoretical Minimum U (abs) | | |
|---|---|---|---|---|---|
| CD80-WT | 207 | 12.72% | 79 | | |
| **Nucleic Acid** | **Length** | **U Content(abs)** | **U Content(%)** | **U Content v WT (%)** | **U Content v Theoretical Minimum (%)** |
| CD80-WT | 621 | 159 | 25.60% | 100.00% | 201.27% |
| | MAX | 109 | 17.55% | 68.55% | 137.97% |
| | MIN | 95 | 15.30% | 59.75% | 120.25% |
| | MEAN | 101.28 | 16.31% | 63.70% | 128.20% |
| | MEDIAN | 101 | 16.26% | 63.52% | 127.85% |
| | STD DEV | 4.01 | 0.64% | 2.52% | 5.07% |

FIG. 87A

| Protein | Length | Theoretical Minimum U (%) | Theoretical Minimum U (abs) | | |
|---|---|---|---|---|---|
| Fc-WT | 227 | 10.87% | 74 | | |
| **Nucleic Acid** | **Length** | **U Content(abs)** | **U Content(%)** | **U Content v WT (%)** | **U Content v Theoretical Minimum (%)** |
| Fc-WT | 681 | 106 | 15.57% | 100.00% | 143.24% |
| | MAX | 106 | 15.57% | 100.00% | 143.24% |
| | MIN | 91 | 13.36% | 85.85% | 122.97% |
| | MEAN | 100.4 | 14.74% | 94.72% | 135.68% |
| | MEDIAN | 101 | 14.83% | 95.28% | 136.49% |
| | STD DEV | 4.00 | 0.59% | 3.77% | 5.41% |

FIG. 87B

| Protein | Length | Theoretical Maximum G (%) | Theoretical Maximum G (abs) | | |
|---|---|---|---|---|---|
| CD80-WT | 207 | 36.07% | 224 | | |
| **Nucleic Acid** | **Length** | **G Content(abs)** | **G Content(%)** | **G Content v WT (%)** | **G Content v Theoretical Maximum (%)** |
| CD80-WT | 621 | 133 | 21.42% | 100.00% | 59.38% |
| | MAX | 169 | 27.21% | 127.07% | 75.45% |
| | MIN | 153 | 24.64% | 115.04% | 68.30% |
| | MEAN | 161.4 | 25.99% | 121.35% | 72.05% |
| | MEDIAN | 162 | 26.09% | 121.80% | 72.32% |
| | STD DEV | 4.10 | 0.66% | 3.08% | 1.83% |

FIG. 87C

| Protein | Length | Theoretical Maximum G (%) | Theoretical Maximum G (abs) | | |
|---|---|---|---|---|---|
| Fc-WT | 227 | 38.77% | 264 | | |
| **Nucleic Acid** | **Length** | **G Content(abs)** | **G Content(%)** | **G Content v WT (%)** | **G Content v Theoretical Maximum (%)** |
| Fc-WT | 681 | 180 | 26.43% | 100.00% | 70.31% |
| | MAX | 209 | 30.69% | 116.11% | 81.64% |
| | MIN | 190 | 27.90% | 105.56% | 74.22% |
| | MEAN | 197.88 | 29.06% | 109.93% | 77.30% |
| | MEDIAN | 198 | 29.07% | 110.00% | 77.34% |
| | STD DEV | 4.90 | 0.72% | 2.72% | 1.91% |

FIG. 87D

| Protein | Length | Theoretical Maximum C (%) | Theoretical Maximum C (abs) | | |
|---|---|---|---|---|---|
| CD80-WT | 207 | 41.22% | 256 | | |
| **Nucleic Acid** | **Length** | **C Content(abs)** | **C Content(%)** | **C Content v WT (%)** | **C Content v Theoretical Maximum (%)** |
| CD80-WT | 621 | 139 | 22.38% | 100.00% | 54.30% |
| | MAX | 201 | 32.37% | 144.60% | 78.52% |
| | MIN | 180 | 28.99% | 129.50% | 70.31% |
| | MEAN | 193.44 | 31.15% | 139.17% | 75.56% |
| | MEDIAN | 193 | 31.08% | 138.85% | 75.39% |
| | STD DEV | 5.09 | 0.82% | 3.66% | 1.99% |

FIG. 87E

| Protein | Length | Theoretical Maximum C (%) | Theoretical Maximum C (abs) | | |
|---|---|---|---|---|---|
| Fc-WT | 227 | 44.64% | 304 | | |
| **Nucleic Acid** | **Length** | **C Content(abs)** | **C Content(%)** | **C Content v WT (%)** | **C Content v Theoretical Maximum (%)** |
| Fc-WT | 681 | 225 | 33.04% | 100.00% | 74.01% |
| | MAX | 229 | 33.63% | 101.78% | 75.33% |
| | MIN | 206 | 30.25% | 91.56% | 67.76% |
| | MEAN | 221.28 | 32.49% | 98.35% | 72.79% |
| | MEDIAN | 222 | 32.60% | 98.67% | 73.03% |
| | STD DEV | 5.18 | 0.76% | 2.30% | 1.71% |

FIG. 87F

| Protein | Length | Theoretical Maximum GC (%) | Theoretical Maximum GC (abs) | | |
|---|---|---|---|---|---|
| CD80-WT | 207 | 61.67% | 383 | | |
| **Nucleic Acid** | **Length** | **GC Content (abs)** | **GC Content(%)** | **GC Content v WT (%)** | **GC Content v Theoretical Maximum (%)** |
| CD80-WT | 621 | 272 | 43.80% | 100.00% | 71.02% |
| | MAX | 363 | 58.45% | 133.46% | 94.78% |
| | MIN | 346 | 55.72% | 127.21% | 90.34% |
| | MEAN | 354.84 | 57.14% | 130.46% | 92.65% |
| | MEDIAN | 355 | 57.17% | 130.51% | 92.69% |
| | STD DEV | 4.22 | 0.68% | 1.55% | 1.10% |

FIG. 87G

| Protein | Length | Theoretical Maximum GC (%) | Theoretical Maximum GC (abs) | | |
|---|---|---|---|---|---|
| Fc-WT | 227 | 65.49% | 446 | | |
| **Nucleic Acid** | **Length** | **GC Content (abs)** | **GC Content(%)** | **GC Content v WT (%)** | **GC Content v Theoretical Maximum (%)** |
| Fc-WT | 681 | 405 | 59.47% | 100.00% | 90.81% |
| | MAX | 426 | 62.56% | 105.19% | 95.52% |
| | MIN | 414 | 60.79% | 102.22% | 92.83% |
| | MEAN | 419.16 | 61.55% | 103.50% | 93.98% |
| | MEDIAN | 418 | 61.38% | 103.21% | 93.72% |
| | STD DEV | 3.98 | 0.58% | 0.98% | 0.89% |

FIG. 87H

| CD80 (w/o SP) Moiety | | | | |
|---|---|---|---|---|
| Sequence | GC | GC 1st | GC 2nd | GC 3rd |
| *CD80-WT* | *43.8* | *45.89* | *35.75* | *49.76* |
| MAX | 58.45 | 48.79 | 35.75 | 92.27 |
| MIN | 55.72 | 46.38 | 35.75 | 85.02 |
| MEAN | 57.14 | 47.34 | 35.75 | 88.33 |
| MEDIAN | 57.17 | 47.34 | 35.75 | 88.41 |
| STD DEV | 0.68 | 0.71 | 0.00 | 1.86 |

FIG. 88A

| Fc Moiety | | | | |
|---|---|---|---|---|
| Sequence | GC | GC 1st | GC 2nd | GC 3rd |
| *Fc-WT* | *59.47* | *55.95* | *40.09* | *82.38* |
| MAX | 62.56 | 55.51 | 40.09 | 92.95 |
| MIN | 60.79 | 53.3 | 40.09 | 87.22 |
| MEAN | 61.55 | 54.82 | 40.09 | 89.75 |
| MEDIAN | 61.38 | 55.07 | 40.09 | 89.43 |
| STD DEV | 0.58 | 0.61 | 0.00 | 1.54 |

FIG. 88B

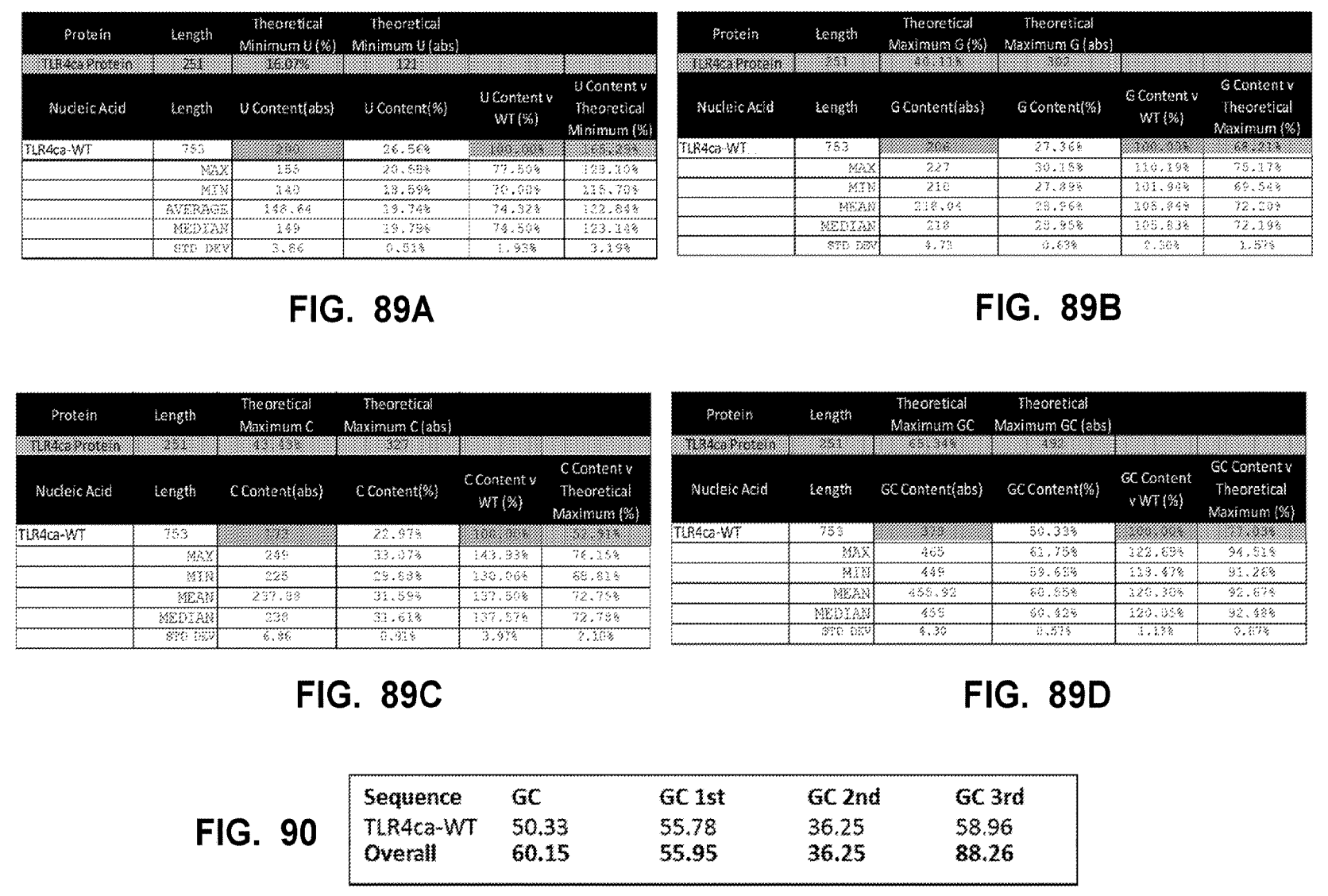

| Protein | Length | Theoretical Minimum U (%) | Theoretical Minimum U (abs) | | |
|---|---|---|---|---|---|
| TLR4ca Protein | 251 | 16.07% | 121 | | |
| **Nucleic Acid** | **Length** | **U Content(abs)** | **U Content(%)** | **U Content v WT (%)** | **U Content v Theoretical Minimum (%)** |
| TLR4ca-WT | 753 | 200 | 26.56% | 100.00% | 165.29% |
| | MAX | 155 | 20.58% | 77.50% | 128.10% |
| | MIN | 140 | 18.59% | 70.00% | 115.70% |
| | AVERAGE | 148.64 | 19.74% | 74.32% | 122.84% |
| | MEDIAN | 149 | 19.79% | 74.50% | 123.14% |
| | STD DEV | 3.86 | 0.51% | 1.93% | 3.19% |

FIG. 89A

| Protein | Length | Theoretical Maximum G (%) | Theoretical Maximum G (abs) | | |
|---|---|---|---|---|---|
| TLR4ca Protein | 251 | 40.11% | 302 | | |
| **Nucleic Acid** | **Length** | **G Content(abs)** | **G Content(%)** | **G Content v WT (%)** | **G Content v Theoretical Maximum (%)** |
| TLR4ca-WT | 753 | 206 | 27.36% | 100.00% | 68.21% |
| | MAX | 227 | 30.15% | 110.19% | 75.17% |
| | MIN | 210 | 27.89% | 101.94% | 69.54% |
| | MEAN | 218.04 | 28.96% | 105.84% | 72.20% |
| | MEDIAN | 218 | 28.95% | 105.83% | 72.19% |
| | STD DEV | 4.73 | 0.63% | 2.30% | 1.57% |

FIG. 89B

| Protein | Length | Theoretical Maximum C | Theoretical Maximum C (abs) | | |
|---|---|---|---|---|---|
| TLR4ca Protein | 251 | 43.43% | 327 | | |
| **Nucleic Acid** | **Length** | **C Content(abs)** | **C Content(%)** | **C Content v WT (%)** | **C Content v Theoretical Maximum (%)** |
| TLR4ca-WT | 753 | 173 | 22.97% | 100.00% | 52.91% |
| | MAX | 249 | 33.07% | 143.93% | 76.15% |
| | MIN | 225 | 29.88% | 130.06% | 68.81% |
| | MEAN | 237.88 | 31.59% | 137.50% | 72.75% |
| | MEDIAN | 238 | 31.61% | 137.57% | 72.78% |
| | STD DEV | 6.86 | 0.91% | 3.97% | 2.10% |

FIG. 89C

| Protein | Length | Theoretical Maximum GC | Theoretical Maximum GC (abs) | | |
|---|---|---|---|---|---|
| TLR4ca Protein | 251 | 65.34% | 492 | | |
| **Nucleic Acid** | **Length** | **GC Content(abs)** | **GC Content(%)** | **GC Content v WT (%)** | **GC Content v Theoretical Maximum (%)** |
| TLR4ca-WT | 753 | 379 | 50.33% | 100.00% | 77.03% |
| | MAX | 465 | 61.75% | 122.69% | 94.51% |
| | MIN | 449 | 59.63% | 118.47% | 91.26% |
| | MEAN | 455.92 | 60.55% | 120.30% | 92.67% |
| | MEDIAN | 455 | 60.42% | 120.05% | 92.48% |
| | STD DEV | 4.30 | 0.57% | 1.13% | 0.87% |

| Sequence | GC | GC 1st | GC 2nd | GC 3rd |
|---|---|---|---|---|
| TLR4ca-WT | 50.33 | 55.78 | 36.25 | 58.96 |
| **Overall** | **60.15** | **55.95** | **36.25** | **88.26** |

| Protein | Length | Theoretical Minimum U (%) | Theoretical Minimum U (abs) | | |
|---|---|---|---|---|---|
| IL12B WT | 306 | 10.78% | 99 | | |
| **Nucleic Acid** | **Length** | **U Content(abs)** | **U Content(%)** | **U Content v WT (%)** | **U Content v Theoretical Minimum (%)** |
| IL12B WT | 918 | 195 | 21.24% | 100.00% | 196.97% |
| | MAX | 275 | 29.96% | 141.03% | 277.78% |
| | MIN | 109 | 11.87% | 55.90% | 110.10% |
| | MEAN | 173.25 | 18.87% | 88.85% | 175.00% |
| | MEDIAN | 176 | 19.17% | 90.26% | 177.78% |
| | STD DEV | 44.19 | 4.81% | 22.66% | 44.63% |

FIG. 91A

| Protein | Length | Theoretical Maximum G (%) | Theoretical Maximum G (abs) | | |
|---|---|---|---|---|---|
| IL12B WT | 306 | 40.74% | 374 | | |
| **Nucleic Acid** | **Length** | **G Content(abs)** | **G Content(%)** | **G Content v WT (%)** | **G Content v Theoretical Maximum (%)** |
| IL12B WT | 918 | 243 | 26.47% | 100.00% | 64.97% |
| | MAX | 374 | 40.74% | 153.91% | 100.00% |
| | MIN | 219 | 23.86% | 90.12% | 58.56% |
| | MEAN | 260.55 | 28.38% | 107.22% | 69.67% |
| | MEDIAN | 249.5 | 27.18% | 102.67% | 66.71% |
| | STD DEV | 35.31 | 3.85% | 14.53% | 9.44% |

FIG. 91B

| Protein | Length | Theoretical Maximum C (%) | Theoretical Maximum C (abs) | | |
|---|---|---|---|---|---|
| IL12B WT | 306 | 41.61% | 382 | | |
| **Nucleic Acid** | **Length** | **C Content(abs)** | **C Content(%)** | **C Content v WT (%)** | **C Content v Theoretical Maximum (%)** |
| IL12B WT | 918 | 223 | 24.29% | 100.00% | 58.38% |
| | MAX | 279 | 30.39% | 125.11% | 73.04% |
| | MIN | 213 | 23.20% | 95.52% | 55.76% |
| | MEAN | 238.05 | 25.93% | 106.75% | 62.32% |
| | MEDIAN | 238.5 | 25.98% | 106.95% | 62.43% |
| | STD DEV | 18.41 | 2.01% | 8.26% | 4.82% |

FIG. 91C

| Protein | Length | Theoretical Maximum GC (%) | Theoretical Maximum GC (abs) | | |
|---|---|---|---|---|---|
| IL12B WT | 306 | 65.25% | 599 | | |
| **Nucleic Acid** | **Length** | **GC Content (abs)** | **GC Content(%)** | **GC Content v WT (%)** | **GC Content v Theoretical Maximum (%)** |
| IL12B WT | 918 | 466 | 50.76% | 100.00% | 77.80% |
| | MAX | 587 | 63.94% | 125.97% | 98.00% |
| | MIN | 449 | 48.91% | 96.35% | 74.96% |
| | MEAN | 498.6 | 54.31% | 107.00% | 83.24% |
| | MEDIAN | 489.5 | 53.32% | 105.04% | 81.72% |
| | STD DEV | 43.23 | 4.71% | 9.28% | 7.22% |

FIG. 91D

| Protein | Length | Theoretical Minimum U (%) | Theoretical Minimum U (abs) | | |
|---|---|---|---|---|---|
| IL12B WT | 306 | 10.78% | 99 | | |
| **Nucleic Acid** | **Length** | **U Content(abs)** | **U Content(%)** | **U Content v WT (%)** | **U Content v Theoretical Minimum (%)** |
| IL12B WT | 918 | 195 | 21.24% | 100.00% | 156.97% |
| | MAX | 149 | 16.23% | 76.41% | 150.51% |
| | MIN | 131 | 14.27% | 67.18% | 132.32% |
| | MEAN | 141.1 | 15.37% | 72.36% | 142.53% |
| | MEDIAN | 141 | 15.36% | 72.31% | 142.42% |
| | STD DEV | 5.37 | 0.58% | 2.75% | 5.42% |

FIG. 92A

| Protein | Length | Theoretical Maximum G (%) | Theoretical Maximum G (abs) | | |
|---|---|---|---|---|---|
| IL12B WT | 306 | 40.74% | 374 | | |
| **Nucleic Acid** | **Length** | **G Content(abs)** | **G Content(%)** | **G Content v WT (%)** | **G Content v Theoretical Maximum (%)** |
| IL12B WT | 918 | 243 | 26.47% | 100.00% | 64.97% |
| | MAX | 294 | 32.03% | 120.99% | 78.61% |
| | MIN | 279 | 30.39% | 114.81% | 74.60% |
| | MEAN | 287.35 | 31.30% | 118.25% | 76.83% |
| | MEDIAN | 288 | 31.37% | 118.52% | 77.01% |
| | STD DEV | 4.63 | 0.50% | 1.90% | 1.24% |

FIG. 92B

| Protein | Length | Theoretical Maximum C (%) | Theoretical Maximum C (abs) | | |
|---|---|---|---|---|---|
| IL12B WT | 306 | 41.61% | 382 | | |
| **Nucleic Acid** | **Length** | **C Content(abs)** | **C Content(%)** | **C Content v WT (%)** | **C Content v Theoretical Maximum (%)** |
| IL12B WT | 918 | 223 | 24.29% | 100.00% | 58.38% |
| | MAX | 279 | 30.39% | 125.11% | 73.04% |
| | MIN | 262 | 28.54% | 117.49% | 68.59% |
| | MEAN | 270.15 | 29.43% | 121.14% | 70.72% |
| | MEDIAN | 270 | 29.41% | 121.08% | 70.68% |
| | STD DEV | 4.76 | 0.52% | 2.13% | 1.25% |

FIG. 92C

| Protein | Length | Theoretical Maximum GC (%) | Theoretical Maximum GC (abs) | | |
|---|---|---|---|---|---|
| IL12B WT | 306 | 65.25% | 599 | | |
| **Nucleic Acid** | **Length** | **GC Content (abs)** | **GC Content(%)** | **GC Content v WT (%)** | **GC Content v Theoretical Maximum (%)** |
| IL12B WT | 918 | 466 | 50.76% | 100.00% | 77.80% |
| | MAX | 565 | 61.55% | 121.24% | 94.32% |
| | MIN | 547 | 59.59% | 117.38% | 91.32% |
| | MEAN | 557.5 | 60.73% | 119.64% | 93.07% |
| | MEDIAN | 557 | 60.68% | 119.53% | 92.99% |
| | STD DEV | 4.67 | 0.51% | 1.00% | 0.78% |

FIG. 92D

| Protein | Length | Theoretical Minimum U (%) | Theoretical Minimum U (abs) | | |
|---|---|---|---|---|---|
| IL12A WT | 197 | 12.86% | 76 | | |
| **Nucleic Acid** | **Length** | **U Content(abs)** | **U Content(%)** | **U Content v WT (%)** | **U Content v Theoretical Minimum (%)** |
| IL12A WT | 591 | 151 | 25.55% | 100.00% | 198.68% |
| | MAX | 189 | 31.98% | 125.17% | 248.68% |
| | MIN | 83 | 14.04% | 54.97% | 109.21% |
| | MEAN | 126.3 | 21.37% | 83.64% | 166.18% |
| | MEDIAN | 125 | 21.15% | 82.78% | 164.47% |
| | STD DEV | 28.03 | 4.74% | 18.56% | 36.88% |

FIG. 93A

| Protein | Length | Theoretical Maximum G (%) | Theoretical Maximum G (abs) | | |
|---|---|---|---|---|---|
| IL12A WT | 197 | 34.69% | 205 | | |
| **Nucleic Acid** | **Length** | **G Content(abs)** | **G Content(%)** | **G Content v WT (%)** | **G Content v Theoretical Maximum (%)** |
| IL12A WT | 591 | 123 | 20.81% | 100.00% | 60.00% |
| | MAX | 205 | 34.69% | 166.67% | 100.00% |
| | MIN | 108 | 18.27% | 87.80% | 52.68% |
| | MEAN | 134.7 | 22.79% | 109.51% | 65.71% |
| | MEDIAN | 131 | 22.17% | 106.50% | 63.90% |
| | STD DEV | 22.88 | 3.87% | 18.60% | 11.16% |

FIG. 93B

| Protein | Length | Theoretical Maximum C (%) | Theoretical Maximum C (abs) | | |
|---|---|---|---|---|---|
| IL12A WT | 197 | 43.82% | 259 | | |
| **Nucleic Acid** | **Length** | **C Content(abs)** | **C Content(%)** | **C Content v WT (%)** | **C Content v Theoretical Maximum (%)** |
| IL12A WT | 591 | 138 | 23.35% | 100.00% | 53.28% |
| | MAX | 191 | 32.32% | 138.41% | 73.75% |
| | MIN | 140 | 23.69% | 101.45% | 54.05% |
| | MEAN | 164.8 | 27.88% | 119.42% | 63.63% |
| | MEDIAN | 164 | 27.75% | 118.84% | 63.32% |
| | STD DEV | 12.22 | 2.07% | 8.85% | 4.72% |

FIG. 93C

| Protein | Length | Theoretical Maximum GC (%) | Theoretical Maximum GC (abs) | | |
|---|---|---|---|---|---|
| IL12A WT | 197 | 62.27% | 368 | | |
| **Nucleic Acid** | **Length** | **GC Content (abs)** | **GC Content(%)** | **GC Content v WT (%)** | **GC Content v Theoretical Maximum (%)** |
| IL12A WT | 591 | 261 | 44.16% | 100.00% | 70.92% |
| | MAX | 359 | 60.74% | 137.55% | 97.55% |
| | MIN | 265 | 44.84% | 101.53% | 72.01% |
| | MEAN | 299.5 | 50.68% | 114.75% | 81.39% |
| | MEDIAN | 293 | 49.58% | 112.26% | 79.62% |
| | STD DEV | 29.23 | 4.95% | 11.20% | 7.94% |

FIG. 93D

| Protein | Length | Theoretical Minimum U (%) | Theoretical Minimum U (abs) | | |
|---|---|---|---|---|---|
| IL12A WT | 197 | 12.86% | 76 | | |
| **Nucleic Acid** | **Length** | **U Content(abs)** | **U Content(%)** | **U Content v WT (%)** | **U Content v Theoretical Minimum (%)** |
| IL12A WT | 591 | 151 | 25.55% | 100.00% | 198.68% |
| | MAX | 109 | 18.44% | 72.19% | 143.42% |
| | MIN | 95 | 16.07% | 62.91% | 125.00% |
| | MEAN | 101.9 | 17.24% | 67.48% | 134.08% |
| | MEDIAN | 102 | 17.26% | 67.55% | 134.21% |
| | STD DEV | 4.27 | 0.72% | 2.83% | 5.61% |

FIG. 94A

| Protein | Length | Theoretical Maximum G (%) | Theoretical Maximum G (abs) | | |
|---|---|---|---|---|---|
| IL12A WT | 197 | 34.69% | 205 | | |
| **Nucleic Acid** | **Length** | **G Content(abs)** | **G Content(%)** | **G Content v WT (%)** | **G Content v Theoretical Maximum (%)** |
| IL12A WT | 591 | 123 | 20.81% | 100.00% | 60.00% |
| | MAX | 160 | 27.07% | 130.08% | 78.05% |
| | MIN | 147 | 24.87% | 119.51% | 71.71% |
| | MEAN | 153.45 | 25.96% | 124.76% | 74.85% |
| | MEDIAN | 153.5 | 25.97% | 124.80% | 74.88% |
| | STD DEV | 3.38 | 0.57% | 2.75% | 1.65% |

FIG. 94B

| Protein | Length | Theoretical Maximum C (%) | Theoretical Maximum C (abs) | | |
|---|---|---|---|---|---|
| IL12A WT | 197 | 43.82% | 259 | | |
| **Nucleic Acid** | **Length** | **C Content(abs)** | **C Content(%)** | **C Content v WT (%)** | **C Content v Theoretical Maximum (%)** |
| IL12A WT | 591 | 138 | 23.35% | 100.00% | 53.28% |
| | MAX | 195 | 32.99% | 141.30% | 75.29% |
| | MIN | 179 | 30.29% | 129.71% | 69.11% |
| | MEAN | 187.8 | 31.78% | 136.09% | 72.51% |
| | MEDIAN | 187.5 | 31.73% | 135.87% | 72.39% |
| | STD DEV | 4.05 | 0.68% | 2.93% | 1.56% |

FIG. 94C

| Protein | Length | Theoretical Maximum GC (%) | Theoretical Maximum GC (abs) | | |
|---|---|---|---|---|---|
| IL12A WT | 197 | 62.27% | 368 | | |
| **Nucleic Acid** | **Length** | **GC Content (abs)** | **GC Content(%)** | **GC Content v WT (%)** | **GC Content v Theoretical Maximum (%)** |
| IL12A WT | 591 | 261 | 44.16% | 100.00% | 70.92% |
| | MAX | 350 | 59.22% | 134.10% | 95.11% |
| | MIN | 337 | 57.02% | 129.12% | 91.58% |
| | MEAN | 341.25 | 57.74% | 130.75% | 92.73% |
| | MEDIAN | 340 | 57.53% | 130.27% | 92.39% |
| | STD DEV | 4.08 | 0.69% | 1.56% | 1.11% |

FIG. 94D

| IL12B (w/o SP) G5 SEQUENCES | | | | |
|---|---|---|---|---|
| Sequence | GC | GC 1st | GC 2nd | GC 3rd |
| **IL12B_WT** | **50.76** | **48.04** | **43.14** | **61.11** |
| MAX | 63.94 | 50.65 | 43.14 | 100 |
| MIN | 48.91 | 48.04 | 43.14 | 54.25 |
| MEAN | 54.31 | 49.46 | 43.14 | 70.34 |
| MEDIAN | 53.325 | 49.35 | 43.14 | 66.34 |
| STD DEV | 4.71 | 0.80 | 0.00 | 14.42 |

FIG. 95A

| IL12B (w/o SP) G6 SEQUENCES | | | | |
|---|---|---|---|---|
| Sequence | GC | GC 1st | GC 2nd | GC 3rd |
| **IL12B_WT** | **50.76** | **48.04** | **43.14** | **61.11** |
| MAX | 61.55 | 51.63 | 43.14 | 91.83 |
| MIN | 59.59 | 49.35 | 43.14 | 85.29 |
| MEAN | 60.73 | 50.33 | 43.14 | 88.73 |
| MEDIAN | 60.68 | 50.33 | 43.14 | 88.725 |
| STD DEV | 0.51 | 0.61 | 0.00 | 1.60 |

FIG. 95B

| IL12A (w/o SP) G5 SEQUENCES | | | | |
|---|---|---|---|---|
| Sequence | GC | GC 1st | GC 2nd | GC 3rd |
| **IL12A_WT** | **44.16** | **45.18** | **35.53** | **51.78** |
| MAX | 60.74 | 48.73 | 35.53 | 100 |
| MIN | 44.84 | 43.65 | 35.53 | 52.28 |
| MEAN | 50.68 | 46.35 | 35.53 | 70.15 |
| MEDIAN | 49.58 | 46.7 | 35.53 | 67.765 |
| STD DEV | 4.94 | 1.44 | 0.00 | 14.35 |

FIG. 95C

| IL12B (w/o SP) G6 SEQUENCES | | | | |
|---|---|---|---|---|
| Sequence | GC | GC 1st | GC 2nd | GC 3rd |
| **IL12A_WT** | **44.16** | **45.18** | **35.53** | **51.78** |
| MAX | 59.22 | 51.27 | 35.53 | 93.91 |
| MIN | 57.02 | 46.7 | 35.53 | 85.79 |
| MEAN | 57.74 | 48.45 | 35.53 | 89.24 |
| MEDIAN | 57.53 | 48.22 | 35.53 | 88.83 |
| STD DEV | 0.69 | 1.02 | 0.00 | 1.80 |

FIG. 95D

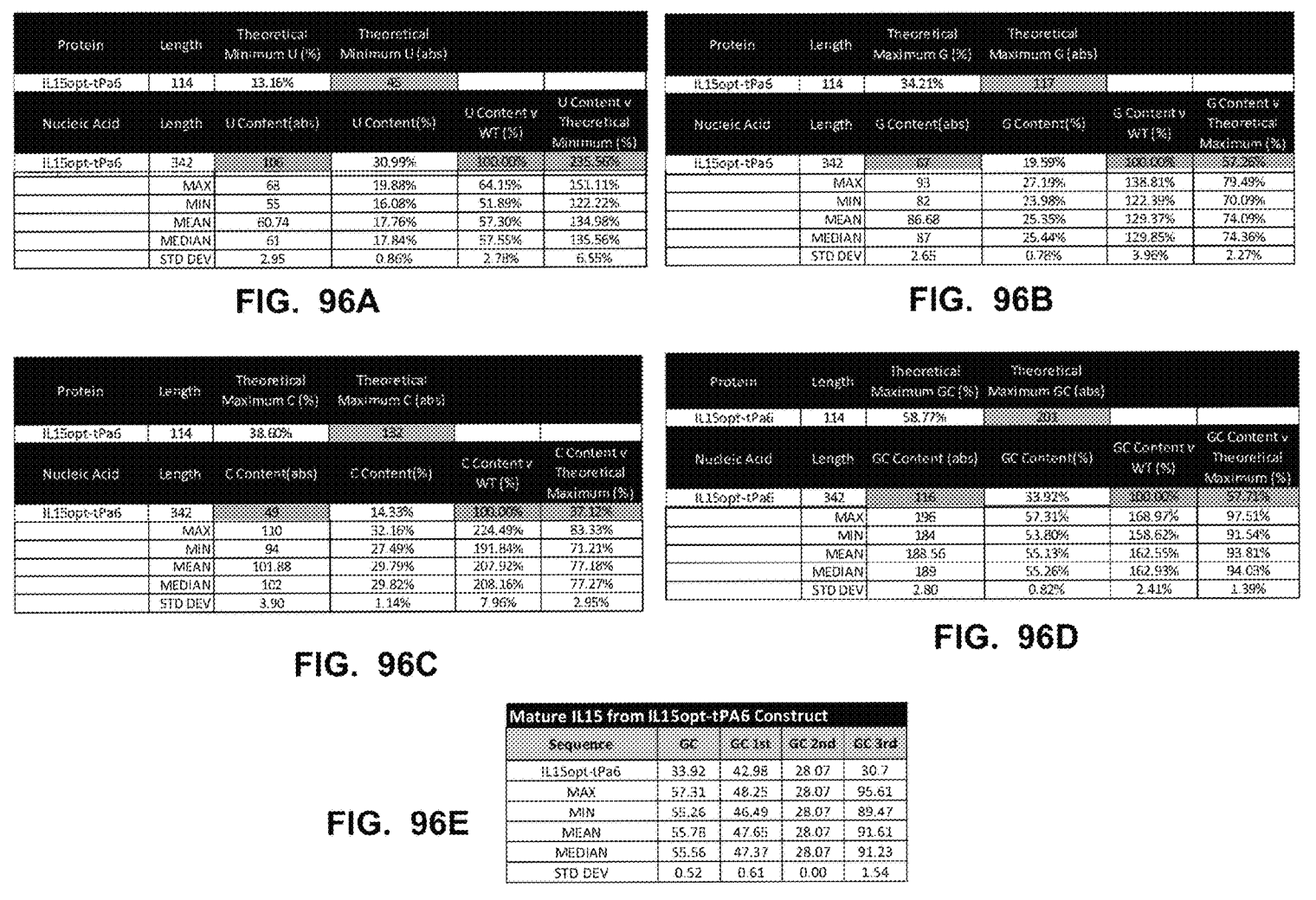

| Protein | Length | Theoretical Minimum U (%) | Theoretical Minimum U (abs) | | |
|---|---|---|---|---|---|
| IL15opt-tPa6 | 114 | 13.16% | 45 | | |
| **Nucleic Acid** | **Length** | **U Content(abs)** | **U Content(%)** | **U Content v WT (%)** | **U Content v Theoretical Minimum (%)** |
| IL15opt-tPa6 | 342 | 106 | 30.99% | 100.00% | 235.56% |
| | MAX | 68 | 19.88% | 64.15% | 151.11% |
| | MIN | 55 | 16.08% | 51.89% | 122.22% |
| | MEAN | 60.74 | 17.76% | 57.30% | 134.98% |
| | MEDIAN | 61 | 17.84% | 57.55% | 135.56% |
| | STD DEV | 2.95 | 0.86% | 2.78% | 6.55% |

FIG. 96A

| Protein | Length | Theoretical Maximum G (%) | Theoretical Maximum G (abs) | | |
|---|---|---|---|---|---|
| IL15opt-tPa6 | 114 | 34.21% | 117 | | |
| **Nucleic Acid** | **Length** | **G Content(abs)** | **G Content(%)** | **G Content v WT (%)** | **G Content v Theoretical Maximum (%)** |
| IL15opt-tPa6 | 342 | 67 | 19.59% | 100.00% | 57.26% |
| | MAX | 93 | 27.19% | 138.81% | 79.49% |
| | MIN | 82 | 23.98% | 122.39% | 70.09% |
| | MEAN | 86.68 | 25.35% | 129.37% | 74.09% |
| | MEDIAN | 87 | 25.44% | 129.85% | 74.36% |
| | STD DEV | 2.65 | 0.78% | 3.96% | 2.27% |

FIG. 96B

| Protein | Length | Theoretical Maximum C (%) | Theoretical Maximum C (abs) | | |
|---|---|---|---|---|---|
| IL15opt-tPa6 | 114 | 38.60% | 132 | | |
| **Nucleic Acid** | **Length** | **C Content(abs)** | **C Content(%)** | **C Content v WT (%)** | **C Content v Theoretical Maximum (%)** |
| IL15opt-tPa6 | 342 | 49 | 14.33% | 100.00% | 37.12% |
| | MAX | 110 | 32.16% | 224.49% | 83.33% |
| | MIN | 94 | 27.49% | 191.84% | 71.21% |
| | MEAN | 101.88 | 29.79% | 207.92% | 77.18% |
| | MEDIAN | 102 | 29.82% | 208.16% | 77.27% |
| | STD DEV | 3.90 | 1.14% | 7.96% | 2.95% |

FIG. 96C

| Protein | Length | Theoretical Maximum GC (%) | Theoretical Maximum GC (abs) | | |
|---|---|---|---|---|---|
| IL15opt-tPa6 | 114 | 58.77% | 201 | | |
| **Nucleic Acid** | **Length** | **GC Content (abs)** | **GC Content(%)** | **GC Content v WT (%)** | **GC Content v Theoretical Maximum (%)** |
| IL15opt-tPa6 | 342 | 116 | 33.92% | 100.00% | 57.71% |
| | MAX | 196 | 57.31% | 168.97% | 97.51% |
| | MIN | 184 | 53.80% | 158.62% | 91.54% |
| | MEAN | 188.56 | 55.13% | 162.55% | 93.81% |
| | MEDIAN | 189 | 55.26% | 162.93% | 94.03% |
| | STD DEV | 2.80 | 0.82% | 2.41% | 1.39% |

FIG. 96D

| Mature IL15 from IL15opt-tPA6 Construct | | | | |
|---|---|---|---|---|
| Sequence | GC | GC 1st | GC 2nd | GC 3rd |
| IL15opt-tPa6 | 33.92 | 42.98 | 28.07 | 30.7 |
| MAX | 57.31 | 48.25 | 28.07 | 95.61 |
| MIN | 55.26 | 46.49 | 28.07 | 89.47 |
| MEAN | 55.78 | 47.65 | 28.07 | 91.61 |
| MEDIAN | 55.56 | 47.37 | 28.07 | 91.23 |
| STD DEV | 0.52 | 0.61 | 0.00 | 1.54 |

FIG. 96E

| Protein | Length | Theoretical Minimum U (%) | Theoretical Minimum U (abs) | | |
|---|---|---|---|---|---|
| IL15_RLI/IL15_Fc_RLI | 78 | 9.40% | 22 | | |
| **Nucleic Acid** | **Length** | **U Content(abs)** | **U Content(%)** | **U Content v WT (%)** | **U Content v Theoretical Minimum (%)** |
| IL15_RLI/IL15_Fc_RLI | 234 | 48 | 20.51% | 100.00% | 218.18% |
| | MAX | 47 | 20.09% | 97.92% | 213.64% |
| | MIN | 31 | 13.25% | 64.58% | 140.91% |
| | MEAN | 36.76 | 15.71% | 76.58% | 167.09% |
| | MEDIAN | 37 | 15.81% | 77.08% | 168.18% |
| | STD DEV | 3.20 | 1.37% | 6.66% | 14.54% |

FIG. 97A

| Protein | Length | Theoretical Maximum G (%) | Theoretical Maximum G (abs) | | |
|---|---|---|---|---|---|
| IL15_RLI/IL15_Fc_RLI | 78 | 38.03% | 89 | | |
| **Nucleic Acid** | **Length** | **G Content(abs)** | **G Content(%)** | **G Content v WT (%)** | **G Content v Theoretical Maximum (%)** |
| IL15_RLI/IL15_Fc_RLI | 234 | 52 | 22.22% | 100.00% | 58.43% |
| | MAX | 69 | 29.49% | 132.69% | 77.53% |
| | MIN | 49 | 20.94% | 94.23% | 55.06% |
| | MEAN | 58.46 | 24.98% | 112.42% | 65.69% |
| | MEDIAN | 58 | 24.79% | 111.54% | 65.17% |
| | STD DEV | 4.63 | 1.98% | 8.90% | 5.20% |

FIG. 97B

| Protein | Length | Theoretical Maximum C (%) | Theoretical Maximum C (abs) | | |
|---|---|---|---|---|---|
| IL15_RLI/IL15_Fc_RLI | 78 | 50.00% | 117 | | |
| **Nucleic Acid** | **Length** | **C Content(abs)** | **C Content(%)** | **C Content v WT (%)** | **C Content v Theoretical Maximum (%)** |
| IL15_RLI/IL15_Fc_RLI | 234 | 58 | 24.79% | 100.00% | 49.57% |
| | MAX | 90 | 38.46% | 155.17% | 76.92% |
| | MIN | 79 | 33.76% | 136.21% | 67.52% |
| | MEAN | 84.06 | 35.92% | 144.93% | 71.85% |
| | MEDIAN | 84 | 35.90% | 144.83% | 71.79% |
| | STD DEV | 2.77 | 1.19% | 4.78% | 2.37% |

FIG. 97C

| Protein | Length | Theoretical Maximum GC (%) | Theoretical Maximum GC (abs) | | |
|---|---|---|---|---|---|
| IL15_RLI/IL15_Fc_RLI | 78 | 68.38% | 160 | | |
| **Nucleic Acid** | **Length** | **GC Content (abs)** | **GC Content(%)** | **GC Content v WT (%)** | **GC Content v Theoretical Maximum (%)** |
| IL15_RLI/IL15_Fc_RLI | 234 | 110 | 47.01% | 100.00% | 68.75% |
| | MAX | 150 | 64.10% | 136.36% | 93.75% |
| | MIN | 134 | 57.26% | 121.82% | 83.75% |
| | MEAN | 142.52 | 60.91% | 129.56% | 89.08% |
| | MEDIAN | 143 | 61.11% | 130.00% | 89.38% |
| | STD DEV | 4.24 | 1.81% | 3.85% | 2.65% |

FIG. 97D

IL15Ra Sushi from RLI and RLI-Fc Constructs

| Sequence | GC | GC 1st | GC 2nd | GC 3rd |
|---|---|---|---|---|
| IL15_RLI/IL15_Fc_RLI | 47.01 | 46.15 | 53.85 | 41.03 |
| MAX | 64.1 | 50 | 53.85 | 93.59 |
| MIN | 61.11 | 44.87 | 53.85 | 82.05 |
| MEAN | 62.45 | 47.28 | 53.85 | 86.21 |
| MEDIAN | 61.97 | 47.44 | 53.85 | 84.62 |
| STD DEV | 0.93 | 1.40 | 0.00 | 3.12 |

FIG. 97E

| Protein | Length | Theoretical Minimum U (%) | Theoretical Minimum U (abs) | | |
|---|---|---|---|---|---|
| IL15Ra_WT_miR122 | 238 | 7.56% | 54 | | |
| **Nucleic Acid** | **Length** | **U Content(abs)** | **U Content(%)** | **U Content v WT (%)** | **U Content v Theoretical Minimum (%)** |
| IL15Ra_WT_miR122 | 714 | 144 | 20.17% | 100.00% | 266.67% |
| | MAX | 101 | 14.15% | 70.14% | 187.04% |
| | MIN | 78 | 10.92% | 54.17% | 144.44% |
| | MEAN | 86 | 12.04% | 59.72% | 159.26% |
| | MEDIAN | 85 | 11.90% | 59.03% | 157.41% |
| | STD DEV | 4.97 | 0.70% | 3.45% | 9.21% |

FIG. 98A

| Protein | Length | Theoretical Maximum G (%) | Theoretical Maximum G (abs) | | |
|---|---|---|---|---|---|
| IL15Ra_WT_miR122 | 238 | 41.04% | 293 | | |
| **Nucleic Acid** | **Length** | **G Content(abs)** | **G Content(%)** | **G Content v WT (%)** | **G Content v Theoretical Maximum (%)** |
| IL15Ra_WT_miR122 | 714 | 161 | 22.55% | 100.00% | 54.95% |
| | MAX | 203 | 28.43% | 126.09% | 69.28% |
| | MIN | 187 | 26.19% | 116.15% | 63.82% |
| | MEAN | 195.52 | 27.38% | 121.44% | 66.73% |
| | MEDIAN | 195 | 27.31% | 121.12% | 66.55% |
| | STD DEV | 4.59 | 0.64% | 2.85% | 1.57% |

FIG. 98B

| Protein | Length | Theoretical Maximum C (%) | Theoretical Maximum C (abs) | | |
|---|---|---|---|---|---|
| IL15Ra_WT_miR122 | 238 | 52.38% | 374 | | |
| **Nucleic Acid** | **Length** | **C Content(abs)** | **C Content(%)** | **C Content v WT (%)** | **C Content v Theoretical Maximum (%)** |
| IL15Ra_WT_miR122 | 714 | 221 | 30.95% | 100.00% | 59.09% |
| | MAX | 292 | 40.90% | 132.13% | 78.07% |
| | MIN | 271 | 37.96% | 122.62% | 72.46% |
| | MEAN | 282.12 | 39.51% | 127.66% | 75.43% |
| | MEDIAN | 282 | 39.50% | 127.60% | 75.40% |
| | STD DEV | 5.74 | 0.80% | 2.60% | 1.53% |

FIG. 98C

| Protein | Length | Theoretical Maximum GC (%) | Theoretical Maximum GC (abs) | | |
|---|---|---|---|---|---|
| IL15Ra_WT_miR122 | 238 | 71.01% | 507 | | |
| **Nucleic Acid** | **Length** | **GC Content (abs)** | **GC Content(%)** | **GC Content v WT (%)** | **GC Content v Theoretical Maximum (%)** |
| IL15Ra_WT_miR122 | 714 | 382 | 53.50% | 100.00% | 75.35% |
| | MAX | 485 | 67.93% | 126.96% | 95.66% |
| | MIN | 469 | 65.69% | 122.77% | 92.50% |
| | MEAN | 477.64 | 66.90% | 125.04% | 94.21% |
| | MEDIAN | 477 | 66.81% | 124.87% | 94.08% |
| | STD DEV | 4.38 | 0.61% | 1.15% | 0.86% |

FIG. 98D

| Mature Wild Type IL15Rα | | | | |
|---|---|---|---|---|
| **Sequence** | **GC** | **GC 1st** | **GC 2nd** | **GC 3rd** |
| IL15Ra_WT_miR122 | 53.5 | 52.1 | 58.4 | 50 |
| MAX | 67.93 | 56.72 | 69.75 | 92.44 |
| MIN | 65.69 | 51.68 | 58.4 | 74.37 |
| MEAN | 66.90 | 52.64 | 58.85 | 89.20 |
| MEDIAN | 66.81 | 52.52 | 58.4 | 89.92 |
| STD DEV | 0.61 | 1.02 | 2.27 | 3.56 |

FIG. 98E

| Protein | Length | Theoretical Minimum U (%) | Theoretical Minimum U (abs) | | |
|---|---|---|---|---|---|
| IL15_RLI/IL15_Fc_RLI | 114 | 13.16% | 45 | | |
| **Nucleic Acid** | **Length** | **U Content(abs)** | **U Content(%)** | **U Content v WT (%)** | **U Content v Theoretical Minimum (%)** |
| IL15_RLI/IL15_Fc_RLI | 342 | 106 | 30.99% | 100.00% | 235.56% |
| | MAX | 72 | 21.05% | 67.92% | 160.00% |
| | MIN | 56 | 16.37% | 52.83% | 124.44% |
| | MEAN | 62.82 | 18.37% | 59.26% | 139.60% |
| | MEDIAN | 62.5 | 18.27% | 58.96% | 138.89% |
| | STD DEV | 3.73 | 1.09% | 3.52% | 8.29% |

FIG. 99A

| Protein | Length | Theoretical Maximum G (%) | Theoretical Maximum G (abs) | | |
|---|---|---|---|---|---|
| IL15_RLI/IL15_Fc_RLI | 114 | 34.21% | 117 | | |
| **Nucleic Acid** | **Length** | **G Content(abs)** | **G Content(%)** | **G Content v WT (%)** | **G Content v Theoretical Maximum (%)** |
| IL15_RLI/IL15_Fc_RLI | 342 | 67 | 19.59% | 100.00% | 57.26% |
| | MAX | 98 | 28.65% | 146.27% | 83.76% |
| | MIN | 83 | 24.27% | 123.88% | 70.94% |
| | MEAN | 91.06 | 26.63% | 135.91% | 77.83% |
| | MEDIAN | 91 | 26.61% | 135.82% | 77.78% |
| | STD DEV | 3.72 | 1.09% | 5.56% | 3.18% |

FIG. 99B

| Protein | Length | Theoretical Maximum C (%) | Theoretical Maximum C (abs) | | |
|---|---|---|---|---|---|
| IL15_RLI/IL15_Fc_RLI | 114 | 38.60% | 132 | | |
| **Nucleic Acid** | **Length** | **C Content(abs)** | **C Content(%)** | **C Content v WT (%)** | **C Content v Theoretical Maximum (%)** |
| IL15_RLI/IL15_Fc_RLI | 342 | 49 | 14.33% | 100.00% | 37.12% |
| | MAX | 103 | 30.12% | 210.20% | 78.03% |
| | MIN | 81 | 23.68% | 165.31% | 61.36% |
| | MEAN | 93 | 27.19% | 189.80% | 70.45% |
| | MEDIAN | 93 | 27.19% | 189.80% | 70.45% |
| | STD DEV | 4.29 | 1.25% | 8.76% | 3.25% |

FIG. 99C

| Protein | Length | Theoretical Maximum GC (%) | Theoretical Maximum GC (abs) | | |
|---|---|---|---|---|---|
| IL15_RLI/IL15_Fc_RLI | 114 | 58.77% | 201 | | |
| **Nucleic Acid** | **Length** | **GC Content (abs)** | **GC Content(%)** | **GC Content v WT (%)** | **GC Content v Theoretical Maximum (%)** |
| IL15_RLI/IL15_Fc_RLI | 342 | 116 | 33.92% | 100.00% | 57.71% |
| | MAX | 192 | 56.14% | 165.52% | 95.52% |
| | MIN | 174 | 50.88% | 150.00% | 86.57% |
| | MEAN | 184.06 | 53.82% | 158.67% | 91.57% |
| | MEDIAN | 184 | 53.80% | 158.62% | 91.54% |
| | STD DEV | 4.73 | 1.38% | 4.08% | 2.35% |

FIG. 99D

Mature IL15 fron RLI and RLI-Fc Constructs

| Sequence | GC | GC 1st | GC 2nd | GC 3rd |
|---|---|---|---|---|
| IL15_RLI/IL15_Fc_RLI | 33.92 | 42.98 | 28.07 | 30.7 |
| MAX | 56.14 | 48.25 | 28.07 | 92.11 |
| MIN | 53.8 | 47.37 | 28.07 | 85.09 |
| MEAN | 55.00 | 48.18 | 28.07 | 88.74 |
| MEDIAN | 54.97 | 48.25 | 28.07 | 88.6 |
| STD DEV | 0.63 | 0.24 | 0.00 | 1.80 |

FIG. 99E

| Mature IL18 Protein | Length | Theoretical Minimum U (%) | Theoretical Minimum U (abs) | | |
|---|---|---|---|---|---|
| IL18-WT | 157 | 13.38% | 63 | | |
| Nucleic Acid | Length | U Content(abs) | U Content(%) | U Content v WT (%) | U Content v Theoretical Minimum (%) |
| IL18-WT | 471 | 140 | 29.72% | 100.00% | 222.22% |
| | MAX | 91 | 19.32% | 65.00% | 144.44% |
| | MIN | 78 | 16.56% | 55.71% | 123.81% |
| | MEAN | 83.86 | 17.80% | 59.90% | 133.11% |
| | MEDIAN | 84 | 17.83% | 60.00% | 133.33% |
| | STD DEV | 3.23 | 0.69% | 2.31% | 5.13% |

FIG. 100A

| Mature IL18 Protein | Length | Theoretical Maximum G (%) | Theoretical Maximum G (abs) | | |
|---|---|---|---|---|---|
| IL18-WT | 157 | 32.76% | 159 | | |
| Nucleic Acid | Length | G Content(abs) | G Content(%) | G Content v WT (%) | G Content v Theoretical Maximum (%) |
| IL18-WT | 471 | 88 | 18.68% | 100.00% | 55.35% |
| | MAX | 131 | 27.81% | 148.86% | 82.39% |
| | MIN | 113 | 23.99% | 128.41% | 71.07% |
| | MEAN | 121.66 | 25.83% | 138.25% | 76.52% |
| | MEDIAN | 121 | 25.69% | 137.50% | 76.10% |
| | STD DEV | 3.46 | 0.73% | 3.93% | 2.17% |

FIG. 100B

| Mature IL18 Protein | Length | Theoretical Maximum C (%) | Theoretical Maximum C (abs) | | |
|---|---|---|---|---|---|
| IL18-WT | 157 | 38.43% | 181 | | |
| Nucleic Acid | Length | C Content(abs) | C Content(%) | C Content v WT (%) | C Content v Theoretical Maximum (%) |
| IL18-WT | 471 | 77 | 16.35% | 100.00% | 42.54% |
| | MAX | 145 | 30.79% | 188.31% | 80.11% |
| | MIN | 123 | 26.11% | 159.74% | 67.96% |
| | MEAN | 134.46 | 28.55% | 174.62% | 74.29% |
| | MEDIAN | 134 | 28.45% | 174.03% | 74.03% |
| | STD DEV | 4.88 | 1.04% | 6.34% | 2.70% |

FIG. 100C

| Mature IL18 Protein | Length | Theoretical Maximum GC (%) | Theoretical Maximum GC (abs) | | |
|---|---|---|---|---|---|
| IL18-WT | 157 | 59.24% | 279 | | |
| Nucleic Acid | Length | GC Content (abs) | GC Content(%) | GC Content v WT (%) | GC Content v Theoretical Maximum (%) |
| IL18-WT | 471 | 165 | 35.03% | 100.00% | 59.14% |
| | MAX | 265 | 56.26% | 160.61% | 94.98% |
| | MIN | 248 | 52.65% | 150.30% | 88.89% |
| | MEAN | 256.12 | 54.38% | 155.22% | 91.80% |
| | MEDIAN | 256 | 54.35% | 155.15% | 91.76% |
| | STD DEV | 4.09 | 0.87% | 2.48% | 1.47% |

FIG. 100D

| Sequence | GC | GC 1st | GC 2nd | GC 3rd |
|---|---|---|---|---|
| tPA_IL18-WT | 38.72 | 43.75 | 34.38 | 38.02 |
| MAX | 57.81 | 48.44 | 34.38 | 93.23 |
| MIN | 55.21 | 45.31 | 34.38 | 83.33 |
| MEAN | 56.60 | 47.00 | 34.38 | 88.44 |
| MEDIAN | 56.6 | 47.4 | 34.38 | 88.02 |
| STD DEV | 0.68 | 0.94 | 0.00 | 2.08 |

FIG. 100E

| Protein | Length | Theoretical Maximum C (%) | Theoretical Maximum C (abs) | | |
|---|---|---|---|---|---|
| IL2sp_IL18-WT | 177 | 39.74% | 211 | | |
| **Nucleic Acid** | **Length** | **C Content(abs)** | **C Content(%)** | **C Content v WT (%)** | **C Content v Theoretical Maximum (%)** |
| IL2sp_IL18-WT | 531 | 92 | 17.33% | 100.00% | 43.60% |
| | MAX | 169 | 31.83% | 183.70% | 80.09% |
| | MIN | 146 | 27.50% | 158.70% | 69.19% |
| | MEAN | 156.92 | 29.55% | 170.57% | 74.37% |
| | MEDIAN | 157 | 29.57% | 170.65% | 74.41% |
| | STD DEV | 6.05 | 1.14% | 6.58% | 2.87% |

FIG. 101A

| Protein | Length | Theoretical Maximum G (%) | Theoretical Maximum G (abs) | | |
|---|---|---|---|---|---|
| IL2sp_IL18-WT | 177 | 33.90% | 180 | | |
| **Nucleic Acid** | **Length** | **G Content(abs)** | **G Content(%)** | **G Content v WT (%)** | **G Content v Theoretical Maximum (%)** |
| IL2sp_IL18-WT | 531 | 99 | 18.64% | 100.00% | 55.00% |
| | MAX | 143 | 26.93% | 144.44% | 79.44% |
| | MIN | 128 | 24.11% | 129.29% | 71.11% |
| | MEAN | 134.08 | 25.25% | 135.43% | 74.49% |
| | MEDIAN | 133 | 25.05% | 134.34% | 73.89% |
| | STD DEV | 3.67 | 0.69% | 3.71% | 2.04% |

FIG. 101B

| Protein | Length | Theoretical Minimum U (%) | Theoretical Minimum U (abs) | | |
|---|---|---|---|---|---|
| IL2sp_IL18-WT | 177 | 13.75% | 73 | | |
| **Nucleic Acid** | **Length** | **U Content(abs)** | **U Content(%)** | **U Content v WT (%)** | **U Content v Theoretical Minimum (%)** |
| IL2sp_IL18-WT | 531 | 158 | 29.76% | 100.00% | 216.44% |
| | MAX | 105 | 19.77% | 66.46% | 143.84% |
| | MIN | 90 | 16.95% | 56.96% | 123.29% |
| | MEAN | 97.44 | 18.35% | 61.67% | 133.48% |
| | MEDIAN | 98 | 18.46% | 62.03% | 134.25% |
| | STD DEV | 3.71 | 0.70% | 2.35% | 5.08% |

FIG. 101C

| Protein | Length | Theoretical Maximum GC (%) | Theoretical Maximum GC (abs) | | |
|---|---|---|---|---|---|
| IL2sp_IL18-WT | 177 | 59.70% | 317 | | |
| **Nucleic Acid** | **Length** | **GC Content (abs)** | **GC Content(%)** | **GC Content v WT (%)** | **GC Content v Theoretical Maximum (%)** |
| IL2sp_IL18-WT | 531 | 191 | 35.97% | 100.00% | 60.25% |
| | MAX | 301 | 56.69% | 157.59% | 94.95% |
| | MIN | 284 | 53.48% | 148.69% | 89.59% |
| | MEAN | 291 | 54.80% | 152.36% | 91.80% |
| | MEDIAN | 291 | 54.80% | 152.36% | 91.80% |
| | STD DEV | 4.38 | 0.82% | 2.29% | 1.38% |

FIG. 101D

| Sequence | GC | GC 1st | GC 2nd | GC 3rd |
|---|---|---|---|---|
| IL2sp_IL18-WT | 35.97 | 41.24 | 31.64 | 35.03 |
| MAX | 56.69 | 45.76 | 31.64 | 92.66 |
| MIN | 53.48 | 42.37 | 31.64 | 85.88 |
| MEAN | 54.80 | 44.00 | 31.64 | 88.77 |
| MEDIAN | 54.8 | 44.07 | 31.64 | 88.14 |
| STD DEV | 0.83 | 0.96 | 0.00 | 2.01 |

FIG. 101E

IL23 Fusion Construct - IL12B Moiety (no SP)

| Protein | Length | Theoretical Minimum U (%) | Theoretical Minimum U (abs) | | |
|---|---|---|---|---|---|
| IL23-WT protein | 306 | 10.78% | 99 | | |
| **Nucleic Acid** | **Length** | **U Content(abs)** | **U Content(%)** | **U Content v WT (%)** | **U Content v Theoretical Minimum (%)** |
| IL23-WT | 918 | 195 | 21.24% | 100.00% | 196.97% |
| | MAX | 150 | 16.34% | 76.92% | 151.52% |
| | MIN | 127 | 13.83% | 65.13% | 128.28% |
| | MEAN | 139 | 15.14% | 71.28% | 140.40% |
| | MEDIAN | 139 | 15.14% | 71.28% | 140.40% |
| | STD DEV | 5.62 | 0.61% | 2.88% | 5.68% |

FIG. 102A

IL23 Fusion Construct - IL12B Moiety (no SP)

| Protein | Length | Theoretical Maximum G (%) | Theoretical Maximum G (abs) | | |
|---|---|---|---|---|---|
| IL23-WT protein | 306 | 40.74% | 374 | | |
| **Nucleic Acid** | **Length** | **G Content(abs)** | **G Content(%)** | **G Content v WT (%)** | **G Content v Theoretical Maximum (%)** |
| IL23-WT | 918 | 243 | 26.47% | 100.00% | 64.97% |
| | MAX | 283 | 30.83% | 116.46% | 75.67% |
| | MIN | 260 | 28.32% | 107.00% | 69.52% |
| | MEAN | 274.28 | 29.88% | 112.87% | 73.34% |
| | MEDIAN | 273 | 29.74% | 112.35% | 72.99% |
| | STD DEV | 5.40 | 0.59% | 2.22% | 1.45% |

FIG. 102B

IL23 Fusion Construct - IL12B Moiety (no SP)

| Protein | Length | Theoretical Maximum C (%) | Theoretical Maximum C (abs) | | |
|---|---|---|---|---|---|
| IL23-WT protein | 306 | 41.61% | 382 | | |
| **Nucleic Acid** | **Length** | **C Content(abs)** | **C Content(%)** | **C Content v WT (%)** | **C Content v Theoretical Maximum (%)** |
| IL23-WT | 918 | 223 | 24.29% | 100.00% | 58.38% |
| | MAX | 297 | 32.35% | 133.18% | 77.75% |
| | MIN | 273 | 29.74% | 122.42% | 71.47% |
| | MEAN | 283.2 | 30.85% | 127.00% | 74.14% |
| | MEDIAN | 283 | 30.83% | 126.91% | 74.08% |
| | STD DEV | 5.96 | 0.65% | 2.67% | 1.56% |

FIG. 102C

IL23 Fusion Construct - IL12B Moiety (no SP)

| Protein | Length | Theoretical Maximum GC (%) | Theoretical Maximum GC (abs) | | |
|---|---|---|---|---|---|
| IL23-WT protein | 306 | 65.25% | 599 | | |
| **Nucleic Acid** | **Length** | **GC Content (abs)** | **GC Content(%)** | **GC Content v WT (%)** | **GC Content v Theoretical Maximum (%)** |
| IL23-WT | 918 | 466 | 50.76% | 100.00% | 77.80% |
| | MAX | 573 | 62.42% | 122.96% | 95.66% |
| | MIN | 546 | 59.48% | 117.17% | 91.15% |
| | MEAN | 557.48 | 60.73% | 119.63% | 93.07% |
| | MEDIAN | 557 | 60.68% | 119.53% | 92.99% |
| | STD DEV | 5.38 | 0.59% | 1.15% | 0.90% |

FIG. 102D

IL23 Fusion Construct - IL12B Moiety (no SP)

| Sequence | GC | GC 1st | GC 2nd | GC 3rd |
|---|---|---|---|---|
| IL23-WT | 50.76 | 48.04 | 43.14 | 61.11 |
| MAX | 62.42 | 51.31 | 43.14 | 93.14 |
| MIN | 59.48 | 49.02 | 43.14 | 84.97 |
| MEAN | 60.73 | 50.43 | 43.14 | 88.61 |
| MEDIAN | 60.68 | 50.65 | 43.14 | 88.56 |
| STD DEV | 0.59 | 0.64 | 0.00 | 1.64 |

FIG. 102E

IL23 Fusion Construct - IL23A Moiety (no SP)

| Protein | Length | Theoretical Minimum U (%) | Theoretical Minimum U (abs) | | |
|---|---|---|---|---|---|
| IL23-WT protein | 170 | 10.98% | 56 | | |
| **Nucleic Acid** | **Length** | **U Content(abs)** | **U Content(%)** | **U Content v WT (%)** | **U Content v Theoretical Minimum (%)** |
| IL23-WT | 510 | 110 | 21.57% | 100.00% | 196.43% |
| | MAX | 84 | 16.47% | 76.36% | 150.00% |
| | MIN | 72 | 14.12% | 65.45% | 128.57% |
| | MEAN | 77.04 | 15.11% | 70.04% | 137.57% |
| | MEDIAN | 77 | 15.10% | 70.00% | 137.50% |
| | STD DEV | 3.18 | 0.62% | 2.89% | 5.68% |

FIG. 103A

IL23 Fusion Construct - IL23A Moiety (no SP)

| Protein | Length | Theoretical Maximum G (%) | Theoretical Maximum G (abs) | | |
|---|---|---|---|---|---|
| IL23-WT protein | 170 | 41.96% | 214 | | |
| **Nucleic Acid** | **Length** | **G Content(abs)** | **G Content(%)** | **G Content v WT (%)** | **G Content v Theoretical Maximum (%)** |
| IL23-WT | 510 | 136 | 26.67% | 100.00% | 63.55% |
| | MAX | 168 | 32.94% | 123.53% | 78.50% |
| | MIN | 149 | 29.22% | 109.56% | 69.63% |
| | MEAN | 159.84 | 31.34% | 117.53% | 74.69% |
| | MEDIAN | 160 | 31.37% | 117.65% | 74.77% |
| | STD DEV | 4.55 | 0.89% | 3.35% | 2.13% |

FIG. 103B

IL23 Fusion Construct - IL23A Moiety (no SP)

| Protein | Length | Theoretical Maximum C (%) | Theoretical Maximum C (abs) | | |
|---|---|---|---|---|---|
| IL23-WT protein | 170 | 50.00% | 255 | | |
| **Nucleic Acid** | **Length** | **C Content(abs)** | **C Content(%)** | **C Content v WT (%)** | **C Content v Theoretical Maximum (%)** |
| IL23-WT | 510 | 154 | 30.20% | 100.00% | 60.39% |
| | MAX | 196 | 38.43% | 127.27% | 76.86% |
| | MIN | 173 | 33.92% | 112.34% | 67.84% |
| | MEAN | 183.64 | 36.01% | 119.25% | 72.02% |
| | MEDIAN | 183 | 35.88% | 118.83% | 71.76% |
| | STD DEV | 5.22 | 1.02% | 3.39% | 2.05% |

FIG. 103C

IL23 Fusion Construct - IL23A Moiety (no SP)

| Protein | Length | Theoretical Maximum GC (%) | Theoretical Maximum GC (abs) | | |
|---|---|---|---|---|---|
| IL23-WT protein | 170 | 72.16% | 368 | | |
| **Nucleic Acid** | **Length** | **GC Content (abs)** | **GC Content(%)** | **GC Content v WT (%)** | **GC Content v Theoretical Maximum (%)** |
| IL23-WT | 510 | 290 | 56.86% | 100.00% | 78.80% |
| | MAX | 350 | 68.63% | 120.69% | 95.11% |
| | MIN | 336 | 65.88% | 115.86% | 91.30% |
| | MEAN | 343.48 | 67.35% | 118.44% | 93.34% |
| | MEDIAN | 344 | 67.45% | 118.62% | 93.48% |
| | STD DEV | 3.90 | 0.76% | 1.34% | 1.06% |

FIG. 103D

IL23 Fusion Construct - IL23A Moiety (no SP)

| Sequence | GC | GC 1st | GC 2nd | GC 3rd |
|---|---|---|---|---|
| IL23-WT | 56.86 | 67.65 | 45.88 | 57.06 |
| MAX | 68.63 | 68.82 | 45.88 | 92.35 |
| MIN | 65.88 | 66.47 | 45.88 | 85.29 |
| MEAN | 67.35 | 67.67 | 45.88 | 88.49 |
| MEDIAN | 67.45 | 67.65 | 45.88 | 88.24 |
| STD DEV | 0.77 | 0.69 | 0.00 | 2.10 |

FIG. 103E

| Protein | Length | Theoretical Minimum U (%) | Theoretical Minimum U (abs) | | |
|---|---|---|---|---|---|
| OX40L | 183 | 14.94% | 82 | | |
| **Nucleic Acid** | **Length** | **U Content(abs)** | **U Content(%)** | **U Content v WT (%)** | **U Content v Theoretical Minimum (%)** |
| OX40L | 549 | 142 | 25.87% | 100.00% | 173.17% |
| | MAX | 113 | 20.58% | 79.58% | 137.80% |
| | MIN | 97 | 17.67% | 68.31% | 118.29% |
| | MEAN | 103.32 | 18.82% | 72.76% | 126.00% |
| | MEDIAN | 103 | 18.76% | 72.54% | 125.61% |
| | STD DEV | 3.93 | 0.72% | 2.77% | 4.80% |

FIG. 104A

| Protein | Length | Theoretical Maximum G (%) | Theoretical Maximum G (abs) | | |
|---|---|---|---|---|---|
| OX40L | 183 | 35.52% | 195 | | |
| **Nucleic Acid** | **Length** | **G Content(abs)** | **G Content(%)** | **G Content v WT (%)** | **G Content v Theoretical Maximum (%)** |
| OX40L | 549 | 122 | 22.22% | 100.00% | 62.56% |
| | MAX | 153 | 27.87% | 125.41% | 78.46% |
| | MIN | 134 | 24.41% | 109.84% | 68.72% |
| | MEAN | 142.12 | 25.89% | 116.49% | 72.88% |
| | MEDIAN | 143 | 26.05% | 117.21% | 73.33% |
| | STD DEV | 4.59 | 0.84% | 3.76% | 2.35% |

FIG. 104B

| Protein | Length | Theoretical Maximum C (%) | Theoretical Maximum C (abs) | | |
|---|---|---|---|---|---|
| OX40L | 183 | 40.80% | 224 | | |
| **Nucleic Acid** | **Length** | **C Content(abs)** | **C Content(%)** | **C Content v WT (%)** | **C Content v Theoretical Maximum (%)** |
| OX40L | 549 | 132 | 24.04% | 100.00% | 58.93% |
| | MAX | 176 | 32.06% | 133.33% | 78.57% |
| | MIN | 151 | 27.50% | 114.39% | 67.41% |
| | MEAN | 165.56 | 30.16% | 125.42% | 73.91% |
| | MEDIAN | 166 | 30.24% | 125.76% | 74.11% |
| | STD DEV | 5.92 | 1.08% | 4.48% | 2.64% |

FIG. 104C

| Protein | Length | Theoretical Maximum GC (%) | Theoretical Maximum GC (abs) | | |
|---|---|---|---|---|---|
| OX40L | 183 | 60.84% | 334 | | |
| **Nucleic Acid** | **Length** | **GC Content (abs)** | **GC Content(%)** | **GC Content v WT (%)** | **GC Content v Theoretical Maximum (%)** |
| OX40L | 549 | 254 | 46.27% | 100.00% | 76.05% |
| | MAX | 316 | 57.56% | 124.41% | 94.61% |
| | MIN | 296 | 53.92% | 116.54% | 88.62% |
| | MEAN | 307.68 | 56.04% | 121.13% | 92.12% |
| | MEDIAN | 307 | 55.92% | 120.87% | 91.92% |
| | STD DEV | 4.34 | 0.79% | 1.71% | 1.30% |

FIG. 104D

| Sequence | GC | GC 1st | GC 2nd | GC 3rd |
|---|---|---|---|---|
| OX40L | 46.27 | 50.82 | 27.32 | 60.66 |
| MAX | 57.56 | 53.55 | 27.32 | 91.8 |
| MIN | 53.92 | 51.37 | 27.32 | 81.97 |
| MEAN | 56.04 | 52.31 | 27.32 | 88.50 |
| MEDIAN | 55.92 | 52.46 | 27.32 | 88.52 |
| STD DEV | 0.79 | 0.78 | 0.00 | 2.18 |

SEQ ID NO: 471 1 Human CD80, Isoform 1

MGHTRRQGTSPSKCPYLNFFQLLVLAGLSHFCSGVIHVTKEVKEVATLSCGHNVSVEELAQTRIYWQ
KEKKMVLTMMSGDMNIWPEYKNRTIFDITNNLSIVILALRPSDEGTYECVVLKYEKDAFKREHLAEVT
LSVKADFPTPSISDFEIPTSNIRRIICSTSGGFPEPHLSWLENGEELNAINTTVSQDPETELYAVSSKLDFN
MTTNHSFMCLIKYGHLRVNQTFNWNTTKQEHFPDNLLPSWAITLISVNGIFVICCLTYCFAPRCRERR
RNERLRRESVRPV

See CD80_HUMAN T-lymphocyte activation antigen CD80 (identifier: P33681-1). This is the isoform 1 sequence. This isoform has been chosen as the 'canonical' sequence. All positional information in this entry refers to it.

FIG. 105B

| Feature | Position | Length | Description |
|---|---|---|---|
| Signal peptide | 1-34 | 34 | Signal peptide |
| Domain | 35-135 | 101 | Ig-like V-type |
| Domain | 145-230 | 86 | Ig-like C2-type |
| Topological Domain | 35-242 | 208 | Extracellular |
| Transmembrane | 243-263 | 21 | Helical |
| Topological Domain | 264-288 | 25 | Cytoplasmic |

FIG. 105C

SEQ ID NO: 472

GACAAGTACTGAGTGAACTCAAACCCTCTGTAAAGTAACAGAAGTTAGAAGGGGAAATGTCGCCTCTCTGAA
GATTACCCAAAGAAAAAGTGATTTGTCATTGCTTTATAGACTGTAAGAAGAGAACATCTCAGAAGTGGAGTC
TTACCCTGAAATCAAAGGATTTAAAGAAAAAGTGGAATTTTTCTTCAGCAAGCTGTGAAACTAAATCCACAAC
CTTTGGAGACCCAGGAACACCCTCCAATCTCTGTGTGTTTTGTAAACATCACTGGAGGGTCTTCTACGTGAGC
AATTGGATTGTCATCAGCCCTGCCTGTTTTGCACCTGGGAAGTGCCCTGGTCTTACTTGGGTCCAAATTGTTG
GCTTTCACTTTTGACCCTAAGCATCTGAAGCCATGGGCCACACACGGAGGCAGGGAACATCACCATCCAAGT
GTCCATACCTCAATTTCTTTCAGCTCTTGGTGCTGGCTGGTCTTTCTCACTTCTGTTCAGGTGTTATCCACGTG
ACCAAGGAAGTGAAAGAAGTGGCAACGCTGTCCTGTGGTCACAATGTTTCTGTTGAAGAGCTGGCACAAA
CTCGCATCTACTGGCAAAAGGAGAAGAAAATGGTGCTGACTATGATGTCTGGGGACATGAATATATGGCC
CGAGTACAAGAACCGGACCATCTTTGATATCACTAATAACCTCTCCATTGTGATCCTGGCTCTGCGCCCATCT
GACGAGGGCACATACGAGTGTGTTGTTCTGAAGTATGAAAAAGACGCTTTCAAGCGGGAACACCTGGCTG
AAGTGACGTTATCAGTCAAAGCTGACTTCCCTACACCTAGTATATCTGACTTTGAAATTCCAACTTCTAATAT
TAGAAGGATAATTTGCTCAACCTCTGGAGGTTTTCCAGAGCCTCACCTCTCCTGGTTGGAAAATGGAGAAG
AATTAAATGCCATCAACACAACAGTTTCCCAAGATCCTGAAACTGAGCTCTATGCTGTTAGCAGCAAACTG
GATTTCAATATGACAACCAACCACAGCTTCATGTGTCTCATCAAGTATGGACATTTAAGAGTGAATCAGACC
TTCAACTGGAATACAACCAAGCAAGAGCATTTTCCTGATAACCTGCTCCCATCCTGGGCCATTACCTTAATCT
CAGTAAATGGAATTTTTGTGATATGCTGCCTGACCTACTGCTTTGCCCCAAGATGCAGAGAGAGAAGGAGGA
ATGAGAGATTGAGAAGGGAAAGTGTACGCCCTGTATAACAGTGTCCGCAGAAGCAAGGGGCTGAAAAGATC
TGAAGGTCCCACCTCCATTTGCAATTGACCTCTTCTGGGAACTTCCTCAGATGGACAAGATTACCCCACCTTGC
CCTTTACGTATCTGCTCTTAGGTGCTTCTTCACTTCAGTTGCTTTGCAGGAAGTGTCTAGAGGAATATGGTGG
GCACAGAAGTAGCTCTGGTGACCTTGATCAAGGTGTTTTGAAATGCAGAATTCTTGAGTTCTGGAAGGGACT
TTAGAGAATACCAGTGTTATTAATGACAAAGGCACTGAGGCCCAGGGAGGTGACCCGAATTATAAAGGCCA
GCGCCAGAACCCAGATTTCCTAACTCTGGTGCTCTTTCCCTTTATCAGTTTGACTGTGGCCTGTTAACTGGTAT
ATACATATATATGTCAGGCAAAGTGCTGCTGGAAGTAGAATTTGTCCAATAACAGGTCAACTTCAGAGACTAT
CTGATTTCCTAATGTCAGAGTAGAAGATTTTATGCTGCTGTTTACAAAAGCCCAATGTAATGCATAGGAAGTA
TGGCATGAACATCTTTAGGAGACTAATGGAAATATTATTGGTGTTTACCCAGTATTCCATTTTTTTCATTGTGT
TCTCTATTGCTGCTCTCTCACTCCCCCATGAGGTACAGCAGAAAGGAGAACTATCCAAAACTAATTTCCTCTGA
CATGTAAGACGAATGATTTAGGTACGTCAAAGCAGTAGTCAAGGAGGAAAGGGATAGTCCAAAGACTTAAC
TGGTTCATATTGGACTGATAATCTCTTTAAATGGCTTTATGCTAGTTTGACCTCATTTGTAAAATATTTATGAG
AAAGTTCTCATTTAAAATGAGATCCTTGTTTACAGTGTATGTACTAAGCAGTAAGCTATCTTCAAATGTCTAAG
GTAGTAACTTTCCATAGGGCCTCCTTAGATCCCTAAGATGGCTTTTTCTCCTTGGTATTTCTGGGTCTTTCTGA
CATCAGCAGAGAACTGGAAAGACATAGCCAACTGCTGTTCATGTTACTCATGACTCCTTTCTCTAAAACTGCC
TTCCACAATTCACTAGACCAGAAGTGGACGCAACTTAAGCTGGGATAATCACATTATCATCTGAAAATCTGGA
GTTGAACAGCAAAAGAAGACAACATTTCTCAAATGCACATCTCATGGCAGCTAAGCCACATGGCTGGGATTT
AAAGCCTTTAGAGCCAGCCCATGGCTTTAGCTACCTCACTATGCTGCTTCACAAACCTTGCTCCTGTGTAAAAC
TATATTCTCAGTGTAGGGCAGAGAGGTCTAACACCAACATAAGGTACTAGCAGTGTTTCCCGTATTGACAGG
AATACTTAACTCAATAATTCTTTTCTTTTCCATTTAGTAACAGTTGTGATGACTATGTTTCTATTCTAAGTAATTC
CTGTATTCTACAGCAGATACTTTGTCAGCAATACTAAGGGAAGAAACAAAGTTGAACCGTTTCTTTAATAA

Underlined nucleobases indicate region encoding the signal peptide ;
Bold nucleobases indicate region encoding the extracellular domain

FIG. 106A

SEQ ID NO: 473

*MGHTRRQGTSPSKCPYLNFFQLLVLAGLSHFCSG*VIHVTKEVKEVATLSCGHNVSVEELA
QTRIYWQKEKKMVLTMMSGDMNIWPEYKNRTIFDITNNLSIVILALRPSDEGTYECVVLK
YEKDAFKREHLAEVTLSVKADFPTPSISDFEIPTSNIRRIICSTSGGFPEPHLSWLENGE
ELNAINTTVSQDPETELYAVSSKLDFNMTTNHSFMCLIKYGHLRVNQTFNWNTTKQEHFP
DDKTHTCPPCPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGK

Signal Peptide — Italics
EC Domain — Underlined
Fc region — Bold

FIG. 106B

SEQ ID NO: 474

*ATGGGCCACACACGGAGGCAGGGAACATCACCATCCAAGTGTCCATACCTCAATTTCTTT*
*CAGCTCTTGGTGCTGGCTGGTCTTTCTCACTTCTGTTCAGGT*GTTATCCACGTGACCAAG
GAAGTGAAAGAAGTGGCAACGCTGTCCTGTGGTCACAATGTTTCTGTTGAAGAGCTGGCA
CAAACTCGCATCTACTGGCAAAAGGAGAAGAAAATGGTGCTGACTATGATGTCTGGGGAC
ATGAATATATGGCCCGAGTACAAGAACCGGACCATCTTTGATATCACTAATAACCTCTCC
ATTGTGATCCTGGCTCTGCGCCCATCTGACGAGGGCACATACGAGTGTGTTGTTCTGAAG
TATGAAAAAGACGCTTTCAAGCGGGAACACCTGGCTGAAGTGACGTTATCAGTCAAAGCT
GACTTCCCTACACCTAGTATATCTGACTTTGAAATTCCAACTTCTAATATTAGAAGGATA
ATTTGCTCAACCTCTGGAGGTTTTCCAGAGCCTCACCTCTCCTGGTTGGAAAATGGAGAA
GAATTAAATGCCATCAACACAACAGTTTCCCAAGATCCTGAAACTGAGCTCTATGCTGTT
AGCAGCAAACTGGATTTCAATATGACAACCAACCACAGCTTCATGTGTCTCATCAAGTAT
GGACATTTAAGAGTGAATCAGACCTTCAACTGGAATACAACCAAGCAAGAGCATTTTCCT
GATGACAAAACTCACACATGCCCACCGTGCCCAGCACCTGAACTCCTGGGGGGACCGTCA
GTCTTCCTCTTCCCCCCAAAACCCAAGGACACCCTCATGATCTCCCGGACCCCTGAGGTC
ACATGCGTGGTGGTGGACGTGAGCCACGAAGACCCTGAGGTCAAGTTCAACTGGTACGTG
GACGGCGTGGAGGTGCATAATGCCAAGACAAAGCCGCGGGAGGAGCAGTACAACAGCACG
TACCGGGTGGTCAGCGTCCTCACCGTCCTGCACCAGGACTGGCTGAATGGCAAGGAGTAC
AAGTGCAAGGTCTCCAACAAAGCCCTCCCAGCCCCCATCGAGAAAACCATCTCCAAAGCC
AAAGGGCAGCCCCGAGAACCACAGGTGTACACCCTGCCCCCATCCCGGGATGAGCTGACC
AAGAACCAGGTCAGCCTGACCTGCCTGGTCAAAGGCTTCTATCCCAGCGACATCGCCGTG
GAGTGGGAGAGCAATGGGCAGCCGGAGAACAACTACAAGACCACGCCTCCCGTGCTGGAC
TCCGACGGCTCCTTCTTCCTCTACAGCAAGCTCACCGTGGACAAGAGCAGGTGGCAGCAG
GGGAACGTCTTCTCATGCTCCGTGATGCATGAGGCTCTGCACAACCACTACACGCAGAAG
AGCCTCTCCCTGTCTCCGGGTAAA

SEQ ID NO: 523 1 TRL4, Toll-like receptor 4, isoform 1

FIG. 107A

MMSASRLAGTLIPAMAFLSCVRPESWEPCVEVVPNITYQCMELNFYKIPDNLPFSTKNLD
LSFNPLRHLGSYSFFSFPELQVLDLSRCEIQTIEDGAYQSLSHLSTLILTGNPIQSLALG
AFSGLSSLQKLVAVETNLASLENFPIGHLKTLKELNVAHNLIQSFKLPEYFSNLTNLEHL
DLSSNKIQSIYCTDLRVLHQMPLLNLSLDLSLNPMNFIQPGAFKEIRLHKLTLRNNFDSL
NVMKTCIQGLAGLEVHRLVLGEFRNEGNLEKFDKSALEGLCNLTIEEFRLAYLDYYLDDI
IDLFNCLTNVSSFSLVSVTIERVKDFSYNFGWQHLELVNCKFGQFPTLKLKSLKRLTFTS
NKGGNAFSEVDLPSLEFLDLSRNGLSFKGCCSQSDFGTTSLKYLDLSFNGVITMSSNFLG
LEQLEHLDFQHSNLKQMSEFSVFLSLRNLIYLDISHTHTRVAFNGIFNGLSSLEVLKMAG
NSFQENFLPDIFTELRNLTFLDLSQCQLEQLSPTAFNSLSSLQVLNMSHNNFFSLDTFPY
KCLNSLQVLDYSLNHIMTSKKQELQHFPSSLAFLNLTQNDFACTCEHQSFLQWIKDQRQL
LVEVERMECATPSDKQGMPVLSLNITCQMNKTIIGVSVLSVLVVSVVAVLVYKFYFHLML
LAGCIKYGRGENIYDAFVIYSSQDEDWVRNELVKNLEEGVPPFQLCLHYRDFIPGVAIAA
NIIHEGFHKSRKVIVVVSQHFIQSRWCIFEYEIAQTWQFLSSRAGIIFIVLQKVEKTLLR
QQVELYRLLSRNTYLEWEDSVLGRHIFWRRLRKALLDGKSWNPEGTVGTGCNWQEATSI

See Toll-like receptor 4, Uniprot Acc. No. O00206. This is the isoform 1 sequence. This isoform has been chosen as the 'canonical' sequence. All positional information in this entry refers to it.

SEQ ID NO: 524 2

FIG. 107C

ATGATGTCTGCCTCGCGCCTGGCTGGGACTCTGATCCCAGCCATGGCCTTCCTCTCCTGCGTGAGAC
CAGAAAGCTGGGAGCCCTGCGTGGAGGTGGTTCCTAATATTACTTATCAATGCATGGAGCTGAATTT
CTACAAAATCCCCGACAACCTCCCCTTCTCAACCAAGAACCTGGACCTGAGCTTTAATCCCCTGAGG
CATTTAGGCAGCTATAGCTTCTTCAGTTTCCCAGAACTGCAGGTGCTGGATTTATCCAGGTGTGAAA
TCCAGACAATTGAAGATGGGGCATATCAGAGCCTAAGCCACCTCTCTACCTTAATATTGACAGGAAA
CCCCATCCAGAGTTTAGCCCTGGGAGCCTTTTCTGGACTATCAAGTTTACAGAAGCTGGTGGCTGTG
GAGACAAATCTAGCATCTCTAGAGAACTTCCCCATTGGACATCTCAAAACTTTGAAAGAACTTAATG
TGGCTCACAATCTTATCCAATCTTTCAAATTACCTGAGTATTTTTCTAATCTGACCAATCTAGAGCA
CTTGGACCTTTCCAGCAACAAGATTCAAAGTATTTATTGCACAGACTTGCGGGTTCTACATCAAATG
CCCCTACTCAATCTCTCTTTAGACCTGTCCCTGAACCCTATGAACTTTATCCAACCAGGTGCATTTA
AAGAAATTAGGCTTCATAAGCTGACTTTAAGAAATAATTTTGATAGTTTAAATGTAATGAAAACTTG
TATTCAAGGTCTGGCTGGTTTAGAAGTCCATCGTTTGGTTCTGGGAGAATTTAGAAATGAAGGAAAC
TTGGAAAAGTTTGACAAATCTGCTCTAGAGGGCCTGTGCAATTTGACCATTGAAGAATTCCGATTAG
CATACTTAGACTACTACCTCGATGATATTATTGACTTATTTAATTGTTTGACAAATGTTTCTTCATT
TTCCCTGGTGAGTGTGACTATTGAAAGGGTAAAAGACTTTTCTTATAATTTCGGATGGCAACATTTA
GAATTAGTTAACTGTAAATTTGGACAGTTTCCCACATTGAAACTCAAATCTCTCAAAAGGCTTACTT
TCACTTCCAACAAAGGTGGGAATGCTTTTTCAGAAGTTGATCTACCAAGCCTTGAGTTTCTAGATCT
CAGTAGAAATGGCTTGAGTTTCAAAGGTTGCTGTTCTCAAAGTGATTTTGGGACAACCAGCCTAAAG
TATTTAGATCTGAGCTTCAATGGTGTTATTACCATGAGTTCAAACTTCTTGGGCTTAGAACAACTAG
AACATCTGGATTTCCAGCATTCCAATTTGAAACAAATGAGTGAGTTTTCAGTATTCCTATCACTCAG
AAACCTCATTTACCTTGACATTTCTCATACTCACACCAGAGTTGCTTTCAATGGCATCTTCAATGGC
TTGTCCAGTCTCGAAGTCTTGAAAATGGCTGGCAATTCTTTCCAGGAAAACTTCCTTCCAGATATCT
TCACAGAGCTGAGAAACTTGACCTTCCTGGACCTCTCTCAGTGTCAACTGGAGCAGTTGTCTCCAAC
AGCATTTAACTCACTCTCCAGTCTTCAGGTACTAAATATGAGCCACAACAACTTCTTTTCATTGGAT
ACGTTTCCTTATAAGTGTCTGAACTCCCTCCAGGTTCTTGATTACAGTCTCAATCACATAATGACTT
CCAAAAAACAGGAACTACAGCATTTTCCAAGTAGTCTAGCTTTCTTAAATCTTACTCAGAATGACTT
TGCTTGTACTTGTGAACACCAGAGTTTCCTGCAATGGATCAAGGACCAGAGGCAGCTCTTGGTGGAA
GTTGAACGAATGGAATGTGCAACACCTTCAGATAAGCAGGGCATGCCTGTGCTGAGTTTGAATATCA
CCTGTCAGATGAATAAGACCATCATTGGTGTGTCGGTCCTCAGTGTGCTTGTAGTATCTGTTGTAGC
AGTTCTGGTCTATAAGTTCTATTTTCACCTGATGCTTCTTGCTGGCTGCATAAAGTATGGTAGAGGT
GAAAACATCTATGATGCCTTTGTTATCTACTCAAGCCAGGATGAGGACTGGGTAAGGAATGAGCTAG
TAAAGAATTTAGAAGAAGGGGTGCCTCCATTTCAGCTCTGCCTTCACTACAGAGACTTTATTCCCGG
TGTGGCCATTGCTGCCAACATCATCCATGAAGGTTTCCATAAAAGCCGAAAGGTGATTGTTGTGGTG
TCCCAGCACTTCATCCAGAGCCGCTGGTGTATCTTTGAATATGAGATTGCTCAGACCTGGCAGTTTC
TGAGCAGTCGTGCTGGTATCATCTTCATTGTCCTGCAGAAGGTGGAGAAGACCCTGCTCAGGCAGCA
GGTGGAGCTGTACCGCCTTCTCAGCAGGAACACTTACCTGGAGTGGGAGGACAGTGTCCTGGGGCGG
CACATCTTCTGGAGACGACTCAGAAAAGCCCTGCTGGATGGTAAATCATGGAATCCAGAAGGAACAG
TGGGTACAGGATGCAATTGGCAGGAAGCAACATCTATCTGA

Underlined nucleobases indicate region encoding the signal peptide (1-69)

| Feature | Position | Length | Description |
|---|---|---|---|
| Signal peptide | 1-23 | 23 | Signal peptide |
| Chain | 24-839 | 816 | Toll-like receptor 4 |
| Repeat | 55-76 | 22 | LRR 1 |
| Repeat | 79-100 | 22 | LRR 2 |
| Repeat | 103-124 | 22 | LRR 3 |
| Repeat | 127-148 | 22 | LRR 4 |
| Repeat | 151-172 | 22 | LRR 5 |
| Repeat | 176-199 | 24 | LRR 6 |
| Repeat | 205-225 | 21 | LRR 7 |
| Repeat | 227-247 | 21 | LRR 8 |
| Repeat | 331-351 | 21 | LRR 9 |
| Repeat | 352-373 | 22 | LRR 10 |
| Repeat | 374-394 | 21 | LRR 11 |
| Repeat | 400-422 | 23 | LRR 12 |
| Repeat | 423-444 | 22 | LRR 13 |
| Repeat | 448-456 | 9 | LRR 14 |
| Repeat | 472-495 | 24 | LRR 15 |
| Repeat | 497-518 | 22 | LRR 16 |
| Repeat | 521-542 | 22 | LRR 17 |
| Repeat | 545-565 | 21 | LRR 18 |
| Domain | 579-629 | 51 | LRRCT |
| Domain | 672-818 | 147 | TIR |
| Topological Domain | 24-631 | 608 | Extracellular |
| Transmembrane | 632-652 | 21 | Helical |
| Topological Domain | 653-839 | 187 | Cytoplasmic |

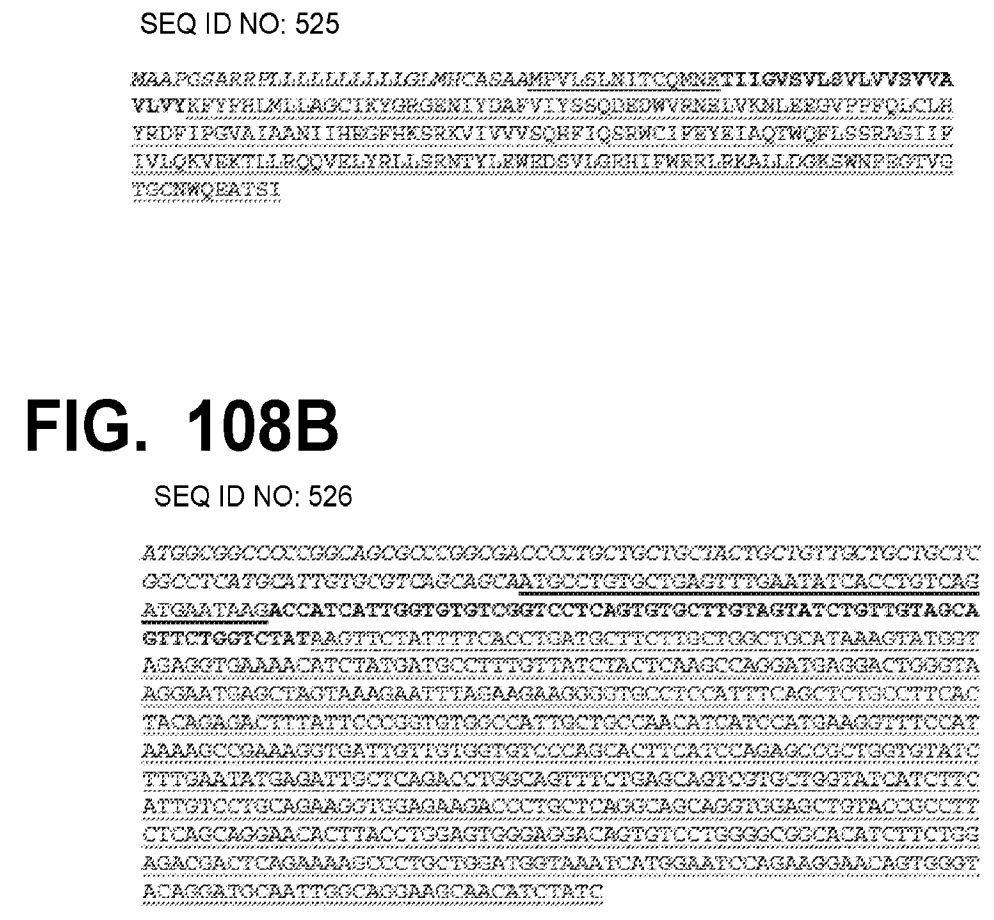

SEQ ID NO: 525

MAAPGSARRPLLLLLLLLLLGLMHCASAAMFVLSLNITCQMNKTIIGVSVLSVLVVSVVA
VLVYKFYFHLMLLAGCIKYGHGEKIYDAFVIYSSQDEDWVRNELVKNLEEGVPPFQLCLH
YRDFIPGVAIAANIIHEGFHKSRKVIVVVSQHFIQSRWCIFEYEIAQTWQFLSSRAGIIF
IVLQKVEKTLLRQQVELYRLLSRNTYLEWEDSVLGRHIFWRRLRKALLDGKSWNPEGTVG
TGCNWQEATSI

FIG. 108B

SEQ ID NO: 526

ATGGCGGCCCCTGGCAGCGCCCGGCGACCCCTGCTGCTGCTACTGCTGTTGCTGCTGCTC
GGCCTCATGCATTGTGCGTCAGCAGCAATGTTTGTGCTGAGTTTGAATATCACCTGTCAG
ATGAATAAGACCATCATTGGTGTGTCGGTCCTCAGTGTGCTTGTAGTATCTGTTGTAGCA
GTTCTGGTCTATAAGTTCTATTTTCACCTGATGCTTCTTGCTGGCTGCATAAAGTATGGT
AGAGGTGAAAACATCTATGATGCCTTTGTTATCTACTCAAGCCAGGATGAGGACTGGGTA
AGGAATGAGCTAGTAAAGAATTTAGAAGAAGGGGTGCCTCCATTTCAGCTCTGCCTTCAC
TACAGAGACTTTATTCCCGGTGTGGCCATTGCTGCCAACATCATCCATGAAGGTTTCCAT
AAAAGCCGAAAGGTGATTGTTGTGGTGTCCCAGCACTTCATCCAGAGCCGCTGGTGTATC
TTTGAATATGAGATTGCTCAGACCTGGCAGTTTCTGAGCAGTCGTGCTGGTATCATCTTC
ATTGTCCTGCAGAAGGTGGAGAAGACCCTGCTCAGGCAGCAGGTGGAGCTGTACCGCCTT
CTCAGCAGGAACACTTACCTGGAGTGGGAGGACAGTGTCCTGGGGCGGCACATCTTCTGG
AGACGACTCAGAAAAGCCCTGCTGGATGGTAAATCATGGAATCCAGAAGGAACAGTGGGT
ACAGGATGCAATTGGCAGGAAGCAACATCTATC

Wild Type IL12B without signal (IL12B) Amino Acids SEQ ID NO: 1035

IWELKKDVYVVELDWYPDAPGEMVVLTCDTPEEDGITWTLDQSSEVLGSGKTLTIQVKEFGDAGQYTCHKGGEV
LSHSLLLLHKKEDGIWSTDILKDQKEPKNKTFLRCEAKNYSGRFTCWWLTTISTDLTFSVKSSRGSSDPQGVTC
GAATLSAERVRGDNKEYEYSVECQEDSACPAAEESLPIEVMVDAVHKLKYENYTSSFFIRDIIKPDPPKNLQLK
PLKNSRQVEVSWEYPDTWSTPHSYFSLTFCVQVQGKSKREKKDRVFTDKTSATVICRKNASISVRAQDRYYSSS
WSEWASVPCS

Wild Type IL12B without signal (IL12B) Nucleic Acids SEQ ID NO: 1036

ATATGGGAACTGAAGAAAGATGTTTATGTCGTAGAATTGGATTGGTATCCGGATGCCCCTGGAGAAATGGTGGT
CCTCACCTGTGACACCCCTGAAGAAGATGGTATCACCTGGACCTTGGACCAGAGCAGTGAGGTCTTAGGCTCTG
GCAAAACCCTGACCATCCAAGTCAAAGAGTTTGGAGATGCTGGCCAGTACACCTGTCACAAAGGAGGCGAGGTT
CTAAGCCATTCGCTCCTGCTGCTTCACAAAAAGGAAGATGGAATTTGGTCCACTGATATTTTAAAGGACCAGAA
AGAACCCAAAAATAAGACCTTTCTAAGATGCGAGGCCAAGAATTATTCTGGACGTTTCACCTGCTGGTGGCTGA
CGACAATCAGTACTGATTTGACATTCAGTGTCAAAAGCAGCAGAGGCTCTTCTGACCCCCAAGGGGTGACGTGC
GGAGCTGCTACACTCTCTGCAGAGAGAGTCAGAGGGGACAACAAGGAGTATGAGTACTCAGTGGAGTGCCAGGA
GGACAGTGCCTGCCCAGCTGCTGAGGAGAGTCTGCCCATTGAGGTCATGGTGGATGCCGTTCACAAGCTCAAGT
ATGAAAACTACACCAGCAGCTTCTTCATCAGGGACATCATCAAACCTGACCCACCCAAGAACTTGCAGCTGAAG
CCATTAAAGAATTCTCGGCAGGTGGAGGTCAGCTGGGAGTACCCTGACACCTGGAGTACTCCACATTCCTACTT
CTCCCTGACATTCTGCGTTCAGGTCCAGGGCAAGAGCAAGAGAGAAAAGAAAGATAGAGTCTTCACGGACAAGA
CCTCAGCCACGGTCATCTGCCGCAAAAATGCCAGCATTAGCGTGCGGGCCCAGGACCGCTACTATAGCTCATCT
TGGAGCGAATGGGCATCTGTGCCCTGCAGT

Wild Type IL12A without signal peptide Amino acids SEQ ID NO: 1037

RNLPVATPDPGMFPCLHHSQNLLRAVSNMLQKARQTLEFYPCTSEEIDHEDITKDKTSTVEACLPLELTKNESC
LNSRETSFITNGSCLASRKTSFMMALCLSSIYEDLKMYQVEFKTMNAKLLMDPKRQIFLDQNMLAVIDELMQAL
NFNSETVPQKSSLEEPDFYKTKIKLCILLHAFRIRAVTIDRVMSYLNAS

Wild Type IL12A without signal peptide Nucleic acids SEQ ID NO: 1038

AGAAACCTCCCCGTGGCCACTCCAGACCCAGGAATGTTCCCATGCCTTCACCACTCCCAAAACCTGCTGAGGGCC
GTCAGCAACATGCTCCAGAAGGCCAGACAAACTCTAGAATTTTACCCTTGCACTTCTGAAGAGATTGATCATGAA
GATATCACAAAAGATAAAACCAGCACAGTGGAGGCCTGTTTACCATTGGAATTAACCAAGAATGAGAGTTGCCTA
AATTCCAGAGAGACCTCTTTCATAACTAATGGGAGTTGCCTGGCCTCCAGAAAGACCTCTTTTATGATGGCCCTG
TGCCTTAGTAGTATTTATGAAGACTTGAAGATGTACCAGGTGGAGTTCAAGACCATGAATGCAAAGCTTCTGATG
GATCCTAAGAGGCAGATCTTTCTAGATCAAAACATGCTGGCAGTTATTGATGAGCTGATGCAGGCCCTGAATTTC
AACAGTGAGACTGTGCCACAAAAATCCTCCCTTGAAGAACCGGATTTTTATAAAACTAAAATCAAGCTCTGCATA
CTTCTTCATGCTTTCAGAATTCGGGCAGTGACTATTGATAGAGTGATGAGCTATCTGAATGCTTCC

Wild Type IL12B signal peptide Amino acids: SEQ ID NO: 1039

MCHQQLVISWFSLVFLASPLVA

Wild Type IL12B signal peptide Nucleic acids: SEQ ID NO: 1040

ATGTGTCACCAGCAGTTGGTCATCTCTTGGTTTTCCCTGGTTTTTCTGGCATCTCCCCTCGTGGCC

FIG. 109A

| | Amino acids | Nucleotides |
|---|---|---|
| Signal Peptide IL12B | 1-22 of SEQ ID NO: 1259 | 1-66 of SEQ ID NOs: 1041-1080 |
| Mature IL12B | 23-328 of SEQ ID NO: 1259 | 67-984 of SEQ ID NOs: 1041-1080 |
| Linker | 329-335 of SEQ ID NO: 1259 | 985-1005 of SEQ ID NOs: 1041-1080 |
| Mature IL12A | 336-532 of SEQ ID NO: 1259 | 1006-1596 of SEQ ID NOs: 1041-1080 |
| | | |

FIG. 109B

Full Length IL15R Amino Acid Sequence (Wild Type) SEQ ID NO: 808

```
        10         20         30         40         50
MAPRRARGCR TLGLPALLLL LLLRPPATRG ITCPPPMSVE HADIWVKSYS
        60         70         80         90        100
LYSRERYICN SGFKRKAGTS SLTECVLNKA TNVAHWTTPS LKCIRDPALV
       110        120        130        140        150
HQRPAPPSTV TTAGVTPQPE SLSPSGKEPA ASSPSSNNTA ATTAAIVPGS
       160        170        180        190        200
QLMPSKSPST GTTEISSHES SHGTPSQTTA KNWELTASAS HQPPGVYPQG
       210        220        230        240        250
HSDTTVAIST STVLLCGLSA VSLLACYLKS RQTPPLASVE MEAMEALPVT
       260
WGTSSRDEDL ENCSHHL
```

FIG. 110A

Full-Length IL15R Nucleotide Sequence (Wild Type) SEQ ID NO: 809

```
ATGGCTCCCCGCCGCGCGCGAGGCTGTCGCACCCTCGGACTTCCTGCACTCTTGCTTTTGCTCCTCCTTAGACCCCCTGCA
ACCAGAGGGATAACCTGTCCACCTCCAATGAGCGTCGAGCACGCAGACATTTGGGTGAAATCATACAGTCTGTACAGTAGA
GAGCGGTACATCTGCAACAGTGGGTTTAAAAGAAAAGCAGGCACTTCATCTCTGACAGAGTGCGTGCTGAACAAAGCAACT
AATGTAGCTCATTGGACAACCCCATCACTGAAATGCATTAGAGATCCAGCTCTGGTGCATCAAAGACCAGCACCACCAAGT
ACCGTAACAACCGCAGGGGTGACCCCTCAGCCTGAGTCCCTATCTCCCTCCGGCAAGGAGCCAGCAGCATCTTCACCTAGC
TCCAATAACACCGCAGCTACCACTGCCGCCATAGTCCCCGGAAGCCAGCTGATGCCTAGTAAATCTCCCTCAACAGGTACC
ACCGAAATTTCTAGCCATGAGTCCTCGCACGGCACCCCGTCACAGACTACAGCTAAAAACTGGGAGCTAACGGCTTCGGCA
TCCCACCAACCTCCAGGCGTTTATCCCCAAGGTCACTCCGACACTACTGTGGCGATTAGCACAAGTACCGTCCTTCTGTGT
GGACTGAGTGCAGTTTCATTGCTGGCCTGTTATCTGAAATCTCGCCAGACCCCTCCCCTCGCCAGTGTTGAGATGGAAGCC
ATGGAAGCACTTCCTGTGACTTGGGGAACATCCTCGAGGGACGAGGACCTCGAGAACTGCTCTCACCACCTG
```

FIG. 110B

Full-Length IL15 Amino Acid Sequence (Wild Type) SEQ ID NO: 810

```
        10         20         30         40         50
MRISKPHLRS ISIQCYLCLL LNSHFLTEAG IHVFILGCFS AGLPKTEANW
        60         70         80         90        100
VNVISDLKKI EDLIQSMHID ATLYTESDVH PSCKVTAMKC FLLELQVISL
       110        120        130        140        150
ESGDASIHDT VENLIILANN SLSSNGNVTE SGCKECEELE EKNIKEFLQS
       160
FVHIVQMFIN TS
```

Full-length IL15 Nucleotide Sequence (Wild Type) SEQ ID NO: 811

*ATGCGCATCAGCAAACCTCATTTACGGAGTATCAGCATCCAGTGCTATCTCTGCCTGCTTCTGAACAGTCATTTTCTGACTG*
*AGGC*GGGCATTCATGTCTTTATTTAGGCTGCTTTTCCGCAGGTCTGCCCAAAACAGAAGCAAATTGGGTGAACGTGATCAG
CGACCTGAAGAAGATTGAGGATCTAATTCAAAGCATGCATATTGATGCCACACTCTACACCGAATCCGACGTGCACCCTTCG
TGTAAAGTGACTGCAATGAAGTGTTTCTTACTGGAACTGCAGGTGATCAGTCTGGAGTCCGGGGATGCATCAATCCACGACA
CAGTGGAAAACCTGATTATCCTGGCAAACAATTCCCTGAGCAGTAATGGCAATGTCACGGAGAGCGGATGTAAGGAGTGTGA
GGAATTAGAGGAAAAGAATATCAAGGAATTCCTTCAGTCCTTTGTGCACATCGTACAGATGTTTATTAATACATCC

FIG. 110E tPA-IL15 Amino acid Sequence (SQ_032091) SEQ ID NO: 812

*MDAMKRGLCCVLLLCGAVFVSPSQEIHARFRRGAR*NWVNVISDLKKIEDLIQSMHIDATL
YTESDVHPSCKVTAMKCFLLELQVISLESGDASIHDTVENLIILANNSLSSNGNVTESGC
KECEELEEKNIKEFLQSFVHIVQMFINTS

Signal peptide is italicized; the mature IL15 peptide has a dotted underline.

FIG. 110F

Full Fc-IL15R-Linker-IL15 Amino acid Sequence (SQ_032909) SEQ ID NO: 813

*METDTLLLWVLLLWVPGSTG*EPKSCDKTHTCPPCPAPELLGGPSVFLFPPKPKD
TLMISRTPEVTCVVVAVSHEDPEVKFNWYVDGVEVHNAKTKPREEQYNSTYRVV
SVLTVLHQDWLNGKEYKCKVSNKALPAPIEKTISKAKGQPREPQVYTLPPSRDE
LTKNQVSLTCLVKGFYPSDIAVEWESNGQPENNYKTTPPVLDSDGSFFLYSKLT
VDKSRWQQGNVFSCSVMHEALHNHYTQKSLSLSPGKITCPPPMSVEHADIWVKS
YSLYSRERYICNSGFKRKAGTSSLTECVLNKATNVAHWTTPSLKCIRDPALVHQ
RPAPPSGGSGGGGSGGGSGGGGSLQNWVNVISDLKKIEDLIQSMHIDATLYTES
DVHPSCKVTAMKCFLLELQVISLESGDASIHDTVENLIILANNSLSSNGNVTES
GCKECEELEEKNIKEFLQSFVHIVQMFINTS

SEQ ID NO: 564 1 IL18, Interleukin-18, isoform 1

MAAEPVEDNCINFVAMKFIDNTLYFIAEDDENLESDYFGKLESKLSVIRNLNDQVLFIDQ
GNRPLFEDMTDSDCRDNAPRTIFIISMYKDSQPRGMAVTISVKCEKISTLSCENKIISFK
EMNPPDNIKDTKSDIIFFQRSVPGHDNKMQFESSSYEGYFLACEKERDLFKLILKKEDEL
GDRSIMFTVQNED

See Interleukin-18, Uniprot Acc. No. Q14116. This is the isoform 1 sequence. This isoform has been chosen as the 'canonical' sequence. All positional information in this entry refers to it.

FIG. 111A

| Feature | Position | Length | Description |
|---|---|---|---|
| Propeptide | 1-36 | 36 | Propeptide |
| Chain | 37-193 | 157 | Interleukin-18 |

FIG. 111B

SEQ ID NO: 565

ATGGCTGCTGAACCAGTAGAAGACAATTGCATCAACTTTGTGGCAATGAAATTTATTGACAATACGC
TTTACTTTATAGCTGAAGATGATGAAAACCTGGAATCAGATTACTTTGGCAAGCTTGAATCTAAATT
ATCAGTCATAAGAAATTTGAATGACCAAGTTCTCTTCATTGACCAAGGAAATCGGCCTCTATTTGAA
GATATGACTGATTCTGACTGTAGAGATAATGCACCCCGGACCATATTTATTATAAGTATGTATAAAG
ATAGCCAGCCTAGAGGTATGGCTGTAACTATCTCTGTGAAGTGTGAGAAAATTTCAACTCTCTCCTG
TGAGAACAAAATTATTTCCTTTAAGGAAATGAATCCTCCTGATAACATCAAGGATACAAAAAGTGAC
ATCATATTCTTTCAGAGAAGTGTCCCAGGACATGATAATAAGATGCAATTTGAATCTTCATCATACG
AAGGATACTTTCTAGCTTGTGAAAAAGAGAGAGACCTTTTTAAACTCATTTTGAAAAAAGAGGATGA
ATTGGGGGATAGATCTATAATGTTCACTGTTCAAAACGAAGAC

FIG. 111C

SEQ ID NO: 566 3 IL18, Interleukin-18, isoform 2

MAAEPVEDNCINFVAMKFIDNTLYFIENLESDYFGKLESKLSVIRNLNDQVLFIDQGNRP
LFEDMTDSDCRDNAPRTIFIISMYKDSQPRGMAVTISVKCEKISTLSCENKIISFKEMNP
PDNIKDTKSDIIFFQRSVPGHDNKMQFESSSYEGYFLACEKERDLFKLILKKEDELGDRS
IMFTVQNED

See interleukin-18, Uniprot Acc. No. Q14116. This is the isoform 2 sequence. Also known as Delta3pro-IL-18. The sequence of this isoform differs from the canonical sequence as follows: 27-30: Missing.

FIG. 112A

| Feature | Position | Length | Description |
|---|---|---|---|
| Propeptide | 1-36 | 36 | Propeptide |
| Chain | 37-193 | 157 | Interleukin-18 |

*All positional information refers to the 'canonical' sequence*

FIG. 112B

SEQ ID NO: 567

ATGGCTGCTGAACCAGTAGAAGACAATTGCATCAACTTTGTGGCAATGAAATTTATTGACAATACGC
TTTACTTTATAGAAAACCTGGAATCAGATTACTTTGGCAAGCTTGAATCTAAATTATCAGTCATAAG
AAATTTGAATGACCAAGTTCTCTTCATTGACCAAGGAAATCGGCCTCTATTTGAAGATATGACTGAT
TCTGACTGTAGAGATAATGCACCCCGGACCATATTTATTATAAGTATGTATAAAGATAGCCAGCCTA
GAGGTATGGCTGTAACTATCTCTGTGAAGTGTGAGAAAATTTCAACTCTCTCCTGTGAGAACAAAAT
TATTTCCTTTAAGGAAATGAATCCTCCTGATAACATCAAGGATACAAAAAGTGACATCATATTCTTT
CAGAGAAGTGTCCCAGGACATGATAATAAGATGCAATTTGAATCTTCATCATACGAAGGATACTTTC
TAGCTTGTGAAAAAGAGAGAGACCTTTTTAAACTCATTTTGAAAAAAGAGGATGAATTGGGGGATAG
ATCTATAATGTTCACTGTTCAAAACGAAGAC

FIG. 112C

FIG. 113A tPA(sp)-IL18 Amino Acids SEQ ID NO: 572

*MDAMKRGLCCVLLLCGAVFVSPSQEIHARFRRGAR*YFGKLESKLSVIRNLNDQVL
FIDQGNRPLFEDMTDSDCRDNAPRTIFIISMYKDSQPRGMAVTISVKCEKISTLS
CENKIISFKEMNPPDNIKDTKSDIIFFQRSVPGHDNKMQFESSSYEGYFLACEKE
RDLFKLILKKEDELGDRSIMFTVQNED

FIG. 113B tPA(sp)-IL18 Nucleotides SEQ ID NO: 573

ATGGATGCAATGAAGAGAGGGCTCTGCTGTGTGCTGCTGCTGTGTGGAGCAGTCTTCGT
TTCGCCCAGCCAGGAAATCCATGCCCGATTCAGAAGAGGAGCCAGATACTTTGGCAAGC
TTGAATCTAAATTATCAGTCATAAGAAATTTGAATGACCAAGTTCTCTTCATTGACCAA
GGAAATCGGCCTCTATTTGAAGATATGACTGATTCTGACTGTAGAGATAATGCACCCCG
GACCATATTTATTATAAGTATGTATAAAGATAGCCAGCCTAGAGGTATGGCTGTAACTA
TCTCTGTGAAGTGTGAGAAAATTTCAACTCTCTCCTGTGAGAACAAAATTATTTCCTTT
AAGGAAATGAATCCTCCTGATAACATCAAGGATACAAAAAGTGACATCATATTCTTTCA
GAGAAGTGTCCCAGGACATGATAATAAGATGCAATTTGAATCTTCATCATACGAAGGAT
ACTTTCTAGCTTGTGAAAAAGAGAGAGACCTTTTTAAACTCATTTTGAAAAAAGAGGAT
GAATTGGGGGATAGATCTATAATGTTCACTGTTCAAAACGAAGAC

FIG. 113C

IL2(sp)-IL18 Amino Acids SEQ ID NO: 574

*MYRMQLLSCIALSLALVTNS*YFGKLESKLSVIRNLNDQVLFIDQGNRPLFEDMTD
SDCRDNAPRTIFIISMYKDSQPRGMAVTISVKCEKISTLSCENKIISFKEMNPPD
NIKDTKSDIIFFQRSVPGHDNKMQFESSSYEGYFLACEKERDLFKLILKKEDELG
DRSIMFTVQNED

FIG. 113D

IL2(sp)-IL18 Nucleotides SEQ ID NO: 575

ATGTACAGGATGCAACTCCTGTCTTGCATTGCACTAAGTCTTGCACTTGTCACAAACAG
TTACTTTGGCAAGCTTGAATCTAAATTATCAGTCATAAGAAATTTGAATGACCAAGTTC
TCTTCATTGACCAAGGAAATCGGCCTCTATTTGAAGATATGACTGATTCTGACTGTAGA
GATAATGCACCCCGGACCATATTTATTATAAGTATGTATAAAGATAGCCAGCCTAGAGG
TATGGCTGTAACTATCTCTGTGAAGTGTGAGAAAATTTCAACTCTCTCCTGTGAGAACA
AAATTATTTCCTTTAAGGAAATGAATCCTCCTGATAACATCAAGGATACAAAAAGTGAC
ATCATATTCTTTCAGAGAAGTGTCCCAGGACATGATAATAAGATGCAATTTGAATCTTC
ATCATACGAAGGATACTTTCTAGCTTGTGAAAAAGAGAGAGACCTTTTTAAACTCATTT
TGAAAAAAGAGGATGAATTGGGGGATAGATCTATAATGTTCACTGTTCAAAACGAAGAC

FIG. 114A

IgLC(sp)-IL18 Amino Acids SEQ ID NO: 576

MAWTVLLLGLLSHCTGSVTSYFGKLESKLSVIRNLNDQVLFIDQGNRPLFEDMTDSDCR
DNAPRTIFIISMYKDSQPRGMAVTISVKCEKISTLSCENKIISFKEMNPPDNIKDTKSD
IIFFQRSVPGHDNKMQFESSSYEGYFLACEKERDLFKLILKKEDELGDRSIMFTVQNED

FIG. 114B

IL-1ra(sp)-IL18 Amino Acids SEQ ID NO: 577

MEICRGLRSHLITLLLFLFHSETICYFGKLESKLSVIRNLNDQVLFIDQGNRPLFEDM
TDSDCRDNAPRTIFIISMYKDSQPRGMAVTISVKCEKISTLSCENKIISFKEMNPPDN
IKDTKSDIIFFQRSVPGHDNKMQFESSSYEGYFLACEKERDLFKLILKKEDELGDRSI
MFTVQNED

FIG. 114C

IL18 Double Mutants SEQ ID NO: 578

MAAEPVEDNCINFVAMKFIDNTLYFIAEDDENLESDYFGKLESKLSVIRNLNDQVLFI
DQGNRPLFEDMTSSDCRNNAPRTIFIISMYKDSQPRGMAVTISVKCEKISTLSCENKI
ISFKEMNPPDNIKDTKSDIIFFQRSVPGHDNKMQFESSSYEGYFLACEKERDLFKLIL
KKEDELGDRSIMFTVQNED

SEQ ID NO: 979 1 IL12B, Interleukin-12 subunit beta, wt

```
        10         20         30         40         50
MCHQQLVISW FSLVFLASPL VAIWELKKDV YVVELDWYPD APGEMVVLTC
        60         70         80         90        100
DTPEEDGITW TLDQSSEVLG SGKTLTIQVK EFGDAGQYTC HKGGEVLSHS
       110        120        130        140        150
LLLLHKKEDG IWSTDILKDQ KEPKNKTFLR CEAKNYSGRF TCWWLTTIST
       160        170        180        190        200
DLTFSVKSSR GSSDPQGVTC GAATLSAERV RGDNKEYEYS VECQEDSACP
       210        220        230        240        250
AAEESLPIEV MVDAVHKLKY ENYTSSFFIR DIIKPDPPKN LQLKPLKNSR
       260        270        280        290        300
QVEVSWEYPD TWSTPHSYFS LTFCVQVQGK SKREKKDRVF TDKTSATVIC
       310        320
RKNASISVRA QDRYYSSSWS EWASVPCS
```

FIG. 115A

SEQ ID NO: 980

```
ATGTGTCACCAGCAGTTGGTCATCTCTTGGTTTTCCCTGGTTTTTCTGGCATCTCCCCTCGTGGCCA
TATGGGAACTGAAGAAAGATGTTTATGTCGTAGAATTGGATTGGTATCCGGATGCCCCTGGAGAAAT
GGTGGTCCTCACCTGTGACACCCCTGAAGAAGATGGTATCACCTGGACCTTGGACCAGAGCAGTGAG
GTCTTAGGCTCTGGCAAAACCCTGACCATCCAAGTCAAAGAGTTTGGAGATGCTGGCCAGTACACCT
GTCACAAAGGAGGCGAGGTTCTAAGCCATTCGCTCCTGCTGCTTCACAAAAAGGAAGATGGAATTTG
GTCCACTGATATTTTAAAGGACCAGAAAGAACCCAAAAATAAGACCTTTCTAAGATGCGAGGCCAAG
AATTATTCTGGACGTTTCACCTGCTGGTGGCTGACGACAATCAGTACTGATTTGACATTCAGTGTCA
AAAGCAGCAGAGGCTCTTCTGACCCCCAAGGGGTGACGTGCGGAGCTGCTACACTCTCTGCAGAGAG
AGTCAGAGGGGACAACAAGGAGTATGAGTACTCAGTGGAGTGCCAGGAGGACAGTGCCTGCCCAGCT
GCTGAGGAGAGTCTGCCCATTGAGGTCATGGTGGATGCCGTTCACAAGCTCAAGTATGAAAACTACA
CCAGCAGCTTCTTCATCAGGGACATCATCAAACCTGACCCACCCAAGAACTTGCAGCTGAAGCCATT
AAAGAATTCTCGGCAGGTGGAGGTCAGCTGGGAGTACCCTGACACCTGGAGTACTCCACATTCCTAC
TTCTCCCTGACATTCTGCGTTCAGGTCCAGGGCAAGAGCAAGAGAGAAAAGAAAGATAGAGTCTTCA
CGGACAAGACCTCAGCCACGGTCATCTGCCGCAAAAATGCCAGCATTAGCGTGCGGGCCCAGGACCG
CTACTATAGCTCATCTTGGAGCGAATGGGCATCTGTGCCCTGCAGT
```

Underlined nucleobases indicate region encoding the signal peptide (1-66)

FIG. 115B

SEQ ID NO: 981 3 IL23A, Interleukin-23 subunit alpha, wt

```
MLGSRAVMLLLLLPWTAQGRAVPGGSSPAWTQCQQLSQKLCTLAWSAHPLVGHMDLREEG
DEETTNDVPHIQCGDGCDPQGLRDNSQFCLQRIHQGLIFYEKLLGSDIFTGEPSLLPDSP
VGQLHASLLGLSQLLQPEGHHWETQQIPSLSPSQPWQRLLLRFKILRSLQAFVAVAARVF
AHGAATLSP
```

FIG. 115C

SEQ ID NO: 982 4

```
ATGCTGGGGAGCAGAGCTGTAATGCTGCTGTTGCTGCTGCCCTGGACAGCTCAGGGCAGAGCTGTGC
CTGGGGGCAGCAGCCCTGCCTGGACTCAGTGCCAGCAGCTTTCACAGAAGCTCTGCACACTGGCCTG
GAGTGCACATCCACTAGTGGGACACATGGATCTAAGAGAAGAGGGAGATGAAGAGACTACAAATGAT
GTTCCCCATATCCAGTGTGGAGATGGCTGTGACCCCCAAGGACTCAGGGACAACAGTCAGTTCTGCT
TGCAAAGGATCCACCAGGGTCTGATTTTTTATGAGAAGCTGCTAGGATCGGATATTTTCACAGGGGA
GCCTTCTCTGCTCCCTGATAGCCCTGTGGGCCAGCTTCATGCCTCCCTACTGGGCCTCAGCCAACTC
CTGCAGCCTGAGGGTCACCACTGGGAGACTCAGCAGATTCCAAGCCTCAGTCCCAGCCAGCCATGGC
AGCGTCTCCTTCTCCGCTTCAAAATCCTTCGCAGCCTCCAGGCCTTTGTGGCTGTAGCCGCCCGGGT
CTTTGCCCATGGAGCAGCAACCCTGAGTCCC
```

Underlined nucleobases indicate region encoding the signal peptide (1-57)

FIG. 115D

SEQ ID NO: 983 5 (Human IL12B-Linker-IL23A Fusion Protein)

*MCHQQLVISWFSLVFLASPLVA*IWELKKDVYVVELDWYPDAPGEMVVLTCDTPEEDGITW
TLDQSSEVLGSGKTLTIQVKEFGDAGQYTCHKGGEVLSHSLLLLHKKEDGIWSTDILKDQ
KEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKN
LQLKPLKNSRQVEVSWEYPDTWSTPHSYFSLTFCVQVQGKSKREKKDRVFTDKTSATVIC
RKNASISVRAQDRYYSSSWSEWASVPCSGGGGGGSRAVPGGSSPAWTQCQQLSQKLCTLA
WSAHPLVGHMDLREEGDEETTNDVPHIQCGDGCDPQGLRDNSQFCLQRIHQGLIFYEKLL
GSDIFTGEPSLLPDSPVGQLHASLLGLSQLLQPEGHHWETQQIPSLSPSQPWQRLLLRFK
ILRSLQAFVAVAARVFAHGAATLSP

FIG. 116A

Features

| Feature | Position | Length |
|---|---|---|
| IL12B signal peptide (italicized in Fig. 2A) | 1-22 | 22 |
| IL12B mature chain (shaded in Fig. 2A) | 23-328 | 306 |
| GS Linker (bolded in Fig. 2A) | 329-335 | 7 |
| IL23A mature chain (dotted underline in Fig. 2A) | 336-505 | 170 |

FIG. 116B

SEQ ID NO: 984

ATGTGTCACCAGCAGTTGGTCATCTCTTGGTTTTCCCTGGTTTTTCTGGCATCTCCCCTCGTGGCCATATGGGA
ACTGAAGAAAGATGTTTATGTCGTAGAATTGGATTGGTATCCGGATGCCCCTGGAGAAATGGTGGTCCTCAC
CTGTGACACCCCTGAAGAAGATGGTATCACCTGGACCTTGGACCAGAGCAGTGAGGTCTTAGGCTCTGGCAA
AACCCTGACCATCCAAGTCAAAGAGTTTGGAGATGCTGGCCAGTACACCTGTCACAAAGGAGGCGAGGTTCT
AAGCCATTCGCTCCTGCTGCTTCACAAAAAGGAAGATGGAATTTGGTCCACTGATATTTTAAAGGACCAGAA
AGAACCCAAAAATAAGACCTTTCTAAGATGCGAGGCCAAGAATTATTCTGGACGTTTCACCTGCTGGTGGCT
GACGACAATCAGTACTGATTTGACATTCAGTGTCAAAAGCAGCAGAGGCTCTTCTGACCCCCAAGGGGTGAC
GTGCGGAGCTGCTACACTCTCTGCAGAGAGAGTCAGAGGGGACAACAAGGAGTATGAGTACTCAGTGGAGT
GCCAGGAGGACAGTGCCTGCCCAGCTGCTGAGGAGAGTCTGCCCATTGAGGTCATGGTGGATGCCGTTCAC
AAGCTCAAGTATGAAAACTACACCAGCAGCTTCTTCATCAGGGACATCATCAAACCTGACCCACCCAAGAACT
TGCAGCTGAAGCCATTAAAGAATTCTCGGCAGGTGGAGGTCAGCTGGGAGTACCCTGACACCTGGAGTACTC
CACATTCCTACTTCTCCCTGACATTCTGCGTTCAGGTCCAGGGCAAGAGCAAGAGAGAAAAGAAAGATAGAG
TCTTCACGGACAAGACCTCAGCCACGGTCATCTGCCGCAAAAATGCCAGCATTAGCGTGCGGGCCCAGGACC
GCTACTATAGCTCATCTTGGAGCGAATGGGCATCTGTGCCCTGCAGTGGCGGCGGCGGCGGCGGAAGCAGA
GCTGTGCCTGGGGGCAGCAGCCCTGCCTGGACTCAGTGCCAGCAGCTTTCACAGAAGCTCTGCACACTGGCC
TGGAGTGCACATCCACTAGTGGGACACATGGATCTAAGAGAAGAGGGAGATGAAGAGACTACAAATGATGT
TCCCCATATCCAGTGTGGAGATGGCTGTGACCCCCAAGGACTCAGGGACAACAGTCAGTTCTGCTTGCAAAG
GATCCACCAGGGTCTGATTTTTTATGAGAAGCTGCTAGGATCGGATATTTTCACAGGGGAGCCTTCTCTGCTC
CCTGATAGCCCTGTGGGCCAGCTTCATGCCTCCCTACTGGGCCTCAGCCAACTCCTGCAGCCTGAGGGTCACC
ACTGGGAGACTCAGCAGATTCCAAGCCTCAGTCCCAGCCAGCCATGGCAGCGTCTCCTTCTCCGCTTCAAAAT
CCTTCGCAGCCTCCAGGCCTTTGTGGCTGTAGCCGCCCGGGTCTTTGCCCATGGAGCAGCAACCCTGAGTCCC

Underlined nucleobases indicate region encoding the signal peptide (1-57)

FIG. 116C

MRNA COMBINATION THERAPY FOR THE TREATMENT OF CANCER

RELATED APPLICATIONS

This Application is a Continuation of Application PCT/US2017/033425 filed on May 18, 2017. Application PCT/US2017/033425 claims the benefit of U.S. Provisional Application Nos. 62/338,496, filed May 18, 2016; 62/338,483, filed May 18, 2016; 62/338,501, filed May 18, 2016; 62/338,505, filed May 18, 2016; 62/338,506, filed May 18, 2016; 62/338,467, filed May 18, 2016; 62/338,507, filed May 18, 2016; 62/338,530, filed May 19, 2016; and 62/404,173, filed Oct. 4, 2016, each of which is hereby incorporated by reference herein in its entirety.

REFERENCE TO SEQUENCE LISTING SUBMITTED ELECTRONICALLY

The instant application contains a Sequence listing which has been submitted in ASCII format via EFS-Web and is hereby incorporated by reference in its entirety. Said ASCII copy, created on Jun. 1, 2018, is named "SeqListing_MDN713PCCN" and is 1653331 bytes in size. The Sequence Listing is being submitted by EFS Web and is hereby incorporated by reference into the specification.

BACKGROUND

Cancer is a disease characterized by uncontrolled cell division and growth within the body. In the United States, roughly a third of all women and half of all men will experience cancer in their lifetime. Polypeptides are involved in every aspect of the disease including cancer cell biology (carcinogenesis, cell cycle suppression, DNA repair and angiogenesis), treatment (immunotherapy, hormone manipulation, enzymatic inhibition), diagnosis and determination of cancer type (molecular markers for breast, prostate, colon and cervical cancer for example). With the host of undesired consequences brought about by standard treatments such as chemotherapy and radiotherapy used today, genetic therapy for the manipulation of disease-related peptides and their functions provides a more targeted approach to disease diagnosis, treatment and management. However, gene therapy poses multiple challenges including undesirable immune response and safety concern due to the incorporation of the gene at random locations within the genome.

Various methods of treating cancer are under development. For example, dendritic cell (DC) vaccines have been studied as a possible anti-cancer therapy. However, DC vaccines require multiple steps of isolating DCs from a subject, ex vivo manipulation of DCs to prime the cells for tumor antigen presentation, and subsequent administration of the manipulated DCs back into the subject. Further, it is reported that the overall clinical response rates for DC vaccines remain low and the ability of DC vaccines to induce cancer regression remains low. See, e.g., Kalkinski et al., "Dendritic cell-based therapeutic cancer vaccines: what we have and what we need," Future Oncol. 5(3):379-390 (2009).

Important goals for the field of immuno-oncology are to improve the response rate and increase the number of tumor indications that respond to immunotherapy, without increasing adverse side effects. One approach to achieve these goals is to use tumor-directed immunotherapy, i.e., to focus the immune activation to the most relevant part of the immune system. This may improve anti-tumor efficacy as well as reduce immune-related adverse events. Tumor-directed immune activation can be achieved by local injections of immune modulators directly into the tumor or into the tumor area. Therapies focused on targeting checkpoint inhibitors and co-stimulatory receptors can generate tumor-specific T cell responses through localized immune activation.

In recent years, the introduction of immune checkpoint inhibitors for therapeutic purposes has revolutionized cancer treatment. Of interest are therapies featuring combinations of checkpoint inhibitors with other costimulatory or inhibitory molecules.

T cell regulation, i.e., activation or inhibition is mediated via co-stimulatory or co-inhibitory signals. This interaction is exerted via ligand/receptor interaction. T cells harbor a myriad of both activating receptors, such as OX40, and inhibitory receptors (i.e., immune checkpoints) such as programmed death receptor 1 (PD-1) or cytotoxic T lymphocyte-associated protein 4 (CTLA-4) (Mellman et al. 2011 Nature; 480:480-489). Activation of this immune checkpoints results in T cell deactivation and commandeering these pathways by tumor cells contributes to their successful immune escape.

Immune checkpoint inhibitors such as pembrolizumab or nivolumab, which target the interaction between programmed death receptor 1/programmed death ligand 1 (PD-1/PD-L1) and PD-L2, have been recently approved for the treatment of various malignancies and are currently being investigated in clinical trials for cancers including melanoma, head and neck squamous cell carcinoma (HNSCC). Data available from these trials indicate substantial activity accompanied by a favorable safety and toxicity profile in these patient populations.

For example, checkpoint inhibitors have been tested in clinical trials for the treatment of melanoma. In particular, phase III clinical trials have revealed that therapies such as ipilimumab and pembrolizumab, which target the CTLA-4 and PD-1 immune checkpoints, respectively, have raised the three-year survival of patients with melanoma to ~70%, and overall survival (>5 years) to ~30%.

Likewise, checkpoint inhibitors have been tested in clinical trials for the treatment of head and neck cancer. In preclinical studies, it had been shown that that 45-80% of HNSCC tumors express programmed death ligand 1 (PD-L1) (Zandberg et al. (2014) Oral Oncol. 50:627-632). Currently there are dozens of clinical trials evaluating the efficacy and safety of immune checkpoint inhibitors as monotherapy or in combination regimens in HNSCC. For example, clinical trials with PD1, PD-L1, and CTLA-4 inhibitors are being tested in HNSCC. Data that the PD-1 antibody pembrolizumab might be effective in metastatic/recurrent (R/M) HNSCC patients were generated in the phase 1b Keynote-012 phase I/II trial (Cheng. ASCO 2015, oral presentation). More recently the data of the randomized CheckMate-141 phase III clinical trial were presented (Gillison. AACR 2016, oral presentation). This study investigated the efficacy of the monoclonal PD-1 antibody nivolumab given every 2 weeks in platinum-refractory R/M HNSCC patients. The study was stopped early due to superiority of the nivolumab arm of the study.

Most immunotherapies available or under development rely on antibodies, which are cumbersome to manufacture, and being foreign proteins frequently lead to the development of anti-drug antibody neutralizing antibodies (ADA nAB). See, e.g., Krishna & Nadler (2016) "Immunogenicity to Biotherapeutic—The role of Anti-drug Immune Complexes" Frontiers in Immunology 7:21; Schellekwn (2010) "The immunogenicity of therapeutic proteins" Discov. Med, 9:560-4. Thus, there is still a need of effective immunotherapies for the treatment of cancer.

BRIEF SUMMARY

The present disclosure provides A method of reducing the size of a tumor or inhibiting growth of a tumor in a subject in need thereof comprising administering to the subject at least two polynucleotides and optionally a checkpoint inhibitor polypeptide, wherein the at least two polynucleotides are selected from the group consisting of (i) a polynucleotide encoding an immune response primer polypeptide; (ii) a polynucleotide encoding an immune response co-stimulatory signal polypeptide; (iii) a polynucleotide encoding a checkpoint inhibitor polypeptide; and, (iv) a combination thereof.

Also provided is a method of reducing the size of a tumor or inhibiting growth of a tumor in a subject in need thereof comprising administering to the subject at least one polynucleotide and a checkpoint inhibitor polypeptide, wherein the at least one polynucleotides are selected from the group consisting of (i) a polynucleotide encoding an immune response primer polypeptide; (ii) a polynucleotide encoding an immune response co-stimulatory signal polypeptide; (iii) a combination thereof.

In some embodiments, the immune response primer polypeptide comprises interleukin 12 (IL12), interleukin (IL23), Toll-like receptor 4 (TLR4), interleukin 36 gamma (IL36gamma), interleukin 18 (IL18), or a combination thereof. In some embodiments, the immune response co-stimulatory signal polypeptide comprises tumor necrosis factor receptor superfamily member 4 ligand (OX40L), cluster of differentiation 80 (CD80), interleukin 15 (IL15), or a combination thereof. In some embodiments, the checkpoint inhibitor polypeptide inhibits programmed cell death protein 1 (PD1), programmed death-ligand 1 (PD-L1), or cytotoxic T-lymphocyte-associated protein 4 (CTLA-4).

In some embodiments of the methods disclosed above, (a) the first polynucleotide encodes an IL23 polypeptide and the second polynucleotide encodes an IL18 polypeptide; (b) the first polynucleotide encodes an IL23 polypeptide and the second polynucleotide encodes an IL12 polypeptide; (c) the first polynucleotide encodes an IL23 polypeptide and the second polynucleotide encodes an OX40L polypeptide; (d) the first polynucleotide encodes an IL12 polypeptide and the second polynucleotide encodes an anti-CTLA-4 antibody; (e) the first polynucleotide encodes an L12 polypeptide and the second polynucleotide encodes an anti-PD-1 antibody or an anti-PD-L1 antibody; (f) the first polynucleotide encodes an IL23 polypeptide and the second polynucleotide encodes an anti-CTLA-4 antibody; (g) the first polynucleotide encodes an IL18 polypeptide and the second polynucleotide encodes an anti-PD-1 antibody or an anti-PD-L1 antibody; (h) the first polynucleotide encodes an IL18 polypeptide and the second polynucleotide encodes an anti-CTLA-4 antibody; (i) the first polynucleotide encodes an IL18 polypeptide and the second polynucleotide encodes an OX40L polypeptide; (j) the first polynucleotide encodes an IL18 polypeptide and the second polynucleotide encodes a TLR4 polypeptide; (k) the first polynucleotide encodes an IL18 polypeptide and the second polynucleotide encodes an IL12 polypeptide; (1) the first polynucleotide encodes an OX40L polypeptide and the second polynucleotide encodes an anti-CTLA-4 antibody;

(m) the first polynucleotide encodes an OX40L polypeptide and the second polynucleotide encodes an anti-PD-1 antibody or an anti-PD-L1 antibody; (n) the first polynucleotide encodes an OX40L polypeptide and the second polynucleotide encodes an caTLR4 polypeptide; (o) the first polynucleotide encodes an OX40L polypeptide and the second polynucleotide encodes an IL23 polypeptide; (p) the first polynucleotide encodes an OX40L polypeptide and the second polynucleotide encodes an IL2 polypeptide; (q) the first polynucleotide encodes a CD80 polypeptide and the second polynucleotide encodes an anti-CTLA-4 antibody; (r) the first polynucleotide encodes a TLR4 polypeptide and the second polynucleotide encodes an anti-CTLA-4 antibody; (s) the first polynucleotide encodes an IL18 polypeptide and the second polynucleotide encodes an IL12, and further comprising administering a third polynucleotide encoding an IL23 polypeptide; (t) the first polynucleotide encodes an OX40L polypeptide and the second polynucleotide encodes a TLR4 polypeptide, and further comprising administering a third polynucleotide encoding an IL18 polypeptide; (u) the first polynucleotide encodes an OX40L polypeptide and the second polynucleotide encodes an IL12 polypeptide, and further comprising administering a third polynucleotide encoding an IL23 polypeptide; (v) the first polynucleotide encodes an IL23 polypeptide and the second polynucleotide encodes an IL2 polypeptide, and further comprising administering a third polynucleotide encoding an anti-CTLA-4 antibody; (w) the first polynucleotide encodes an IL23 polypeptide and the second polynucleotide encodes an IL18 polypeptide, and further comprising administering a third polynucleotide encoding an anti-CTLA-4 antibody; (x) the first polynucleotide encodes an IL23 polypeptide and the second polynucleotide encodes an IL2 polypeptide, and further comprising administering a third polynucleotide encoding an IL18 polypeptide and administering a fourth polynucleotide encoding an anti-CTLA-4 antibody; (y) the first polynucleotide encodes an IL23 polypeptide and the second polynucleotide encodes an IL12 polypeptide, and further comprising administering a third polynucleotide encoding an IL18 polypeptide and administering a fourth polynucleotide encoding an anti-PD-1 antibody or an anti-PD-L1 antibody; (z) the first polynucleotide encodes an OX40L polypeptide and the second polynucleotide encodes an IL8 polypeptide, and further comprising administering a third polynucleotide encoding a TLR4 polypeptide and administering a fourth polynucleotide encoding an anti-CTLA-4 antibody; or (aa) the first polynucleotide encodes an OX40L polypeptide and the second polynucleotide encodes an IL18 polypeptide, and further comprising administering a third polynucleotide encoding a TLR4 polypeptide and administering a fourth polynucleotide encoding an anti-PD-1 antibody or an anti-PD-L1 antibody.

In some embodiments of the methods disclosed above, the at least two polynucleotides are (i) a first polynucleotide encoding an immune response primer polypeptide and a second polynucleotide encoding an immune response primer polypeptide; (ii) a first a polynucleotide encoding an immune response primer polypeptide and a second polynucleotide encoding an immune response co-stimulatory signal polypeptide; or (iii) (i) or (ii) further comprising a polynucleotide encoding a checkpoint inhibitor polypeptide.

Also provided is a method of reducing the size of a tumor or inhibiting growth of a tumor in a subject in need thereof comprising administering to the subject at least two polynucleotides encoding a first polypeptide and a second polypeptide and optionally a checkpoint inhibitor polypeptide, wherein the first polypeptide and the second polypeptide are selected from the group consisting of (i) an IL12 polypeptide; (ii) an IL23 polypeptide, (iii) an IL36gamma polypeptide; (iv) an OX40L polypeptide; (v) a CD80 polypeptide; (vi) a TLR4 polypeptide; (vii) an IL18 polypeptide; (viii) an IL15 polypeptide; (ix) an anti-CTLA-4 antibody; and, (x) a combination thereof.

Also provided is a method of reducing the size of a tumor or inhibiting growth of a tumor in a subject in need thereof comprising administering to the subject at least one polynucleotide encoding a first polypeptide in combination with a second polypeptide, which is a checkpoint inhibitor polypeptide, wherein the first polypeptide is selected from the group consisting of (i) an IL12 polypeptide; (ii) an IL23 polypeptide, (iii) an IL36gamma polypeptide; (iv) an OX40L polypeptide; (v) a CD80 polypeptide; (vi) a TLR4 polypeptide; (vii) an IL18 polypeptide; (viii) an IL15 polypeptide; and, (ix) a combination thereof.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an IL12 polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an IL12 polypeptide. In some aspects, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an IL23 polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an IL23 polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an OX40L polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an OX40L polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes a CD80 polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises a CD80 polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes a TLR4 polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises a TLR4 polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an IL18 polypeptide and the second polynucleotide encodes a polypeptide selected from the group consisting of (i) an immune response primer polypeptide; (ii) an immune response costimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an IL18 polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an IL15 polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an IL15 polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

Also provided is a method of reducing the size of a tumor or inhibiting growth of a tumor in a subject in need thereof comprising administering to the subject at least two polynucleotides comprising a first polynucleotide and a second polynucleotide and optionally a checkpoint inhibitor polypeptide, wherein the first polynucleotide encodes an IL36gamma polypeptide and the second polynucleotide encodes a polypeptide selected from the group consisting of (i) an immune response primer polypeptide; (ii) an immune response co-stimulatory signal polypeptide; (iii) a checkpoint inhibitor polypeptide; and, (iv) any combination thereof.

Also provided is a method of reducing the size of a tumor or inhibiting growth of a tumor in a subject in need thereof comprising administering (a) at least one polynucleotide encoding a first polypeptide and (b) a second polypeptide, which is a checkpoint inhibitor polypeptide, wherein the first polypeptide comprises an IL36gamma polypeptide. In some embodiments, the method further comprises administering a third polynucleotide encoding a third polypeptide, which is selected from the group consisting of an immune response primer polypeptide, an immune response co-stimulatory signal polypeptide, and a checkpoint inhibitor polypeptide.

In some embodiments of the methods disclosed above, the checkpoint inhibitor polypeptide is an antibody or a polynucleotide encoding the antibody. In some embodiments, the antibody is an anti-CTLA-4 antibody or antigen-binding fragment thereof that specifically binds CTLA-4, an anti-PD1 antibody or antigen-binding fragment thereof that specifically binds PD1, an anti-PD-L1 antibody or antigen-binding fragment thereof that specifically binds PD-L1, and a combination thereof. In some embodiments, the anti-PD-L1 antibody is atezolizumab, avelumab, or durvalumab. In some embodiments, the anti-CTLA-4 antibody is tremelimumab or ipilimumab. In some embodiments, the anti-PD-1 antibody is nivolumab or pembrolizumab.

In some embodiments of the methods disclosed above, the at least one or two polynucleotides reduces the size of a tumor derived from MC38(C) or inhibits growth of a tumor derived from MC38(C) in a mouse when a dose of 5 μg of each polynucleotide is administered to the mouse. In some embodiments, the at least one or two polynucleotides reduce the size of a tumor derived from MC38(M) or inhibit growth of a tumor derived from MC38(M) in a mouse when a dose of 5 μg of each polynucleotide is administered to the mouse.

In some embodiments, one or more of the polynucleotides in the combination therapy comprise at least one chemically modified nucleoside. In some embodiments, the at least one chemically modified nucleoside is selected from the group consisting of any of those listed in Section X ("Chemical Modifications") and a combination thereof. In some embodiments, the at least one chemically modified nucleoside is selected from the group consisting of pseudouridine, N1-methylpseudouridine, 5-methylcytosine, 5-methoxyuridine, and a combination thereof. In some embodiments, the nucleosides in one or more of the polynucleotides are chemically modified by at least 10%, at least 20%, at least 30%, at least 40%, at least 50%, at least 60%, at least 70%, at least 80%, at least 90%, at least 95%, at least 99%, or 100%.

In some embodiments, the chemically modified nucleosides in one or more of the polynucleotides are selected from the group consisting of uridine, adenine, cytosine, guanine, and any combination thereof. In some embodiments, the uridine nucleosides in one or more of the polynucleotides are chemically modified by at least 10%, at least 20%, at least 30%, at least 40%, at least 50%, at least 60%, at least 70%, at least 80%, at least 90%, at least 95%, at least 99%, or 100%. In some embodiments, the adenosine nucleosides in one or more of the polynucleotides are chemically modified by at least 10%, at least 20%, at least 30%, at least 40%, at least 50%, at least 60%, at least 70%, at least 80%, at least 90%, at least 95%, at least 99%, or 100%.

In some embodiments, the cytidine nucleosides in one or more of the polynucleotides are chemically modified by at least 10%, at least 20%, at least 30%, at least 40%, at least 50%, at least 60%, at least 70%, at least 80%, at least 90%, at least 95%, at least 99%, or 100%. In some embodiments, the guanosine nucleosides in one or more of the polynucleotides are chemically modified by at least 10%, at least 20%, at least 30%, at least 40%, at least 50%, at least 60%, at least 70%, at least 80%, at least 90%, at least 95%, at least 99%, or 100%.

In some embodiments, one or more of the polynucleotides comprises miRNA binding site. In some embodiments, the miRNA binding site is a miR-122 binding site. In some embodiments, the miRNA binding site is a miR-122-3p or miR-122-5p binding site. In some embodiments, the miRNA binding site comprises a nucleotide sequence at least 80%, at least 85%, at least 90%, at least 95%, or 100% identical to aacgccauua ucacacuaaa ua (SEQ ID NO: 1212), wherein the miRNA binding site binds to miR-122. In some embodiments, the miRNA binding site comprises a nucleotide sequence at least 80%, at least 85%, at least 90%, at least 95%, or 100% identical to uggaguguga caaugguguu ug (SEQ ID NO: 1214), wherein the miRNA binding site binds to miR-122. In some embodiments, the polynucleotides comprise different miRNA binding sites or the same miRNA binding site.

In some embodiments, one or more of the polynucleotides comprise a 5' untranslated region (UTR). In some embodiments, the 5' UTR comprises a nucleic acid sequence at least 90%, 95%, 96%, 97%, 98%, 99%, or 100% identical to a sequence listed in TABLE 20. In some embodiments, one or more of the polynucleotides comprise a 3' untranslated region (UTR). In some embodiments, the 3' UTR comprises a nucleic acid sequence at least 90%, 95%, 96%, 97%, 98%, 99%, or 100% identical to a sequence listed in Table 4A or 4B. In some embodiments, the miRNA binding site is inserted within the 3' UTR. In some embodiments, one or more of the polynucleotides comprise a spacer sequence fused to the miRNA binding site.

In some embodiments, the spacer sequence comprises at least about 10 nucleotides, at least about 20 nucleotides, at least about 30 nucleotides, at least about 40 nucleotides, at least about 50 nucleotides, at least about 60 nucleotides, at least about 70 nucleotides, at least about 80 nucleotides, at least about 90 nucleotides, or at least about 100 nucleotides.

In some embodiments, one or more of the polynucleotides comprise a 5' terminal cap structure. In some embodiments, the 5' terminal cap is a Cap0, Capl, ARCA, inosine, N1-methyl-guanosine, 2'fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof. In some embodiments, one or more of the polynucleotides comprise a 3' polyA tail. In some embodiments, one or more of the polynucleotides comprise at least two, at least three, at least four, at least five, at least six, at least seven, at least eight, at least nine, or at least ten miRNA binding sites.

In some embodiments, one or more of the polynucleotides are codon optimized. In some embodiments, one or more of the polynucleotides are in vitro transcribed (IVT). In some embodiments, one or more of the polynucleotides are chimeric. In some embodiments, one or more of the polynucleotides are circular. In some embodiments, one or more of the polynucleotides is formulated with a delivery agent. In some embodiments, the delivery agent comprises a lipidoid, a liposome, a lipoplex, a lipid nanoparticle, a polymeric compound, a peptide, a protein, a cell, a nanoparticle mimic, a nanotube, or a conjugate. In some embodiments, the delivery agent is a lipid nanoparticle. In some embodiments, the lipid nanoparticle comprises the lipid selected from the group consisting of DLin-DMA, DLin-K-DMA, 98N12-5, C12-200, DLin-MC3-DMA, DLin-KC2-DMA, DODMA, PLGA, PEG, PEG-DMG, PEGylated lipids, amino alcohol lipids, KL22, and combinations thereof.

In some embodiments of the methods disclosed above, the delivery agent comprises a compound having formula (I)

(I)

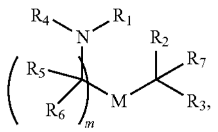

or a salt or stereoisomer thereof, wherein $R_1$ is selected from the group consisting of $C_{5-20}$ alkyl, $C_{5-20}$ alkenyl, —R*YR", —YR", and —R"M'R'; $R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle; $R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a carbocycle, heterocycle, —OR, $—O(CH_2)_nN(R)_2$, —C(O)OR, —OC(O)R, $—CX_3$, $—CX_2H$, $—CXH_2$, —CN, $—N(R)_2$, $—C(O)N(R)_2$, —N(R)C(O)R, $—N(R)S(O)_2R$, $—N(R)C(O)N(R)_2$, $—N(R)C(S)N(R)_2$, and $—(R)N(R)_2C(O)OR$, and each n is independently selected from 1, 2, 3, 4, and 5; each $R_5$ is independently selected from the group consisting of $C_{1-3}$ alkyl, $C_{2-3}$ alkenyl, and H; each $R_6$ is independently selected from the group consisting of $C_{1-3}$ alkyl, $C_{2-3}$ alkenyl, and H; M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group; $R_7$ is selected from the group consisting of $C_{1-3}$ alkyl, $C_{2-3}$ alkenyl, and H; each R is independently selected from the group consisting of $C_{1-3}$ alkyl, $C_{2-3}$ alkenyl, and H; each R' is independently selected from the group consisting of $C_{1-18}$ alkyl, $C_{2-18}$ alkenyl, —R*YR", —YR", and H; each R" is independently selected from the group consisting of $C_{3-14}$ alkyl and $C_{3-14}$ alkenyl; each R* is independently selected from the group consisting of $C_{1-12}$ alkyl and $C_{2-12}$ alkenyl; each Y is independently a $C_{3-6}$ carbocycle; each X is independently selected from the group consisting of F, Cl, Br, and I; and m is selected from 5, 6, 7, 8, 9, 10, 11, 12, and 13; and provided when $R_4$ is $—(CH_2)_nQ$, $—(CH_2)_nCHQR$, —CHQR, or $—CQ(R)_2$, then (i) Q is not $—N(R)_2$ when n is 1, 2, 3, 4 or 5, or (ii) Q is not 5, 6, or 7-membered heterocycloalkyl when n is 1 or 2.

In some embodiments, the compound is of Formula (IA):

(IA)

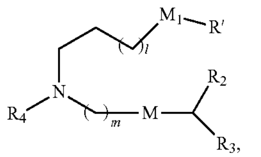

or a salt or stereoisomer thereof, wherein 1 is selected from 1, 2, 3, 4, and 5; m is selected from 5, 6, 7, 8, and 9; $M_1$ is a bond or M'; $R_4$ is unsubstituted $C_{1-3}$ alkyl, or $—(CH_2)_nQ$, in which n is 1, 2, 3, 4, or 5 and Q is OH, $—NHC(S)N(R)_2$, or $—NHC(O)N(R)_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl. In some embodiments, m is 5, 7, or 9.

In some embodiments, the compound is of Formula (II):

(II)

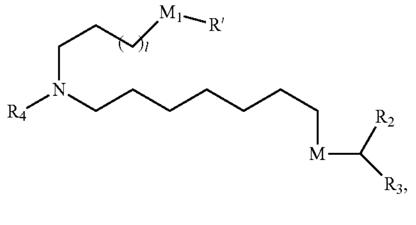

or a salt or stereoisomer thereof, wherein l is selected from 1, 2, 3, 4, and 5; $M_1$ is a bond or M'; $R_4$ is unsubstituted $C_{1-3}$ alkyl, or $—(CH_2)_nQ$, in which n is 2, 3, or 4 and Q is —OH, —NHC(S)N(R)$_2$, or —NHC(O)N(R)$_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, the compound is selected from Compound 1 to Compound 147, and salts and stereoisomers thereof.

In some embodiments, the compound is of the Formula (IIa), (IIa)

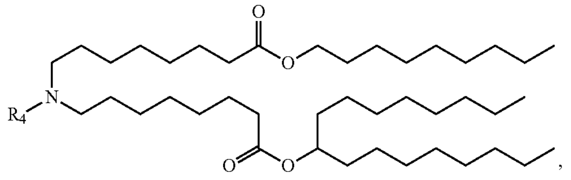

or a salt or stereoisomer thereof.

In some embodiments, the compound is of the Formula (IIb), (IIb)

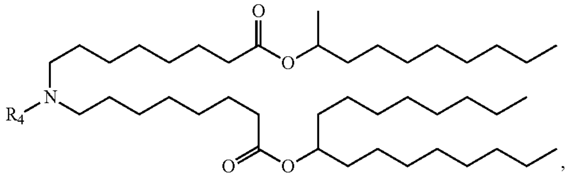

or a salt or stereoisomer thereof.

In some embodiments, the compound is of the Formula (IIc) or (IIe), (IIc)

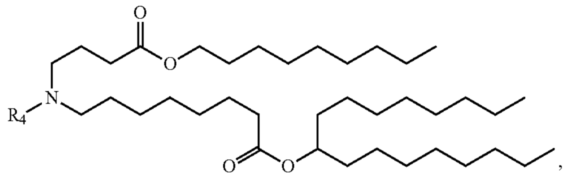

(IIe)

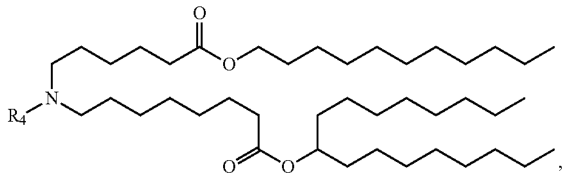

or a salt or stereoisomer thereof.

In some embodiments, $R_4$ is selected from $—(CH_2)_nQ$ and $—(CH_2)_nCHQR$, wherein Q, R and n are as defined above.

In some embodiments, the compound is of the Formula (IId),

IId)

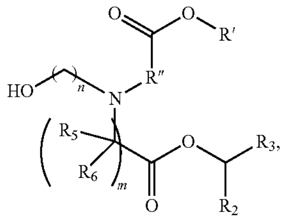

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined above.

In some embodiments, $R_2$ is $C_8$ alkyl. In some embodiments, $R_3$ is $C_5$ alkyl, $C_6$ alkyl, $C_7$ alkyl, $C_8$ alkyl, or $C_9$ alkyl. In some embodiments, m is 5, 7, or 9.89. In some embodiments, each $R_5$ is H. In some embodiments, each $R_6$ is H.

In some embodiments, the delivery agent further comprises a phospholipid. In some embodiments, the phospholipid is selected from the group consisting of
1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), sphingomyelin, and mixtures thereof.

In some embodiments, the phospholipid is selected from the group consisting of
1-myristoyl-2-palmitoyl-sn-glycero-3-phosphocholine (14:0-16:0 PC, MPPC),
1-myristoyl-2-stearoyl-sn-glycero-3-phosphocholine (14:0-18:0 PC, MSPC),
1-palmitoyl-2-acetyl-sn-glycero-3-phosphocholine (16:0-02:0 PC),
1-palmitoyl-2-myristoyl-sn-glycero-3-phosphocholine (16:0-14:0 PC, PMPC),
1-palmitoyl-2-stearoyl-sn-glycero-3-phosphocholine (16:0-18:0 PC, PSPC),
1-palmitoyl-2-oleoyl-sn-glycero-3-phosphocholine (16:0-18:1 PC, POPC), 1-palmitoyl-2-linoleoyl-sn-glycero-3-phosphocholine (16:0-18:2 PC, PLPC), 1-palmitoyl-2-arachidonoyl-sn-glycero-3-phosphocholine (16:0-20:4 PC), 1-palmitoyl-2-docosahexaenoyl-sn-glycero-3-phosphocholine (14:0-22:6 PC), 1-stearoyl-2-myristoyl-sn-glycero-3-phosphocholine (18:0-14:0 PC, SMPC), 1-stearoyl-2-palmitoyl-sn-glycero-3-phosphocholine (18:0-16:0 PC, SPPC), 1-stearoyl-2-oleoyl-sn-glycero-3-phosphocholine (18:0-18:1 PC, SOPC), 1-stearoyl-2-linoleoyl-sn-glycero-3-phosphocholine (18:0-18:2 PC), 1-stearoyl-2-arachidonoyl-sn-glycero-3-phosphocholine (18:0-20:4 PC), 1-stearoyl-2-docosahexaenoyl-sn-glycero-3-phosphocholine (18:0-22:6 PC), 1-oleoyl-2-myristoyl-sn-glycero-3-phosphocholine (18:1-14:0 PC, OMPC), 1-oleoyl-2-palmitoyl-sn-glycero-3-phosphocholine (18:1-16:0 PC, OPPC), 1-oleoyl-2-stearoyl-sn-glycero-3-phosphocholine (18:1-18:0 PC, OSPC), 1-palmitoyl-2-oleoyl-sn-glycero-3-phosphoethanolamine (16:0-18:1 PE, POPE), 1-palmitoyl-2-linoleoyl-sn-glycero-3-phosphoethanolamine (16:0-18:2 PE), 1-palmitoyl-2-arachidonoyl-sn-glycero-3-phosphoethanolamine (16:0-20:4 PE), 1-palmitoyl-2-docosahexaenoyl-sn-glycero-3-phosphoethanolamine (16:0-22:6 PE), 1-stearoyl-2-oleoyl-sn-glycero-3-phosphoethanolamine (18:0-18:1 PE), 1-stearoyl-2-linoleoyl-sn-glycero-3-phosphoethanolamine (18:0-18:2 PE), 1-stearoyl-2-arachidonoyl-sn-glycero-3-phosphoethanolamine (18:0-20:4 PE), 1-stearoyl-2-docosahexaenoyl-sn-glycero-3-phosphoethanolamine (18:0-22:6 PE), 1-oleoyl-2-cholesterylhemisuccinoyl-sn-glycero-3-phosphocholine (OChemsPC), and any combination thereof.

In some embodiments, the delivery agent further comprises a structural lipid. In some embodiments, the structural lipid is selected from the group consisting of cholesterol, fecosterol, sitosterol, ergosterol, campesterol, stigmasterol, brassicasterol, tomatidine, ursolic acid, alpha-tocopherol, and mixtures thereof.

In some embodiments, the delivery agent further comprises a PEG lipid. In some embodiments, the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the delivery agent further comprises an ionizable lipid selected from the group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethyl aminomethyl-[1,3]-dioxolane (DLin-K-DMA), heptatriaconta-6,9,28,31-tetraen-19-yl 4-(dimethylamino) butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), 2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA), (2R)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2S)).

In some embodiments, the delivery agent further comprises a quaternary amine compound. In some embodiments, the quaternary amine compound is selected from the group consisting of 1,2-dioleoyl-3-trimethylammonium-propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), N,N-distearyl-N,N-dimethylammonium bromide (DDAB), N-(1,2-dimyristyloxyprop-3-yl)-N,N-dimethyl-N-hydroxyethyl ammonium bromide (DMRIE), N-(1,2-dioleoyloxyprop-3-yl)-N,N-dimethyl-N-hydroxyethyl ammonium bromide (DORIE), N,N-dioleyl-N,N-dimethyl ammonium chloride (DODAC), 1,2-dilauroyl-sn-glycero-3-ethylphosphocholine (DLePC), 1,2-distearoyl-3-trimethylammonium-propane (DSTAP), 1,2-dipalmitoyl-3-trimethylammonium-propane (DPTAP), 1,2-dilinoleoyl-3-trimethylammonium-propane (DLTAP), 1,2-dimyristoyl-3-trimethylammonium-propane (DMTAP), 1,2-distearoyl-sn-glycero-3-ethylphosphocholine (DSePC), 1,2-dipalmitoyl-sn-glycero-3-ethylphosphocholine (DPePC), 1,2-dimyristoyl-sn-glycero-3-ethylphosphocholine (DMePC), 1,2-dioleoyl-sn-glycero-3-ethylphosphocholine (DOePC), 1,2-di-(9Z-tetradecenoyl)-sn-glycero-3-ethylphosphocholine (14:1 EPC), 1-palmitoyl-2-oleoyl-sn-glycero-3-ethylphosphocholine (16:0-18:1 EPC), and any combination thereof.

The present disclosure also provides a composition comprising (i) one or more of the polynucleotides according to the disclosures above and a pharmaceutically acceptable carrier or (ii) one or more of the polynucleotides according to disclosures above formulated in the delivery agent disclosed above. In some embodiments, the compositions disclosed comprise a delivery agent selected from a lipidoid, a liposome, a lipoplex, a lipid nanoparticle, a polymeric compound, a peptide, a protein, a cell, a nanoparticle mimic, a nanotube, or a conjugate. In some embodiments, the delivery agent comprises a lipid composition disclosed above.

The compositions disclosed herein can be used in reducing or decreasing a size of a tumor or inhibiting a tumor growth in a subject in need thereof.

In some embodiments, the polynucleotides or compositions disclosed herein are formulated for in vivo delivery. In some embodiments, the polynucleotide or composition is formulated for intramuscular, subcutaneous, intratumoral, or intradermal delivery. In some embodiments, the polynucleotide or composition is administered subcutaneously, intravenously, intramuscularly, intra-articularly, intra-synovially, intrasternally, intrathecally, intrahepatically, intralesionally, intracranially, intraventricularly, orally, by inhalation spray, topically, rectally, nasally, buccally, vaginally or via an implanted reservoir.

In some embodiments, administration of the compositions disclosed above, e.g., according to the methods disclosed above, treats a cancer. In some embodiments, the cancer is selected from the group consisting of adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, hepatocellular carcinoma (HCC), non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor, secondary cancers caused by cancer treatment, and any combination thereof.

In some embodiments, the polynucleotide or composition is delivered by a device comprising a pump, patch, drug reservoir, short needle device, single needle device, multiple needle device, micro-needle device, jet injection device, ballistic powder/particle delivery device, catheter, lumen, cryoprobe, cannula, microcanular, or devices utilizing heat, RF energy, electric current, or any combination thereof.

In some embodiments, wherein the effective amount of a composition disclosed herein is between about 0.10 mg/kg to about 1,000 mg/kg.

In some embodiments, the subject is a human.

The present disclosure also provides a kit comprising any composition disclosed above, and instructions to use according to the methods disclosed above.

In some embodiments, the polynucleotide encoding an IL12 polypeptide comprises at least one polynucleotide comprising an ORF encoding an interleukin 12 p40 subunit (IL12B) polypeptide and an interleukin 12 p35 subunit (IL12A) polypeptide. In some embodiments, the IL12B polypeptide is operably linked to the L12A polypeptide by a linker. In some embodiments, the polynucleotide encoding an IL12 polypeptide comprises a nucleic acid encoding a signal peptide. In some embodiments, the signal peptide is an IL12B signal peptide.

In some embodiments, the polynucleotide encoding an IL18 polypeptide comprises an ORF encoding a mature IL18 polypeptide. In some embodiments, the polynucleotide encoding an IL18 polypeptide comprises a nucleic acid encoding a signal peptide. In some embodiments, the signal peptide is a heterologous signal peptide. In some embodiments, the heterologous signal peptide is a tissue plasminogen activator (tPA) signal peptide or an interleukin 12 (IL12) signal peptide.

In some embodiments, the polynucleotide encoding a CD80 polypeptide comprises an ORF encoding a CD80 extracellular domain. In some embodiments, the polynucleotide encoding a CD80 polypeptide comprises a nucleic acid encoding an Fc moiety. In some embodiments, the polynucleotide encoding a CD80 polypeptide comprises a nucleic acid encoding a signal peptide. In some embodiments, the signal peptide is an endogenous CD80 signal peptide.

In some embodiments, the polynucleotide encoding a TLR4 polypeptide comprises an ORF encoding a constitutively active TLR4 polypeptide comprising the intracellular domain and transmembrane region of TLR4. In some embodiments, the polynucleotide encoding a TLR4 polypeptide comprises a nucleic acid encoding a signal peptide. In some embodiments, the signal peptide is a heterologous signal peptide, wherein the heterologous signal peptide is lysosome-associated membrane glycoprotein 1 (LAMP1) signal peptide.

In some embodiments, the polynucleotide encoding an IL15 polypeptide comprises at least one polynucleotide comprising an ORF encoding an IL15 polypeptide and an IL15R extracellular domain polypeptide. In some embodiments, the IL15 polypeptide is operably linked to the IL15R extracellular domain polypeptide by a linker. In some embodiments, the IL15 polypeptide further comprises an Fc domain. In some embodiments, the polynucleotide comprising an ORF encoding an IL15 polypeptide comprises a nucleic acid encoding a signal peptide. In some embodiments, the signal peptide is a heterologous signal peptide. In some embodiments, the heterologous signal peptide is a tPA signal peptide.

In some embodiments, the polynucleotide encoding an IL23 polypeptide comprises an ORF encoding an IL12p40 polypeptide and an IL23p19 polypeptide. In some embodiments, the IL12p40 polypeptide is operably linked to the IL23p19 polypeptide via a linker. In some embodiments, the polynucleotide encoding an IL23 polypeptide comprises a nucleic acid encoding a signal peptide. In some embodiments, the signal peptide is an IL12p40 signal peptide or an IL23p19 signal peptide.

In some embodiments, the polynucleotide encoding an IL36gamma polypeptide comprises an ORF encoding an IL36gamma polypeptide. In some embodiments, the polynucleotide ORF encoding the mature IL36gamma polypeptide further comprises a nucleic acid encoding a signal peptide. In some embodiments, wherein the signal peptide is a heterologous signal peptide. In some embodiments, the heterologous signal peptide is an hIgKV4 signal peptide.

The present disclosure also provides a pharmaceutical composition comprising at least two mRNAs and a pharmaceutically acceptable carrier, wherein the mRNAs are selected from (i) one or more mRNAs having an open reading frame encoding an immune response primer polypeptide; (ii) one or more mRNAs having an open reading frame encoding an immune response costimulatory signal polypeptide; and (iii) one or more mRNAs having an open reading frame encoding a checkpoint inhibitor polypeptide. In some embodiments, the pharmaceutical composition comprises (i) an mRNA having an open reading frame encoding an immune response primer polypeptide and (ii) an mRNA having an open reading frame encoding an immune response costimulatory signal polypeptide. In some embodiments, the pharmaceutical composition comprises two mRNAs each having an open reading frame encoding an immune response primer polypeptide. In some embodiments, the pharmaceutical composition comprises (i) an mRNA having an open reading frame encoding an immune response costimulatory signal polypeptide and (ii) an mRNA having an open reading frame encoding a checkpoint inhibitor polypeptide. In some embodiments, the pharmaceutical composition comprises (i) an mRNA having an open reading frame encoding an immune response costimulatory signal polypeptide, (ii) an mRNA having an open reading frame encoding an immune response costimulatory signal polypeptide, and (iii) an mRNA having an open reading frame encoding a checkpoint inhibitor polypeptide.

In some embodiments, the immune response primer polypeptide comprises interleukin 12 (IL12), interleukin (IL23), Toll-like receptor 4 (TLR4), interleukin 36 gamma (IL36gamma), interleukin 18 (IL18), or a combination thereof. In some embodiments, the immune response costimulatory signal polypeptide comprises tumor necrosis factor receptor superfamily member 4 ligand (OX40L), cluster of differentiation 80 (CD80), interleukin 15 (IL15), or a combination thereof. In some embodiments, the checkpoint inhibitor polypeptide inhibits programmed cell death protein 1 (PD1), programmed death-ligand 1 (PD-L1), or cytotoxic T-lymphocyte-associated protein 4 (CTLA-4).

In some embodiments, the pharmaceutical composition comprises (a) an mRNA that comprises (i) a 5' untranslated region (5'-UTR); (ii) an open reading frame (ORF) encoding at least one immune response primer polypeptide, an immune response costimulatory signal polypeptide, a checkpoint inhibitor polypeptide, or a combination thereof, wherein the ORF comprises at least one chemically modified nucleobase, sugar, backbone, or any combination thereof; (iii) at least one stop codon; (iv) a microRNA (miRNA) binding site; (v) a 3' untranslated region (3'-UTR); (vi) a polyA tail; and, (b) a lipid nanoparticle carrier.

In some embodiments of the pharmaceutical compositions disclosed herein (a) the first mRNA encodes an IL23 polypeptide and the second mRNA encodes an IL18 polypeptide; (b) the first mRNA encodes an IL23 polypeptide and the second mRNA encodes an IL12 polypeptide; (c) the first mRNA encodes an IL23 polypeptide and the second mRNA encodes an OX40L polypeptide; (d) the first mRNA encodes an IL12 polypeptide and the second mRNA encodes an anti-CTLA-4 antibody; (e) the first mRNA encodes an IL12 polypeptide and the second mRNA encodes an anti-PD-1 antibody or an anti-PD-L1 antibody; (f) the first mRNA encodes an IL23 polypeptide and the second mRNA encodes an anti-CTLA-4 antibody; (g) the first mRNA encodes an IL18 polypeptide and the second mRNA encodes an anti-PD-1 antibody or an anti-PD-L1 antibody; (h) the first mRNA encodes an IL18 polypeptide and the second mRNA encodes an anti-CTLA-4 antibody; (i) the first mRNA encodes an IL18 polypeptide and the second mRNA encodes an OX40L polypeptide; (j) the first mRNA encodes an IL18 polypeptide and the second mRNA encodes a TLR4 polypeptide; (k) the first mRNA encodes an IL8 polypeptide and the second mRNA encodes an IL12 polypeptide; (l) the first mRNA encodes an OX40L polypeptide and the second mRNA encodes an anti-CTLA-4 antibody; (m) the first mRNA encodes an OX40L polypeptide and the second mRNA encodes an anti-PD-1 antibody or an anti-PD-L1 antibody; (n) the first mRNA encodes an OX40L polypeptide and the second mRNA encodes an caTLR4 polypeptide; (o) the first mRNA encodes an OX40L polypeptide and the second mRNA encodes an IL23 polypeptide; (p) the first mRNA encodes an OX40L polypeptide and the second mRNA encodes an IL12 polypeptide; (q) the first mRNA encodes a CD80 polypeptide and the second mRNA encodes an anti-CTLA-4 antibody; (r) the first mRNA encodes a TLR4 polypeptide and the second mRNA encodes an anti-CTLA-4 antibody; (s) the first mRNA encodes an IL18 polypeptide and the second mRNA encodes an IL12, and further comprising a third mRNA encoding an IL23 polypeptide; (t) the first mRNA encodes an OX40L polypeptide and the second mRNA encodes a TLR4 polypeptide, and further comprising a third mRNA encoding an IL18 polypeptide; (u) the first mRNA encodes an OX40L polypeptide and the second mRNA encodes an IL12 polypeptide, and further comprising a third mRNA encoding an IL23 polypeptide; (v) the first polynucleotide encodes an IL23 polypeptide and the second polynucleotide encodes an IL12 polypeptide, and further comprising administering a third polynucleotide encoding an anti-CTLA-4 antibody; (w) the first mRNA encodes an IL23 polypeptide and the second mRNA encodes an IL18 polypeptide, and further comprising a third mRNA encoding an anti-CTLA-4 antibody; (x) the first mRNA encodes an IL23 polypeptide and the second mRNA encodes an IL12 polypeptide, and further comprising a third mRNA encoding an IL18 polypeptide and administering a fourth polynucleotide encoding an anti-CTLA-4 antibody; (y) the first mRNA encodes an IL23 polypeptide and the second mRNA encodes an IL12 polypeptide, and further comprising a third mRNA encoding an IL18 polypeptide and a fourth mRNA encoding an anti-PD-1 antibody or an anti-PD-L1 antibody; (z) the first mRNA encodes an OX40L polypeptide and the second mRNA encodes an IL18 polypeptide, and further comprising a third mRNA encoding a TLR4 polypeptide and a fourth mRNA encoding an anti-CTLA-4 antibody; or (aa) the first mRNA encodes an OX40L polypeptide and the second mRNA encodes an IL18 polypeptide, and further comprising a third mRNA encoding a TLR4 polypeptide and a fourth mRNA encoding an anti-PD-1 antibody or an anti-PD-L1 antibody.

In some embodiments of the pharmaceutical compositions disclosed herein, composition comprises 2, 3, 4, 5, 6 or more mRNAs, wherein each mRNA comprises at least one ORF. In some embodiments, the pharmaceutical composition comprises at least one chemically modified nucleobase, sugar, backbone, or any combination thereof. In some embodiments, each mRNA is formulated in the same lipid nanoparticle carrier. In some embodiments, each mRNA is formulated in a different lipid nanoparticle carrier. In some embodiments, the lipid nanoparticle carrier comprises a lipid selected from the group consisting of DLin-DMA, DLin-K-DMA, 98N12-5, C12-200, DLin-MC3-DMA, DLin-KC2-DMA, DODMA, PLGA, PEG, PEG-DMG, PEGylated lipids, amino alcohol lipids, KL22, and combinations thereof.

In some embodiments of the pharmaceutical compositions disclosed herein, the lipid nanoparticle carrier comprises a compound having formula (I)

(I)

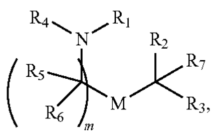

or a salt or stereoisomer thereof, wherein $R_1$ is selected from the group consisting of $C_{5-20}$ alkyl, $C_{5-20}$ alkenyl, —R*YR", —YR", and —R"M'R'; $R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle; $R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a carbocycle, heterocycle, —OR, $—O(CH_2)_nN(R)_2$, —C(O)OR, —OC(O)R, $—CX_3$, $—CX_2H$, $—CXH_2$, —CN, $—N(R)_2$, $—C(O)N(R)_2$, —N(R)C(O)R, $—N(R)S(O)_2R$, $—N(R)C(O)N(R)_2$, $—N(R)C(S)N(R)_2$, and $—C(R)N(R)_2C$(O)OR, and each n is independently selected from 1, 2, 3, 4, and 5; each $R_5$ is independently selected from the group consisting of $C_{1-3}$ alkyl, $C_{2-3}$ alkenyl, and H; each $R_6$ is independently selected from the group consisting of $C_{1-3}$ alkyl, $C_{2-3}$ alkenyl, and H; M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group; $R_7$ is selected from the group consisting of $C_{1-3}$ alkyl, $C_{2-3}$ alkenyl, and H; each R is independently selected from the group consisting of $C_{1-3}$ alkyl, $C_{2-3}$ alkenyl, and H; each R' is independently selected from the group consisting of $C_{1-18}$ alkyl, $C_{2-18}$ alkenyl, —R*YR", —YR", and H; each R" is independently selected from the group consisting of $C_{3-14}$ alkyl and $C_{3-14}$ alkenyl; each R* is independently selected from the group consisting of $C_{1-12}$ alkyl and $C_{2-12}$ alkenyl; each Y is independently a $C_{3-6}$ carbocycle; each X is independently selected from the group consisting of F, Cl, Br, and I; and m is selected from 5, 6, 7, 8, 9, 10, 11, 12, and 13; and provided when $R_4$ is $—(CH_2)_nQ$, $—(CH_2)_nCHQR$, —CHQR, or $—CQ(R)_2$, then (i) Q is not $—N(R)_2$ when n is 1, 2, 3, 4 or 5, or (ii) Q is not 5, 6, or 7-membered heterocycloalkyl when n is 1 or 2.

In some embodiments of the pharmaceutical compositions disclosed herein, the compound is of Formula (IA):

(IA)

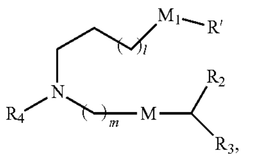

or a salt or stereoisomer thereof, wherein 1 is selected from 1, 2, 3, 4, and 5; m is selected from 5, 6, 7, 8, and 9; $M_1$ is a bond or M'; $R_4$ is unsubstituted $C_{1-3}$ alkyl, or $—(CH_2)_nQ$, in which n is 1, 2, 3, 4, or 5 and Q is OH, $—NHC(S)N(R)_2$, or $—NHC(O)N(R)_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl. In some embodiments, m is 5, 7, or 9.

In some embodiments of the pharmaceutical compositions disclosed herein, the compound is of Formula (II):

(II)

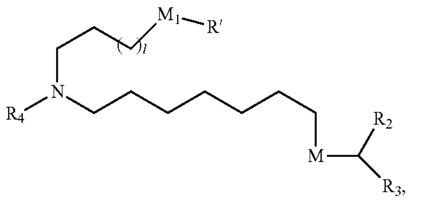

or a salt or stereoisomer thereof, wherein 1 is selected from 1, 2, 3, 4, and 5; $M_1$ is a bond or M'; $R_4$ is unsubstituted $C_{1-3}$ alkyl, or $—(CH_2)_nQ$, in which n is 2, 3, or 4 and Q is OH, $—NHC(S)N(R)_2$, or $—NHC(O)N(R)_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments of the pharmaceutical compositions disclosed herein, the compound is selected from Compound 1 to Compound 147, and salts and stereoisomers thereof.

In some embodiments of the pharmaceutical compositions disclosed herein, the compound is of the Formula (IIa), (IIa)

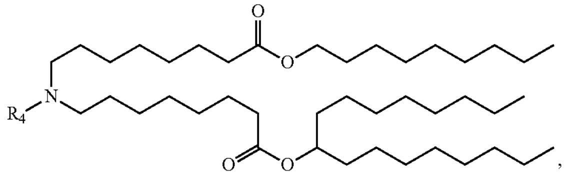

or a salt or stereoisomer thereof.

In some embodiments of the pharmaceutical compositions disclosed herein, the compound is of the Formula (IIb), (IIb)

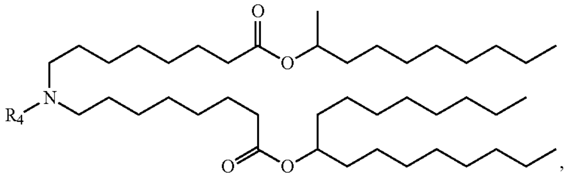

or a salt or stereoisomer thereof.

In some embodiments of the pharmaceutical compositions disclosed herein, the compound is of the Formula (IIc) or (IIe), (IIc)

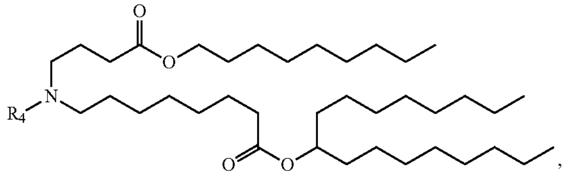

(IIe)

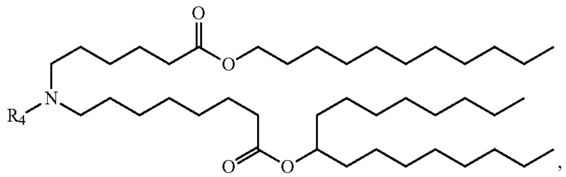

or a salt or stereoisomer thereof.

In some embodiments, wherein $R_4$ is selected from $—(CH_2)_nQ$ and $—(CH_2)_nCHQR$, wherein Q, R and n are as defined above.

In some embodiments of the pharmaceutical compositions disclosed herein, the compound is of the Formula (IId), (IId)

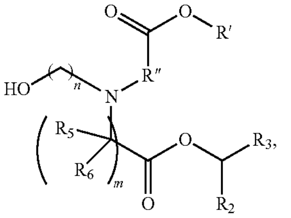

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined above.

In some embodiments, $R_2$ is $C_8$ alkyl. $R_3$ is $C_5$ alkyl, $C_6$ alkyl, $C_7$ alkyl, $C_8$ alkyl, or $C_9$ alkyl. In some embodiments, m is 5, 7, or 9. In some embodiments, each $R_5$ is H. In some embodiments, each $R_6$ is H.

In some embodiments of the pharmaceutical compositions disclosed herein, the lipid nanoparticle carrier further comprises a phospholipid. In some embodiments, the phospholipid is selected from the group consisting of 1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC),
1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), sphingomyelin, and mixtures thereof.

In some embodiments, the phospholipid is selected from the group consisting of 1-myristoyl-2-palmitoyl-sn-glycero-3-phosphocholine (14:0-16:0 PC, MPPC),
1-myristoyl-2-stearoyl-sn-glycero-3-phosphocholine (14:0-18:0 PC, MSPC),
1-palmitoyl-2-acetyl-sn-glycero-3-phosphocholine (16:0-02:0 PC),
1-palmitoyl-2-myristoyl-sn-glycero-3-phosphocholine (16:0-14:0 PC, PMPC),
1-palmitoyl-2-stearoyl-sn-glycero-3-phosphocholine (16:0-18:0 PC, PSPC),
1-palmitoyl-2-oleoyl-sn-glycero-3-phosphocholine (16:0-18:1 PC, POPC),
1-palmitoyl-2-linoleoyl-sn-glycero-3-phosphocholine (16:0-18:2 PC, PLPC),
1-palmitoyl-2-arachidonoyl-sn-glycero-3-phosphocholine (16:0-20:4 PC),
1-palmitoyl-2-docosahexaenoyl-sn-glycero-3-phosphocholine (14:0-22:6 PC),
1-stearoyl-2-myristoyl-sn-glycero-3-phosphocholine (18:0-14:0 PC, SMPC),
1-stearoyl-2-palmitoyl-sn-glycero-3-phosphocholine (18:0-16:0 PC, SPPC),
1-stearoyl-2-oleoyl-sn-glycero-3-phosphocholine (18:0-18:1 PC, SOPC),
1-stearoyl-2-linoleoyl-sn-glycero-3-phosphocholine (18:0-18:2 PC),
1-stearoyl-2-arachidonoyl-sn-glycero-3-phosphocholine (18:0-20:4 PC),
1-stearoyl-2-docosahexaenoyl-sn-glycero-3-phosphocholine (18:0-22:6 PC),
1-oleoyl-2-myristoyl-sn-glycero-3-phosphocholine (18:1-14:0 PC, OMPC),
1-oleoyl-2-palmitoyl-sn-glycero-3-phosphocholine (18:1-16:0 PC, OPPC),
1-oleoyl-2-stearoyl-sn-glycero-3-phosphocholine (18:1-18:0 PC, OSPC),
1-palmitoyl-2-oleoyl-sn-glycero-3-phosphoethanolamine (16:0-18:1 PE, POPE),
1-palmitoyl-2-linoleoyl-sn-glycero-3-phosphoethanolamine (16:0-18:2 PE),
1-palmitoyl-2-arachidonoyl-sn-glycero-3-phosphoethanolamine (16:0-20:4 PE),
1-palmitoyl-2-docosahexaenoyl-sn-glycero-3-phosphoethanolamine (16:0-22:6 PE),
1-stearoyl-2-oleoyl-sn-glycero-3-phosphoethanolamine (18:0-18:1 PE),
1-stearoyl-2-linoleoyl-sn-glycero-3-phosphoethanolamine (18:0-18:2 PE),
1-stearoyl-2-arachidonoyl-sn-glycero-3-phosphoethanolamine (18:0-20:4 PE),
1-stearoyl-2-docosahexaenoyl-sn-glycero-3-phosphoethanolamine (18:0-22:6 PE),
1-oleoyl-2-cholesterylhemisuccinoyl-sn-glycero-3-phosphocholine (OChemsPC), and any combination thereof.

In some embodiments of the pharmaceutical compositions disclosed herein, the lipid nanoparticle carrier further comprises a structural lipid. In some embodiments, the structural lipid is selected from the group consisting of cholesterol, fecosterol, sitosterol, ergosterol, campesterol, stigmasterol, brassicasterol, tomatidine, ursolic acid, alpha-tocopherol, and mixtures thereof.

In some embodiments of the pharmaceutical compositions disclosed herein, the lipid nanoparticle carrier further comprises a PEG lipid. In some embodiments, the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments of the pharmaceutical compositions disclosed herein, the lipid nanoparticle carrier further comprises an ionizable lipid selected from the group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl 4-(dimethylamino) butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), 2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA), (2R)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2S)).

In some embodiments of the pharmaceutical compositions disclosed herein, the lipid nanoparticle carrier further comprises a quaternary amine compound. In some embodiments, the quaternary amine compound is selected from the group consisting of 1,2-dioleoyl-3-trimethylammonium-propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), N,N-distearyl-N,N-dimethylammonium bromide (DDAB), N-(1,2-dimyristyloxyprop-3-yl)-N,N-dimethyl-N-hydroxyethyl ammonium bromide (DMRIE), N-(1,2-dioleoyloxyprop-3-yl)-N,N-dimethyl-N-hydroxyethyl ammonium bromide (DORIE), N,N-dioleyl-N,N-dimethyl ammonium chloride (DODAC), 1,2-dilauroyl-sn-glycero-3-ethylphosphocholine (DLePC), 1,2-distearoyl-3-trimethylammonium-propane (DSTAP), 1,2-dipalmitoyl-3-trimethylammonium-propane (DPTAP), 1,2-dilinoleoyl-3-trimethylammonium-propane (DLTAP), 1,2-dimyristoyl-3-trimethylammonium-propane (DMTAP), 1,2-distearoyl-sn-glycero-3-ethylphosphocholine (DSePC), 1,2-dipalmitoyl-sn-glycero-3-ethylphosphocholine (DPePC), 1,2-dimyristoyl-sn-glycero-3-ethylphosphocholine (DMePC), 1,2-dioleoyl-sn-glycero-3-ethylphosphocholine (DOePC), 1,2-di-(9Z-tetradecenoyl)-sn-glycero-3-ethylphosphocholine (14:1 EPC), 1-palmitoyl-2-oleoyl-sn-glycero-3-ethylphosphocholine (16:0-18:1 EPC), and any combination thereof.

In some embodiments of the compositions, pharmaceutical compositions, or kits disclosed above, the administration of the polynucleotide, composition, or pharmaceutical composition to a subject in need thereof reduces the size of a tumor or inhibits growth of a tumor at least 1.5 fold, at least 2 fold, at least 2.5 fold, at least 3 fold, at least 3.5 fold, at least 4 fold, at least 4.5 fold, or at least 5 fold better than a monotherapy consisting of administration of only one polynucleotide in the composition or pharmaceutical composition.

BRIEF DESCRIPTION OF THE DRAWINGS/FIGURES

FIG. 1 shows total IgG (mIgG) versus active CTLA-4 binding (mCTLA-4 binding) in HeLa cells expressing mRNA-encoded 9D9 antibodies. The 9D9 antibodies are HC-2Aa:LC (9D9 IgG2a antibody) and HC-2B:LC (9D9 IgG2b antibody).

FIGS. 2A to 2C show positive/negative efficacy control data in CT26 carcinoma model from 3 doses of 5 mg/kg anti-CTLA-4 protein (FIG. 2B) or 0.5 mg/kg NST FIX (FIG. 2C) administered at days 3, 6 and 9 as compared to untreated animals (FIG. 2A). NST FIX is a negative control mRNA (mRNA encoding non-translated ("non-start") Factor IX).

FIGS. 3A to 3F show treatment with 1, 2 or 3 doses of mRNA encoding anti-CTLA-4 (9D9 2b) antibody. FIG. 3A and FIG. 3B show data corresponding to control sample NST FIX and 9D9 2b anti-CTLA-4 antibody, respectively, administered at day 3.

FIG. 3C and FIG. 3D show data corresponding to control sample NST FIX and 9D9 2b anti-CTLA-4 antibody, respectively, administered at day 3 and day 9. FIG. 3E and FIG. 3F show data corresponding to control sample NST FIX and 9D9 2b anti-CTLA-4 antibody, respectively, administered at day 3, day 6 and day 9.

FIGS. 4A to 4F show treatment with 1, 2 or 3 doses of mRNA encoding anti-CTLA-4 (9D9 2a). FIG. 4A and FIG. 4B show data corresponding to control sample NST FIX and 9D9 2a anti-CTLA-4 antibody, respectively, administered at day 3. FIG. 4C and FIG. 4D show data corresponding to control sample NST FIX and 9D9 2a anti-CTLA-4 antibody, respectively, administered at day 3 and day 9. FIG. 4E and FIG. 4F show data corresponding to control sample NST FIX and 9D9 2a anti-CTLA-4 antibody, respectively, administered at day 3, day 6 and day 9.

FIGS. 5A and 5B show the efficacy of 9D9 2b anti-CTLA antibody protein in the CT26 carcinoma model (FIG. 5B) compared to untreated controls (FIG. 5A). The 9D9 2b anti-CTLA-4 antibody was administered at days 3, 6 and 9 after tumor implantation.

FIG. 6 shows serum levels of anti-CTLA-4 9D9 antibody after administration of a 5 mg/kg dose (observed at 24 hours (left bar), 48 hours (middle bar), and 72 hours (right bar) time points) or after administration of 0.5 mg/kg of mRNA encoding the 9D9 2b antibody, mRNA encoding the 9D9 2a antibody, or controls (NST FIX or DPBS) (observed at 24 hours, 48 hours, 72 hours, and 7 days time points, from left to right respectively).

FIGS. 7A and 7B show individual tumor growth curves for untreated animals (FIG. 77A) and control animals treated with NST FIX/LNP (FIG. 7B). mRNA encoding the negative control NST FIX was administered at 0.5 mg RNA/kg at day 3, at day 6, and at day 9 after tumor implantation.

FIG. 8 shows individual tumor growth curves for animals treated with 3 doses of 5 mg/kg anti-CTLA-4 9D9 antibody protein administered at day 3, at day 6, and at day 9 after tumor implantation.

FIG. 9 shows individual tumor growth curves for animals treated with 3 doses of mRNA designed to express anti-CTLA-4 9D9 2b antibody. 0.5 mg mRNA/kg doses were administered at day 3, at day 6, and at day 9 after tumor implantation.

FIG. 10 shows individual tumor growth curves for animals treated with 3 doses of mRNA designed to express anti-CTLA-4 9D9 2a antibody. 0.5 mg mRNA/kg doses were administered at day 3, at day 6, and at day 9 after tumor implantation.

Figure 14:
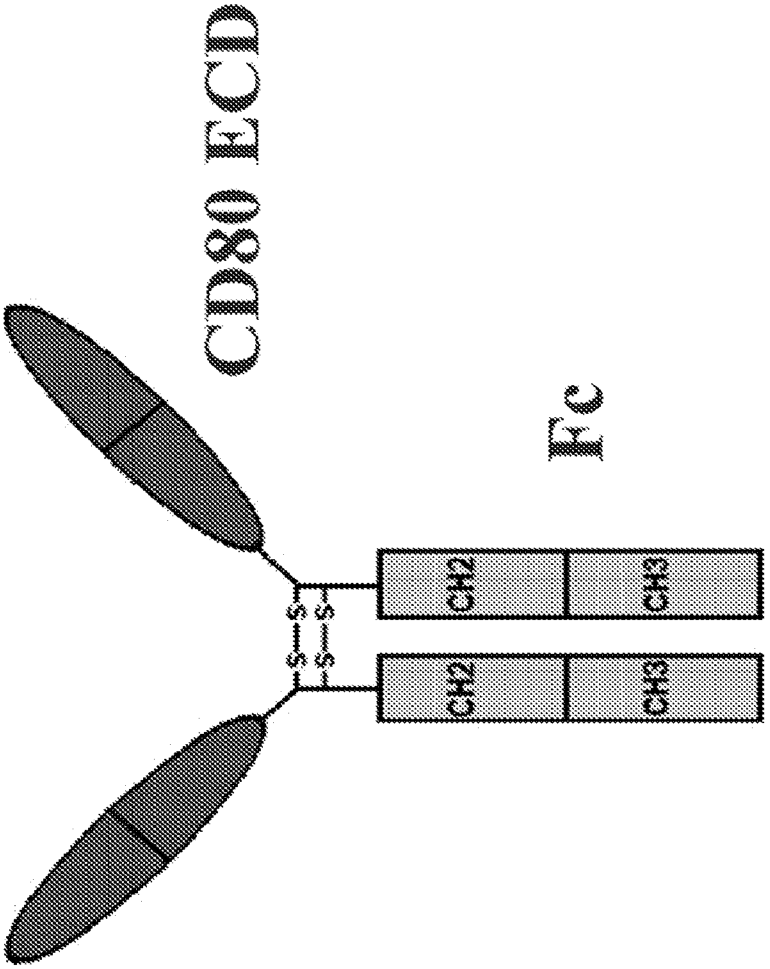

FIG. 14 is a diagram of the structure of a chimeric CD80Fc polypeptide. Such a chimeric polypeptide is a dimer, each monomer of which comprises CD80's extracellular domain and a Fc domain (itself comprising two CH2 domains and a hinge region). The CD80Fc dimer is held together by disulfide bonds within the hinge region of Fc.

Figure 15:
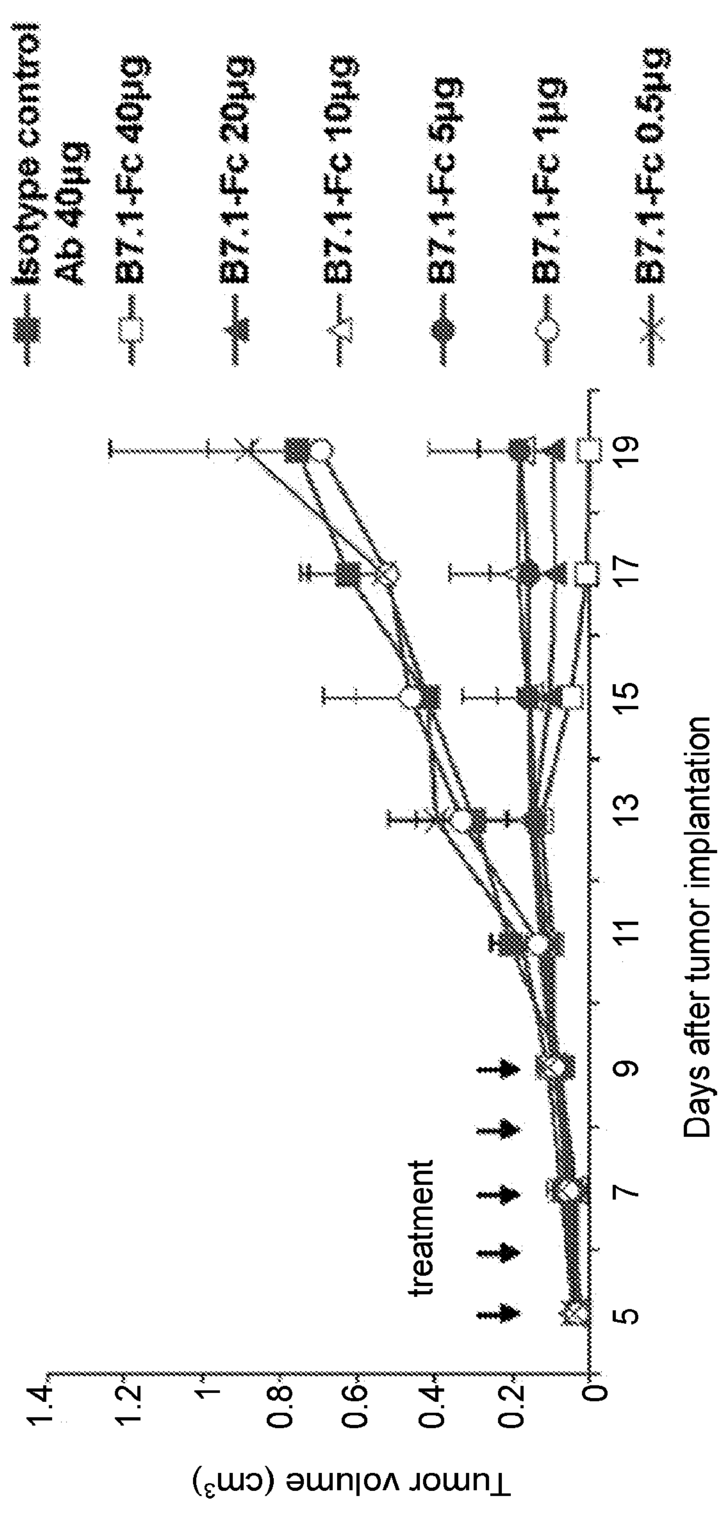

FIG. 15 is a graph showing the effectiveness of CD80Fc ("B7.1-Fc") in treating a mouse model of colon cancer. Colon 26 cells were established in the flank of C57BL/6J mice, and the average tumor volume over time was measured after repeated treatment with a range of CD80Fc concentrations.

Figure 16:
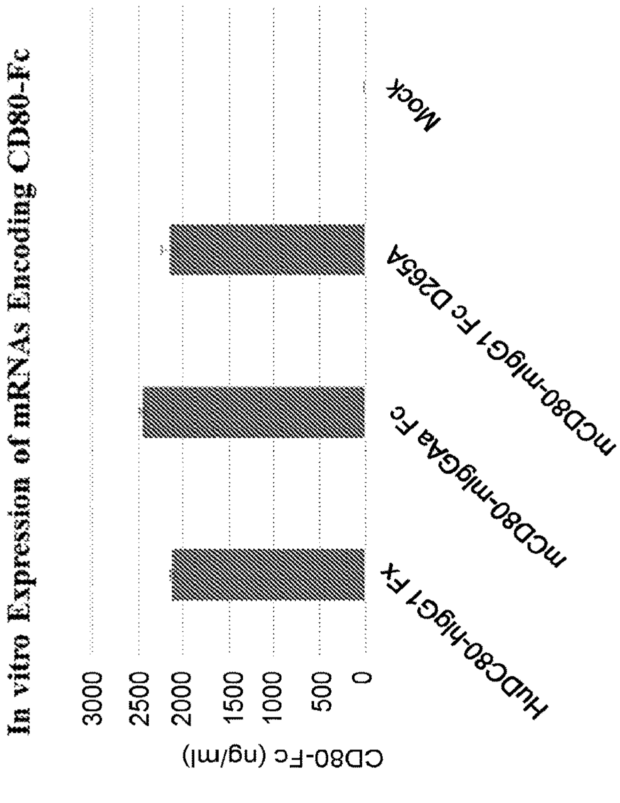

FIG. 16 shows the expression levels of murine and human modified mRNAs encoding CD80Fc constructs.

Figure 17:
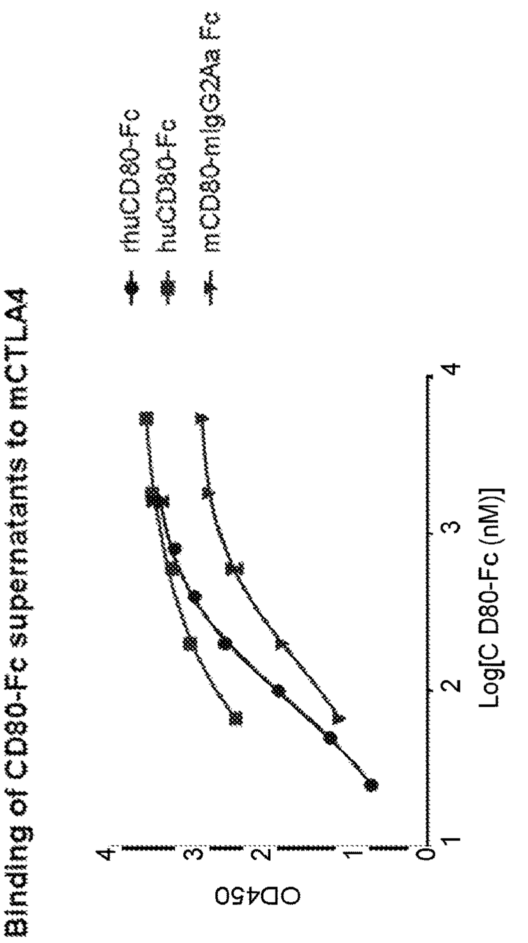

FIG. 17 shows the results of testing the ability of the expressed CD80Fc constructs to bind CTLA-4.

Figure 18:
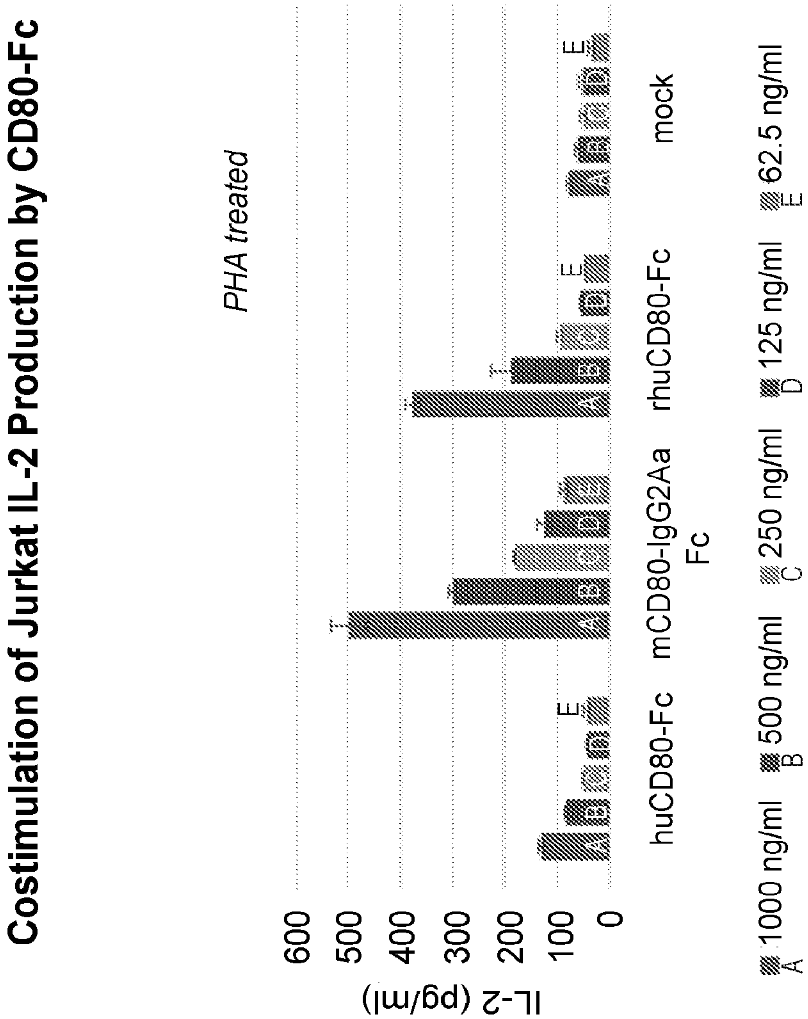

FIG. 18 is a graph showing the secretion of IL-2 after CD80Fc-mediated costimulation of Jurkat cells. Jurkat cells were PHA treated to provide a primary T cell receptor activation signal, and the cells were treated with a CD80Fc polypeptide. Each chimeric polypeptide was administered at a range of concentrations including 62.5 ng/mL, 125 ng/mL, 250 ng/mL, 500 ng/mL, and 1000 ng/mL.

Figures 19A, 19B, 19C:
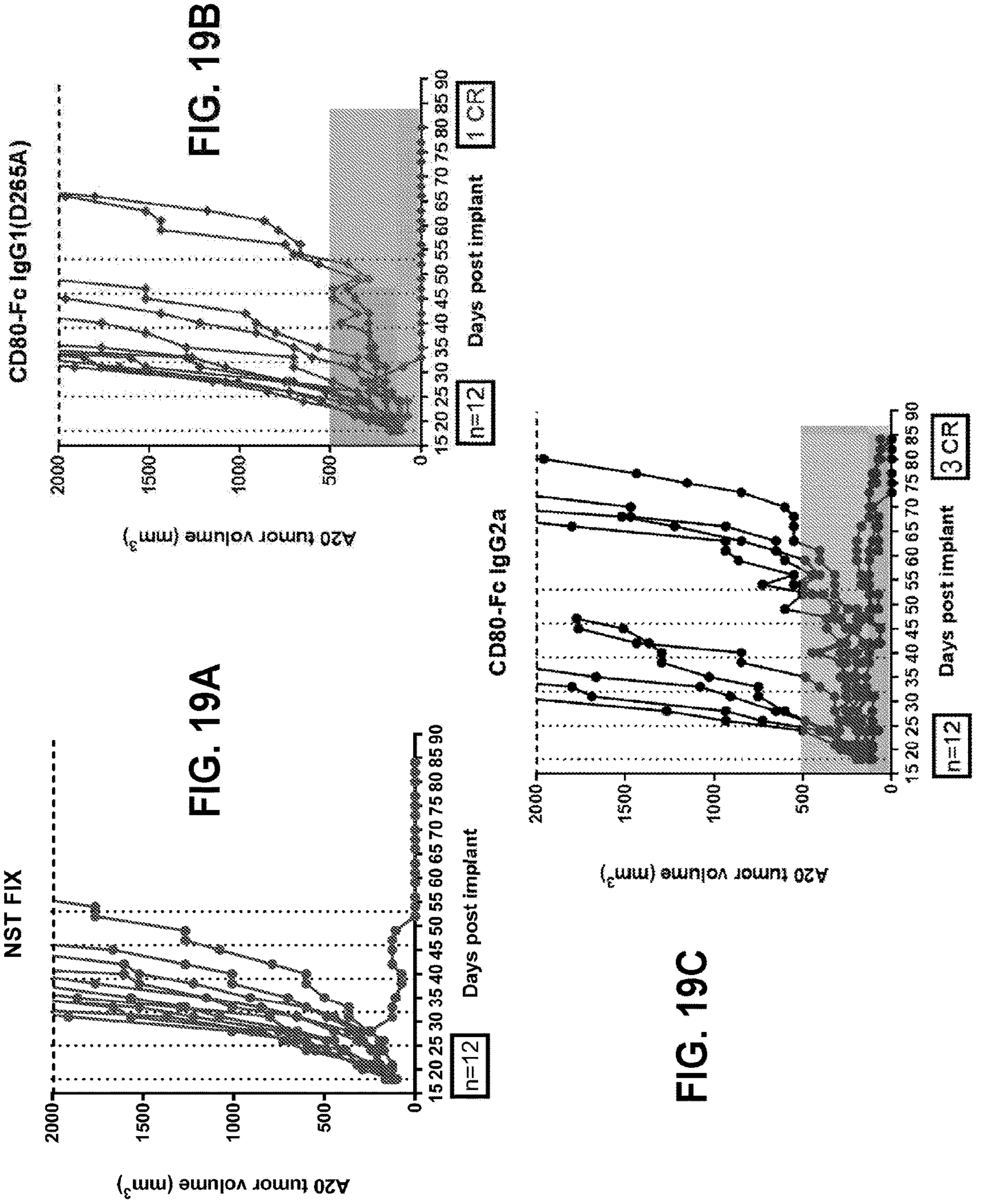

FIG. 19A, FIG. 19B and FIG. 19C contain graphs of the in vivo efficacy of modified mRNAs encoding chimeric CD80Fc polypeptides in a B-cell lymphoma model. A20 B cell lymphoma cells were established subcutaneously in BALB/c mice (n=12), and subsequently dosed with 12.5 μg modified mRNA doses Q7D×6. Mice were dosed with modified mRNA encoding chimeric CD80Fc (FIGS. 19B and 19C) or a control mRNA (FIG. 19A). The graphs present individual plots for the growth of each tumor over time, starting at day 18 post-implantation.

Figure 20:
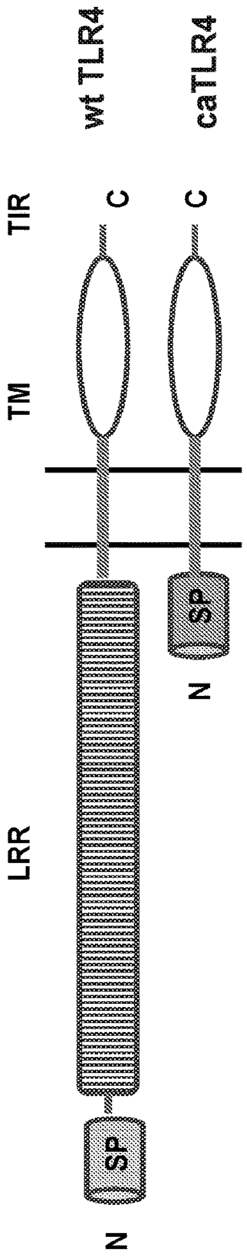

FIG. 20 shows the structures of full-length wild type ("wt") TLR4 and a caTLR4. The full-length wt TLR4 contains a signal peptide ("sp") at the amino-terminus ("N"), an extracellular leucine-rich repeat domain ("LRR"), a transmembrane domain ("TM"), and an intracellular toll/interleukin-1 receptor-like domain ("TIR") at the carboxy-terminus ("C"). caTLR4 lacks the wild type signal peptide and LRR, containing instead a human lysosome-associated membrane protein 1 ("hLAMP1") or mouse immunoglobulin kappa variable ("mIgk") signal peptide. The remainder of the caTLR4 structure is the same as wt TLR4.

Figure 21:
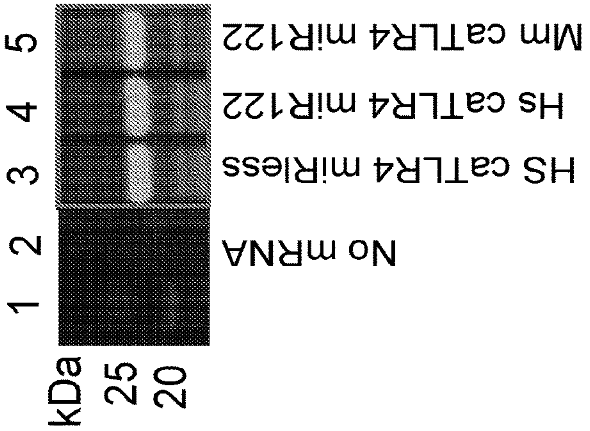

FIG. 21 shows expression of caTLR4 mRNAs in cell-free translation by QC. Lane "1" is an RNA ladder showing sizes of 20 and 25 kiloDaltons ("kDa"). Lane 2 is a negative control showing absence of bands when no mRNA is included in the cell-free translation system. Lane 3 shows human caTLR4 expressed from an mRNA without any microRNA ("miR") target sites ("HS caTLR4 miRless"). Lane 4 shows human caTLR4 expressed from an mRNA containing a miR122 target site ("Hs caTLR4 miR122"). Lane 5 shows mouse caTLR4 expressed from an mRNA containing a miR122 target site ("Mm caTLR4 miR122").

Figure 22:
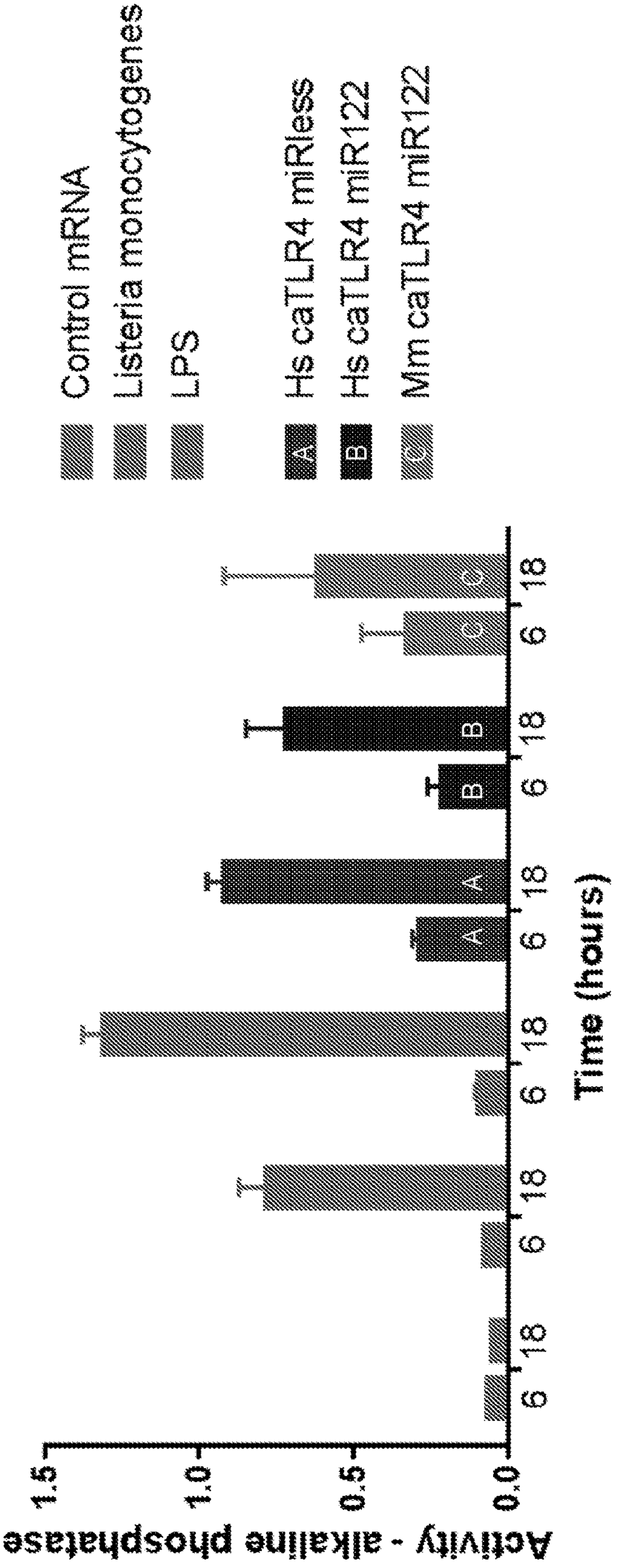

FIG. 22 is a graph showing alkaline phosphatase activity at 6 and 18 hours after transfection of THP1-Blue™ NF-κB cells with control mRNA, Hs caTLR4 miRless, Hs caTLR4 miR122, or Mm caTLR4 miR122, after infection with *Listeria monocytogenes*, or after exposure to lipopolysaccharide ("LPS").

Figure 23B:
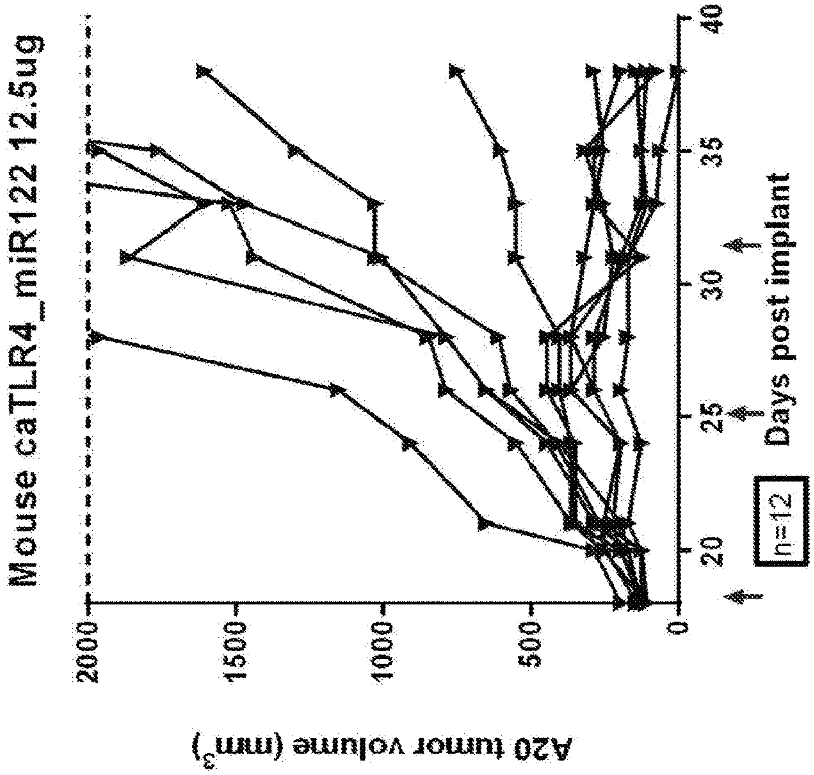
Figure 23A:
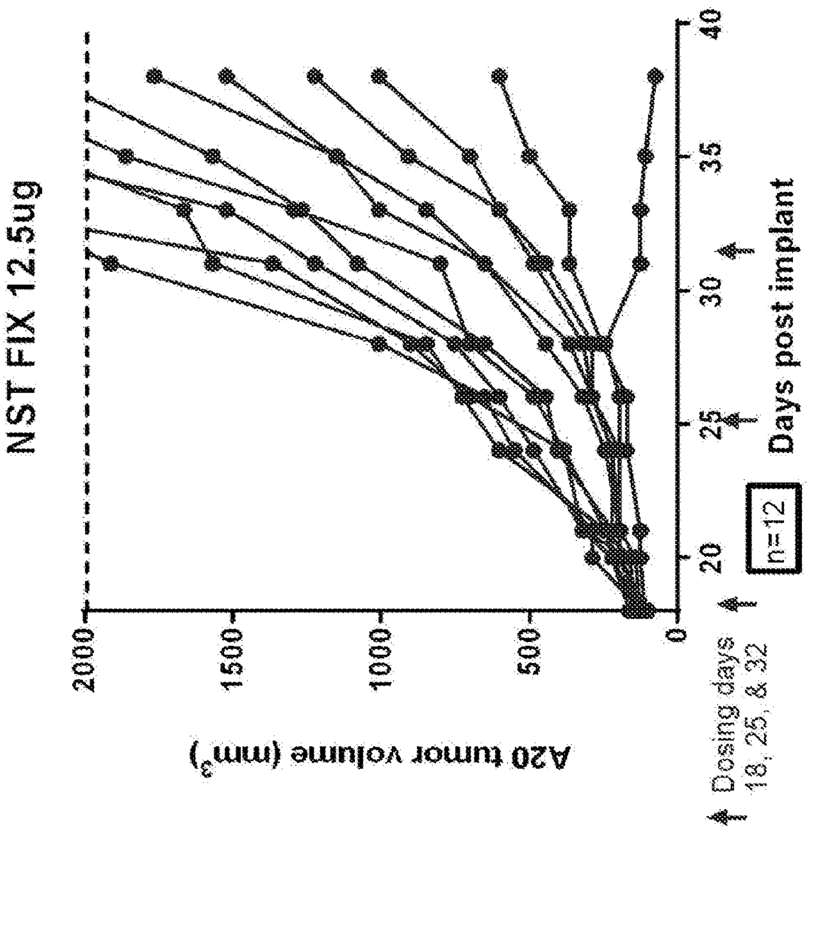

FIG. 23A and FIG. 23B are graphs showing tumor volume ($mm^3$) in 12 individual mice ("n=12") after subcutaneous implantation of mouse A20 B-cell lymphoma cells and intratumoral doses of either 12.5 μg NST FIX (FIG. 23A) or 12.5 μg of an mRNA encoding mouse caTLR4 and containing a miR122 target site ("Mouse caTLR4_miR122," FIG. 23B) at 18, 25, and 32 days after implantation.

Figure 24A:
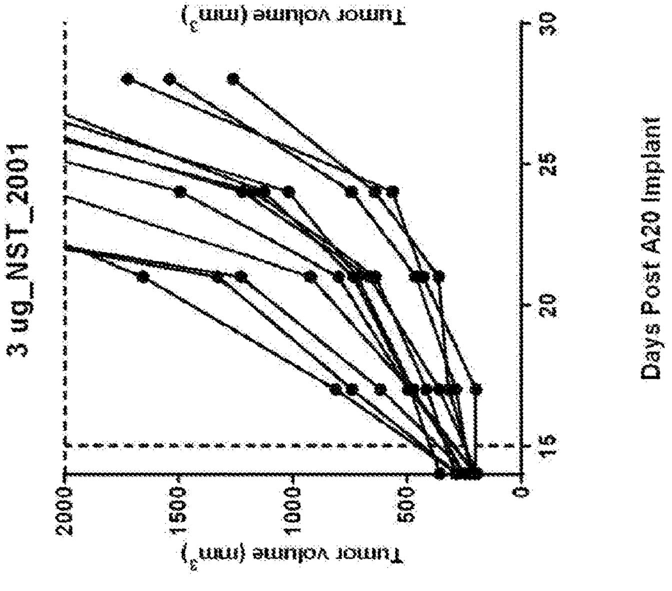
Figure 24B:
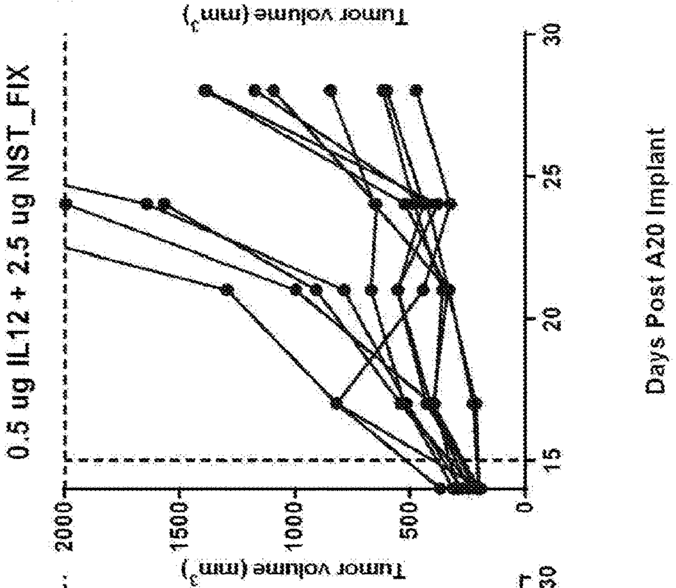
Figure 24C:
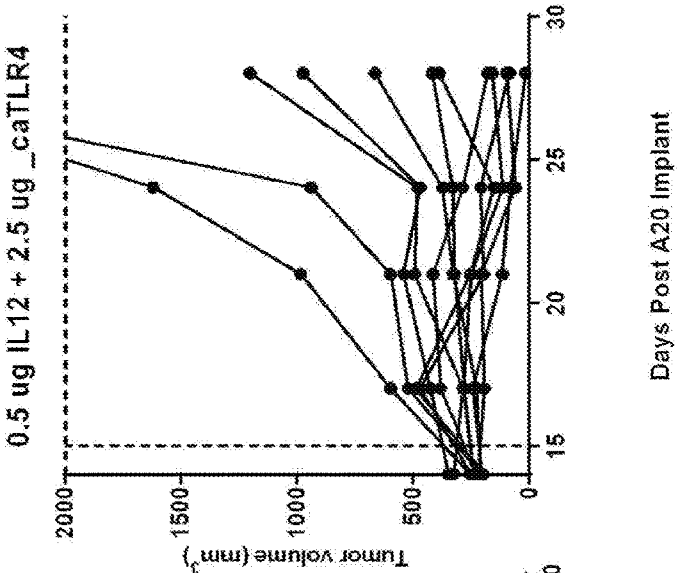

FIGS. 24A to 24C are graphs showing tumor volume ($mm^3$) in 12 individual mice after subcutaneous implantation of an A20 B-cell lymphoma cells and intratumoral dosing with either 3 μg NST 2001 (FIG. 24A), 0.5 μg interleukin-12 ("IL12")+2.5 μg NST FIX (FIG. 24B), or 0.5 μg IL12+2.5 μg of an mRNA encoding a caTLR4 (FIG. 24C) after implantation.

Figure 25:
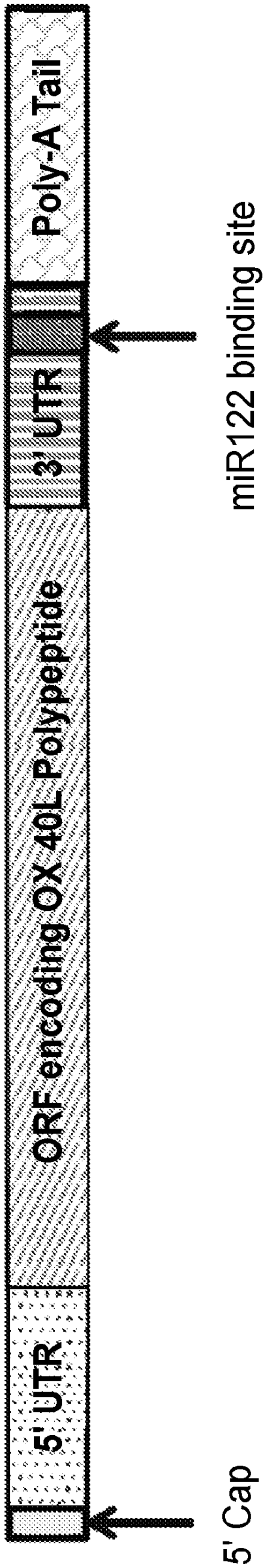

FIG. 25 shows an example of an OX40L encoding polynucleotide (mRNA). The mRNA can comprise a 5'cap, 5' UTR, an ORF (mRNA) encoding an OX40L polypeptide, a 3'UTR, a miR122 binding site, and a poly-A tail.

Figure 26:
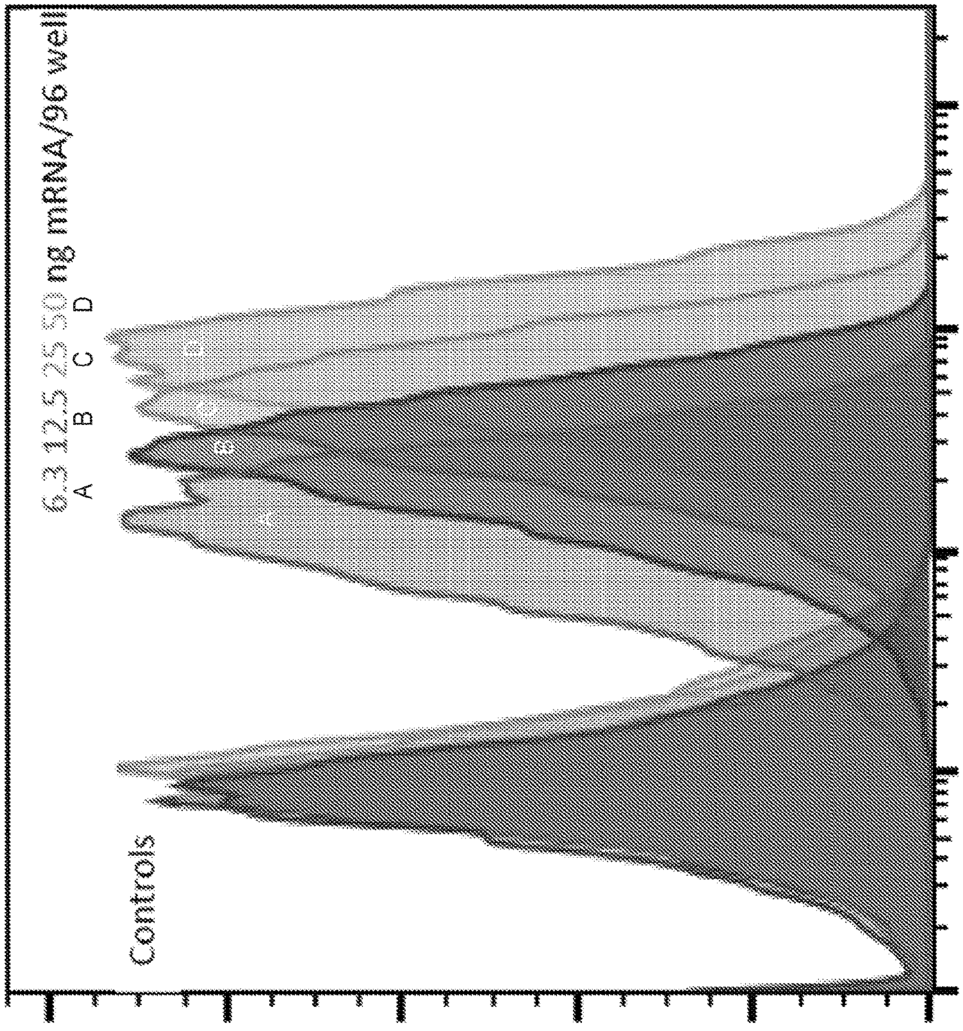

FIG. 26 shows expression of OX40L on the surface of B16F10 cells after treatment with a polynucleotide comprising an mRNA encoding an OX40L polypeptide. The left peaks represent the control (either mock-treated or treated with negative control mRNA (non-translatable version of the same mRNA containing multiple stop codons)). The right four peaks represent OX40L expression from the administration of 6.3 ng, 12.5 ng, 25 ng, or 50 ng OX40L mRNA.

Figures 27A, 27B, 27C, 27D, 27E:
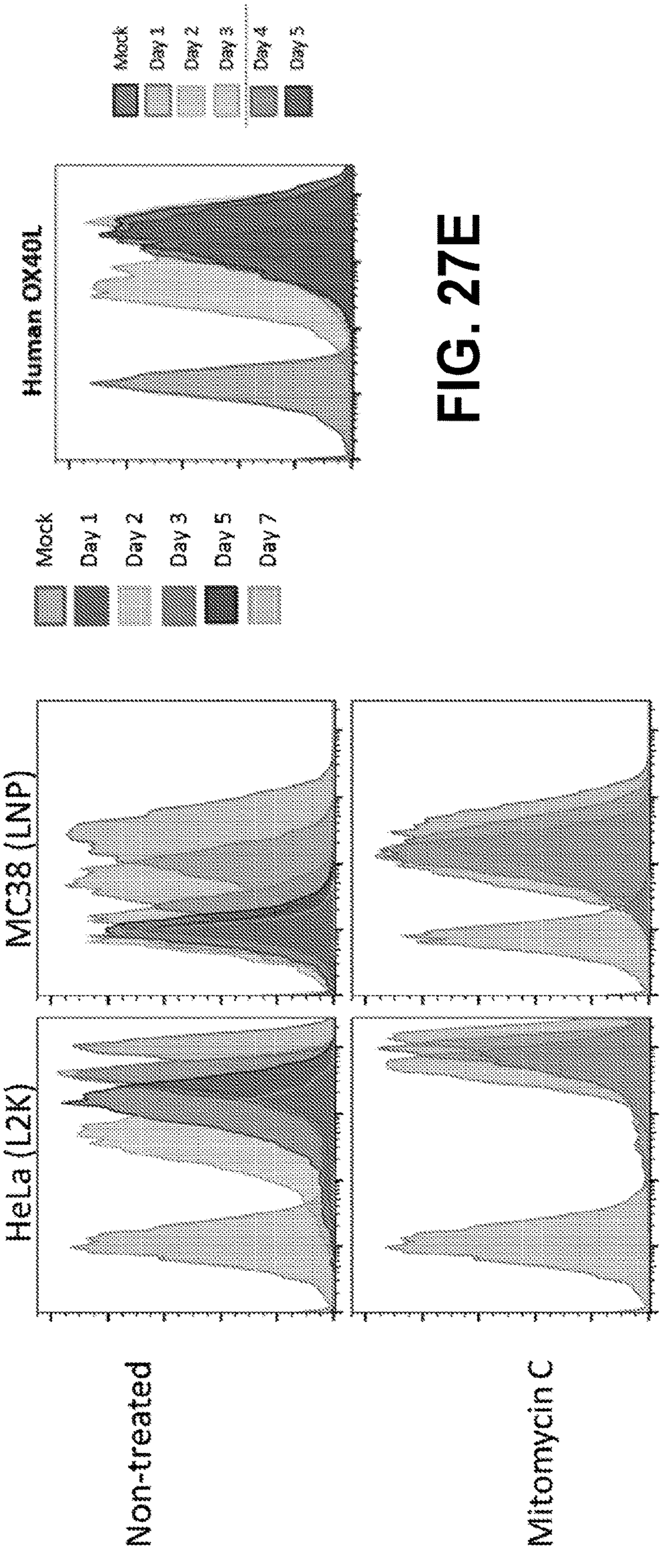

FIG. 27A shows expression of OX40L on the surface of HeLa cells after treatment with a polynucleotide comprising an mRNA encoding an OX40L polypeptide; treatment was in the absence of mitomycin C.

Figure 3B:
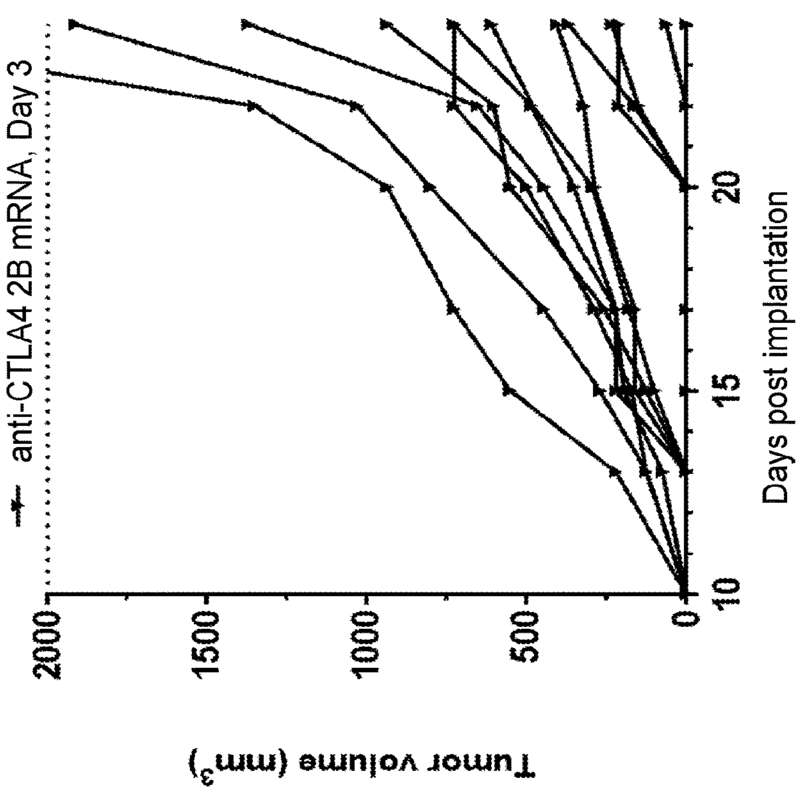
Figure 3A:
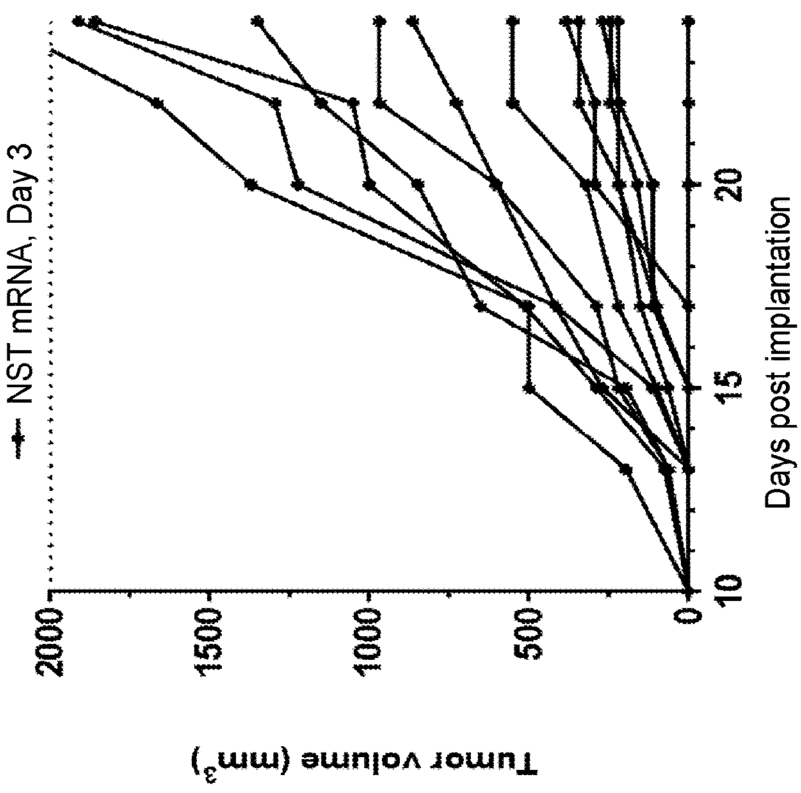

FIG. 27B show expression of OX40L on the surface of MC-38 cells after treatment with a polynucleotide comprising an mRNA encoding an OX40L polypeptide; treatment was in the absence of mitomycin C. Peak 1 in FIGS. 3A and 3B shows surface expression on mock treated cells. Peaks 2-6 show surface expression on days 1, 2, 3, 5, and 7 (respectively) after treatment with a polynucleotide comprising an mRNA encoding an OX40L polypeptide.

FIG. 27C shows expression of OX40L on the surface of HeLa cells after treatment with a polynucleotide comprising an mRNA encoding an OX40L polypeptide; treatment was in the presence of mitomycin C.

Figure 3C:
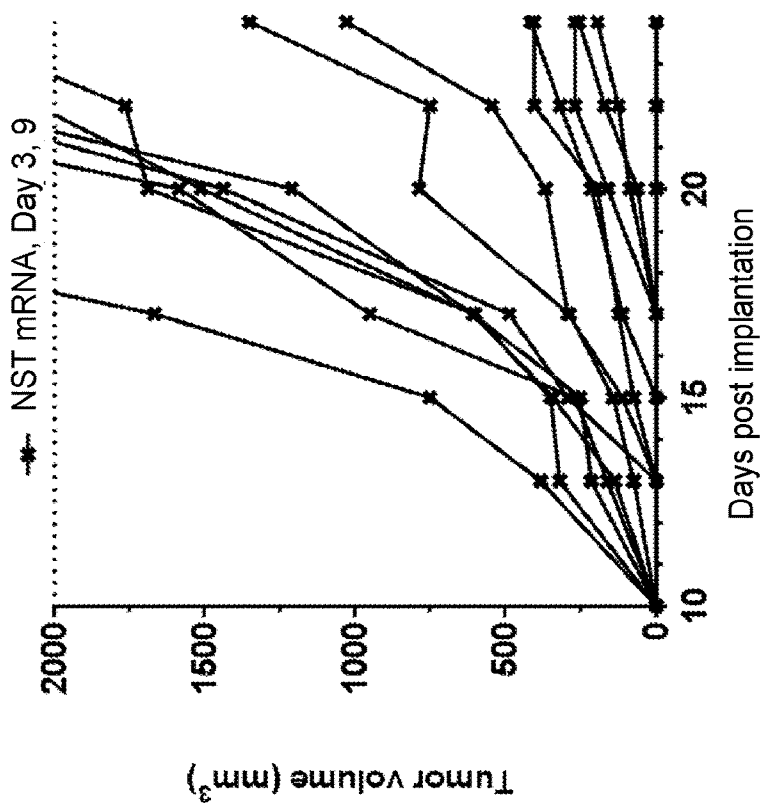
Figure 3D:
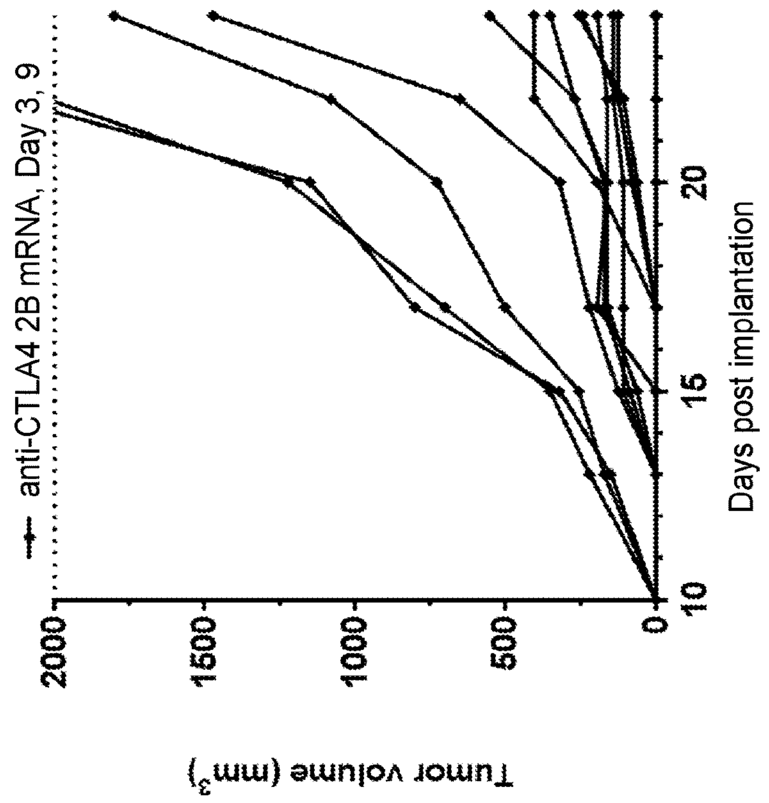
Figure 3E:
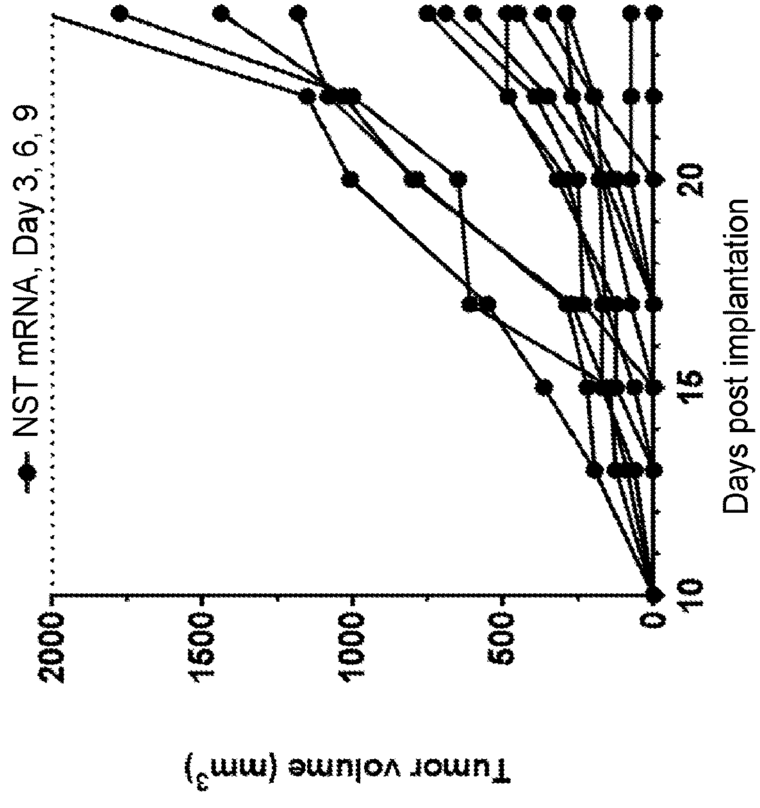

FIG. 27D shows expression of OX40L on the surface of MC-38 cells after treatment with a polynucleotide comprising an mRNA encoding an OX40L polypeptide; treatment was in the presence of mitomycin C. Peak 1 in FIGS. 3C and 3D shows surface expression on mock treated cells. Peaks 2-6 show surface expression on days 1, 2, 3, 5, and 7 (respectively) after treatment with a polynucleotide comprising an mRNA encoding an OX40L polypeptide.

FIG. 27E shows expression of human OX40L on the surface of HeLa cells after treatment with a polynucleotide comprising an mRNA encoding an OX40L polypeptide. Peak 1 shows the surface expression on mock treated cells. Peaks 2-6 show surface expression on day 1, 2, 3, 4, and 5 (respectively) after treatment with a polynucleotide comprising an mRNA encoding an OX40L polypeptide.

Figure 27F:
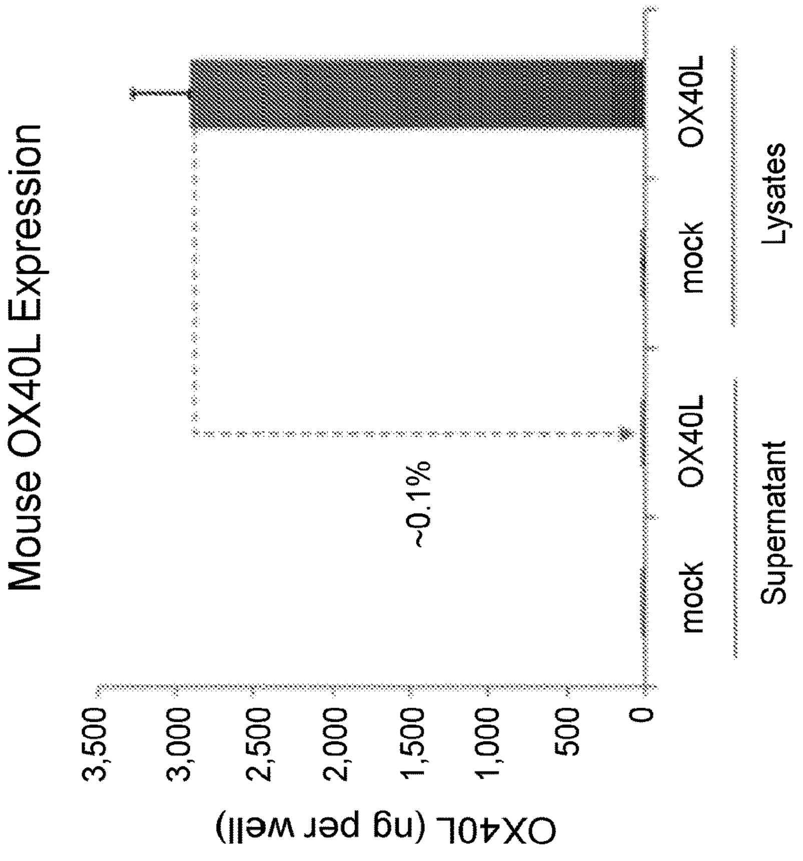

FIG. 27F shows quantitation of mouse OX40L protein in cell lysate and cell culture supernatant after treatment of HeLa cells with a polynucleotide comprising an mRNA encoding an OX40L polypeptide.

Figure 3F:
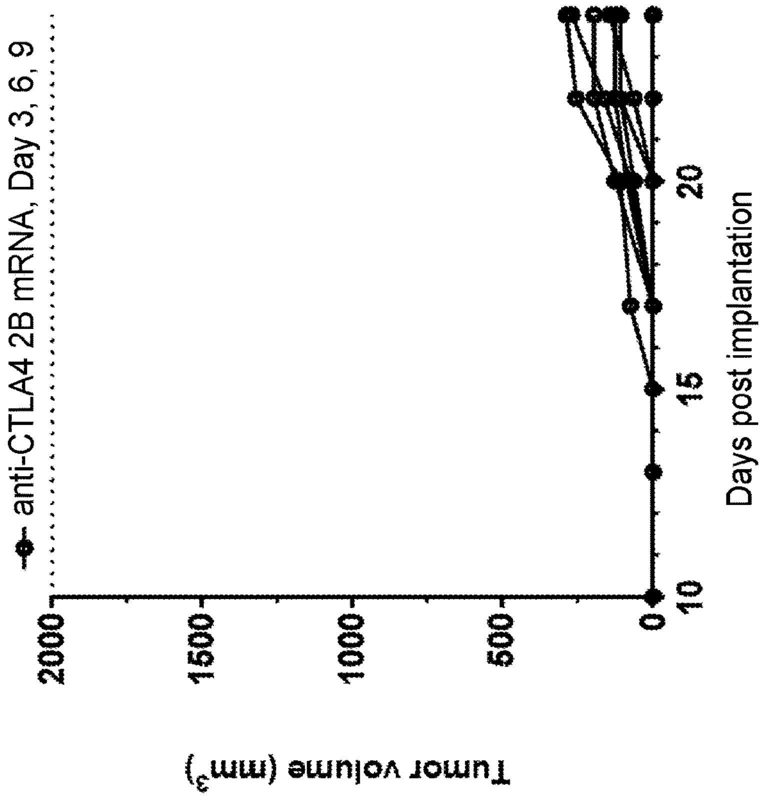
Figure 4A:
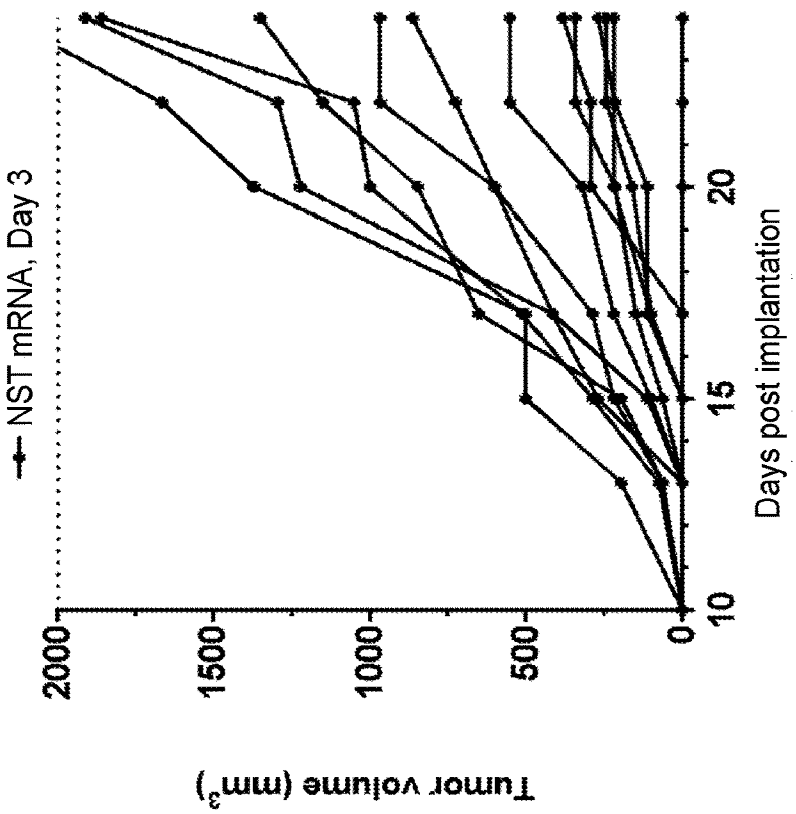
Figure 4B:
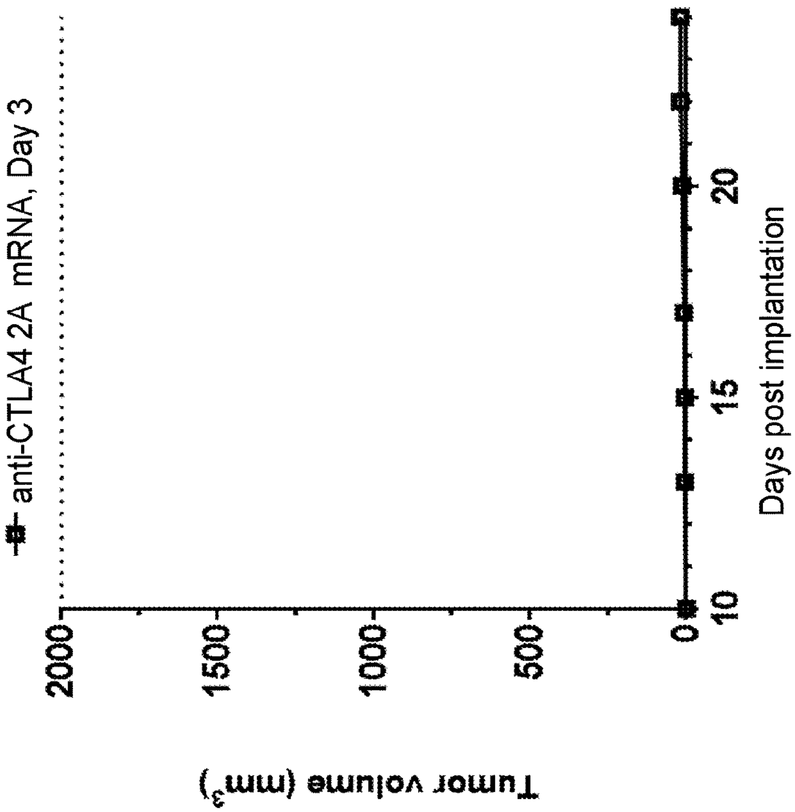
Figure 4D:
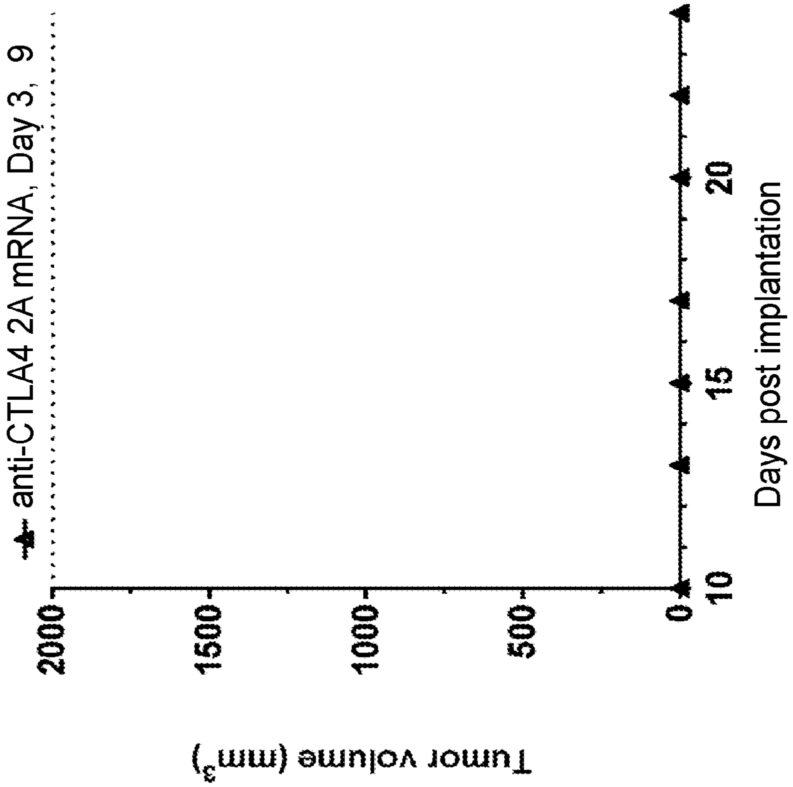
Figure 4C:
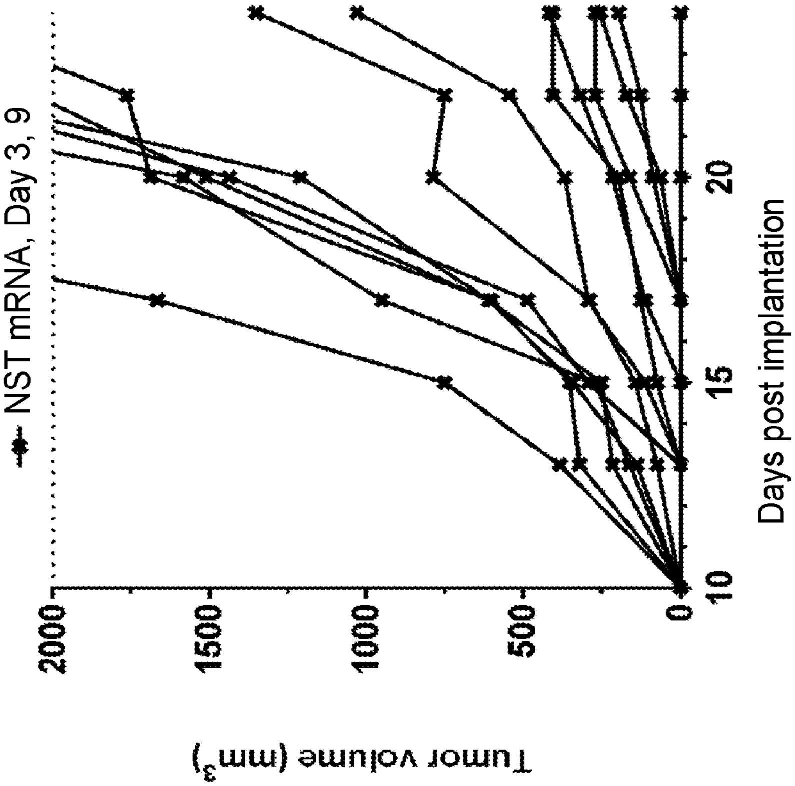
Figure 4E:
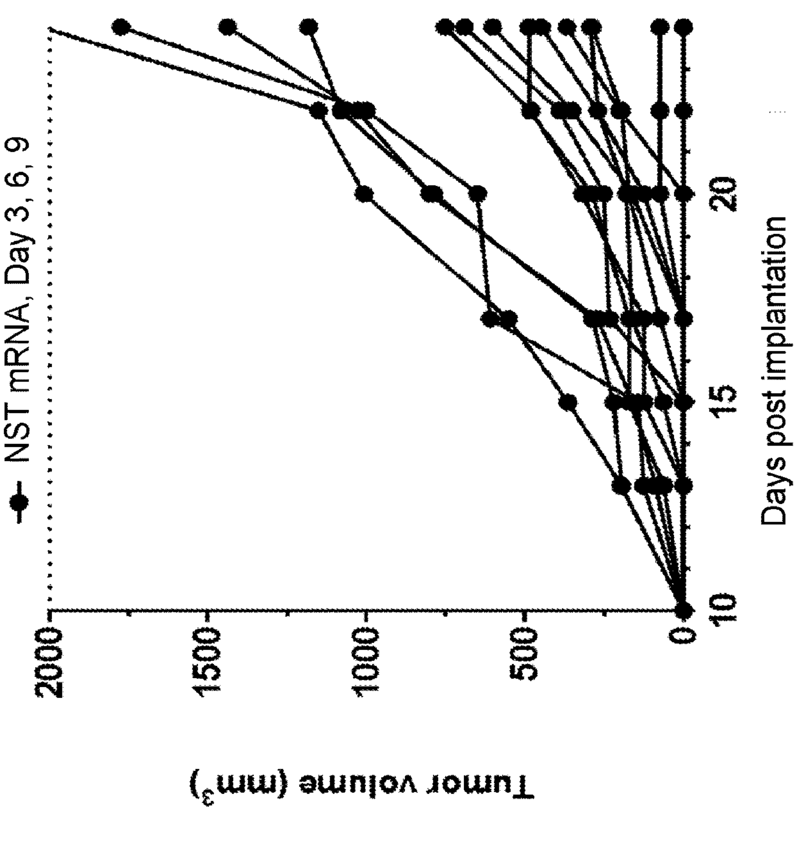
Figure 4F:
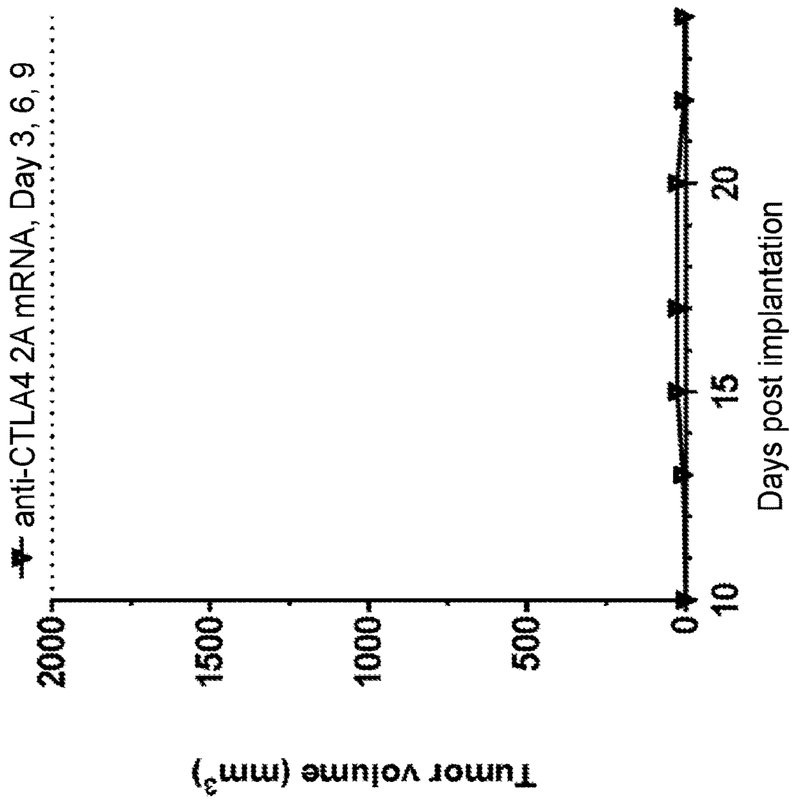
Figure 27G:
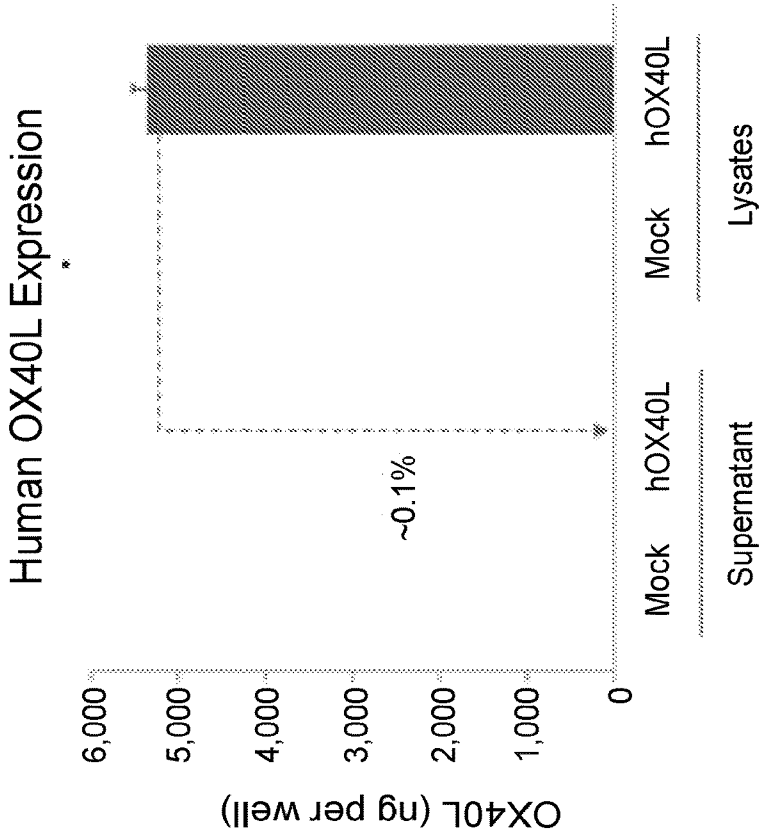

FIG. 27G shows quantitation of human OX40L protein in cell lysate and cell culture supernatant after treatment of HeLa cells with a polynucleotide comprising an mRNA encoding an OX40L polypeptide. The y-axis in FIGS. 3F and 3G shows the amount of protein as nanograms (ng) per well.

Figure 28A:
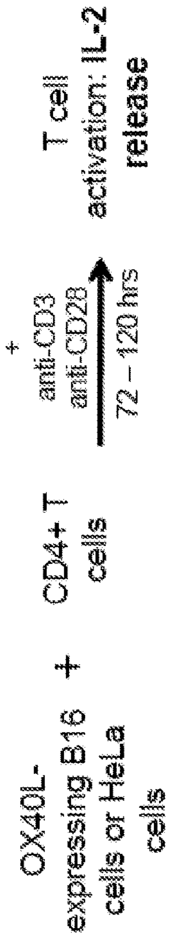
Figure 28B:
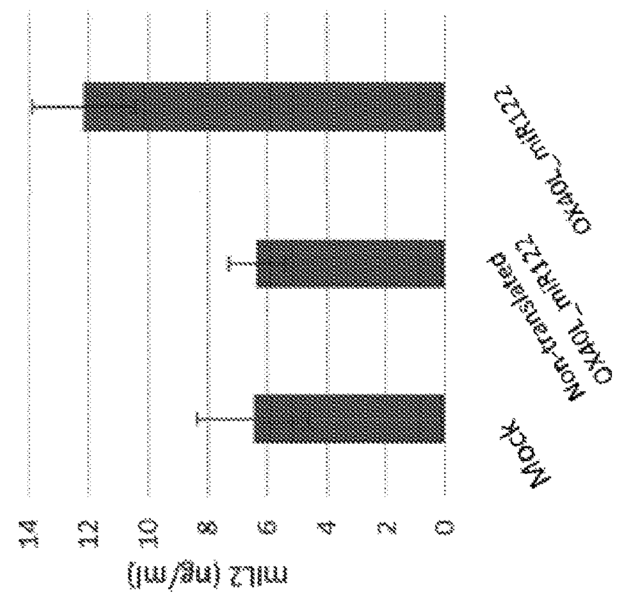
Figure 28C:
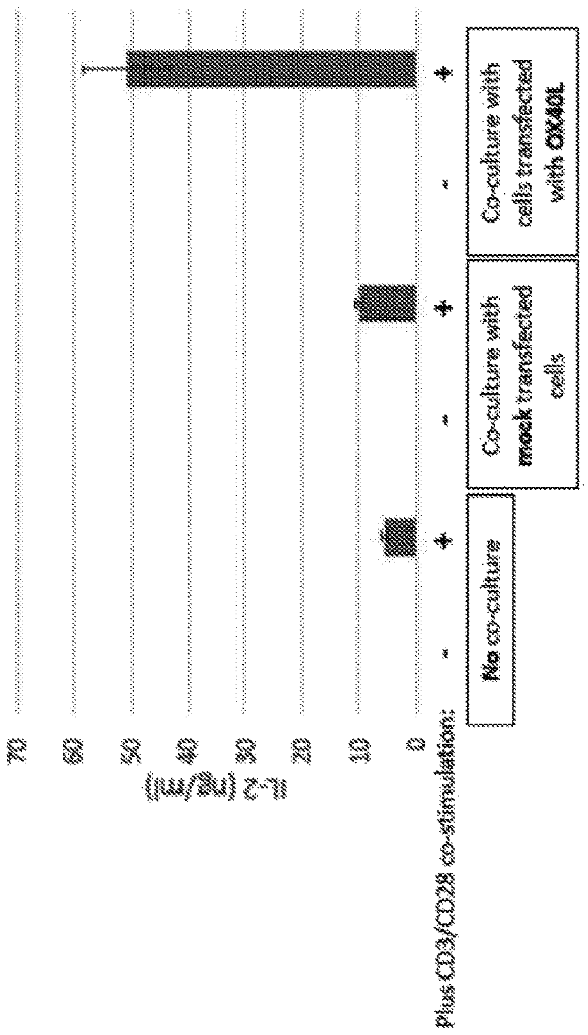
Figure 28D:
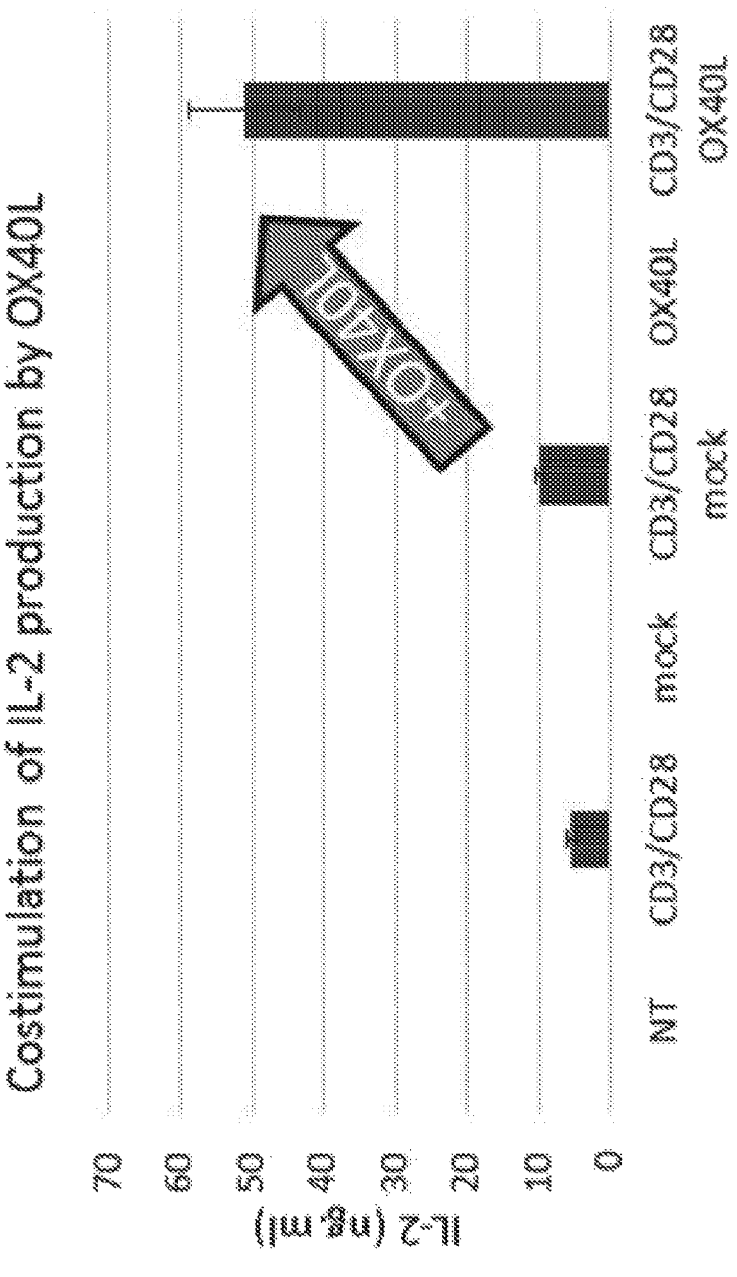
Figure 28E:
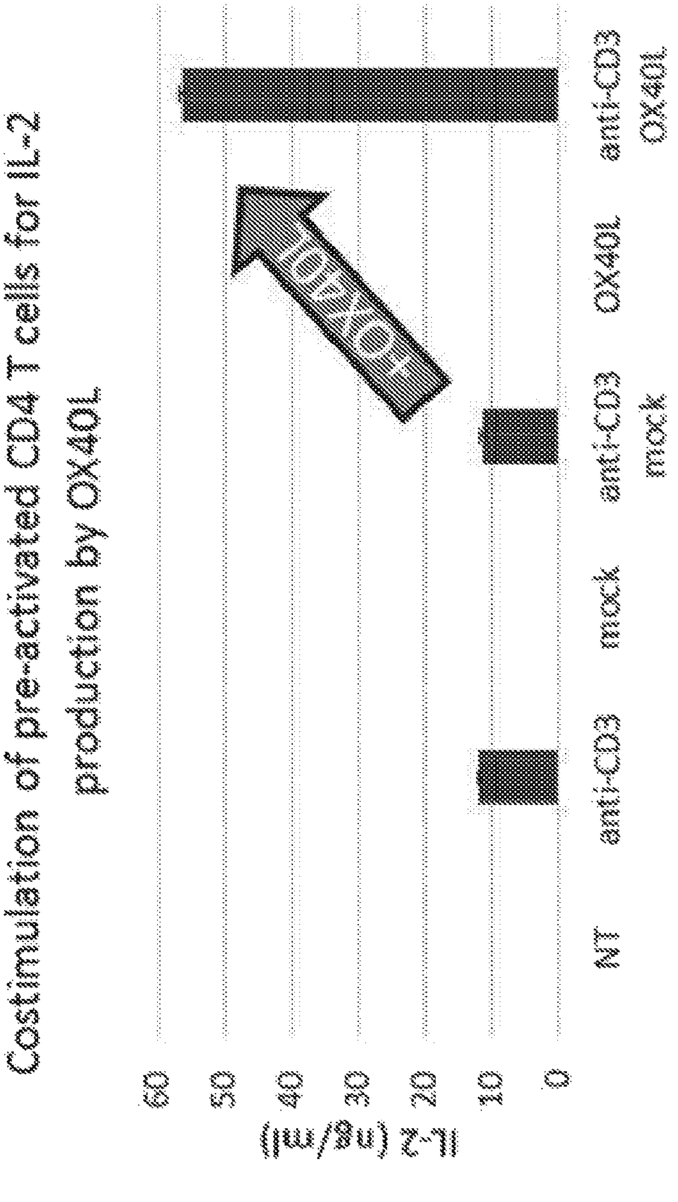

FIGS. 28A to 28E show the costimulatory biological activity of OX40L expressed on the surface of cells treated with OX40L mRNA. FIG. 28A shows a schematic drawing of the T-cell activation assay. OX40L-expressing B16F10 cells or HeLa cells were co-cultured with $CD4^+$ T-cells and anti-mouse CD3 antibody (B16F10 cells) or Dynabeads human T-activator (HeLa cells). IL-2 production was measured using ELISA as a correlate of T-cell activation. FIG. 28B shows results of the T-cell activation assay as measured by mouse IL-2. FIG. 28C shows results of the T-cell activation assay as measured by human IL-2. The y-axis shows mIL-2 expression in ng/ml. FIG. 28D shows the data from FIG. 28C with schematic diagram showing the addition of OX40L expressing cells to the naïve T-cell activation assay. FIG. 28E shows a T-cell activation assay using pre-stimulated T-cells cultured in the presence or absence of OX40L expressing HeLa cells and in the presence or absence of anti-human CD3 antibody.

Figure 29:
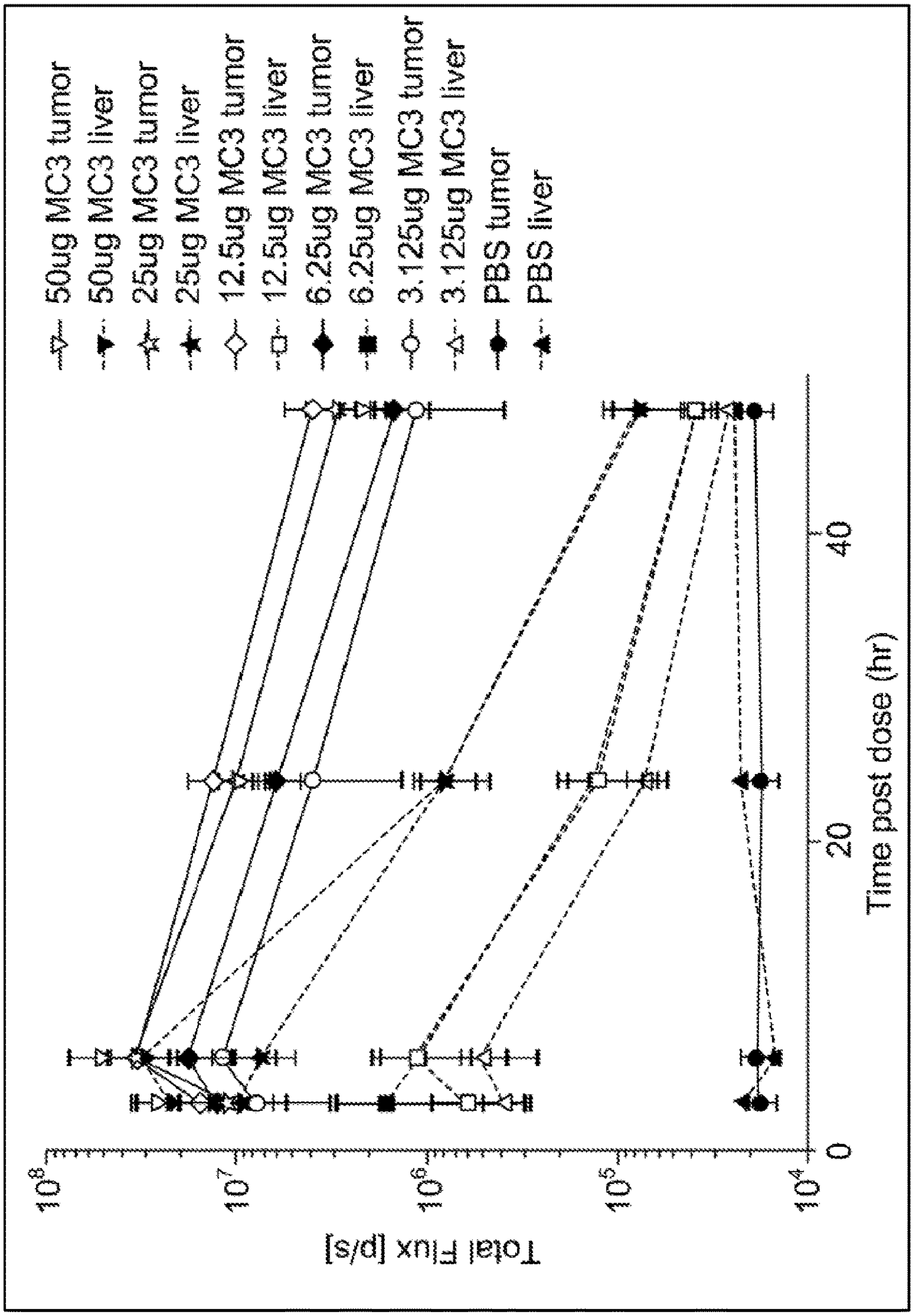

FIG. 29 shows luciferase flux levels in tumor tissue compared to liver tissue in animals treated with a polynucleotide comprising an mRNA encoding a luciferase polypeptide. Representative symbols are as follows. The open inverted triangle, open star, open diamond, shaded diamond, and open circle show the luciferase flux in tumor tissue after administration of 50 μg, 25 μg, 12.5 μg, 6.25 μg, and 3.125 μg of mOX40L_miR122 mRNA (respectively). The shaded inverted triangle, shaded star, open square, shaded square, and open triangle show the luciferase flux in liver tissue after administration of 50 μg, 25 μg, 12.5 μg, 6.25 μg, and 3.125 μg of mOX40L_miR122 mRNA (respectively). The shaded circle and shaded triangle show luciferase flux in tumor tissue (shaded circle) and liver tissue (shaded triangle) after administration of PBS control.

Figure 30:
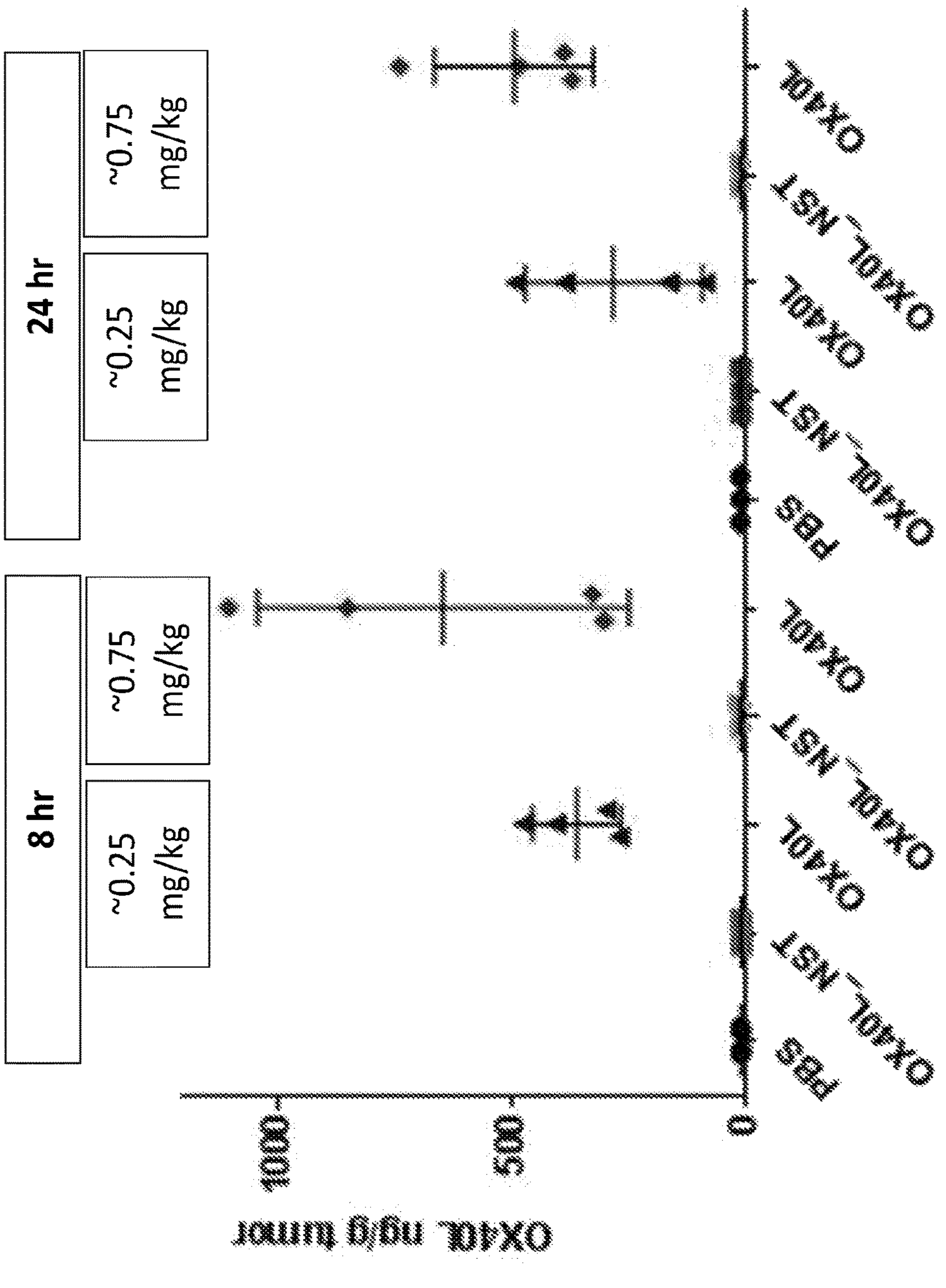

FIG. 30 shows the amount of OX40L polypeptide present in melanoma tumor tissue in animals treated with a polynucleotide comprising an mRNA encoding an OX40L polypeptide. The left panel shows 8 hours after treatment, and the right panel shows 24 hours after treatment.

Figure 31B:
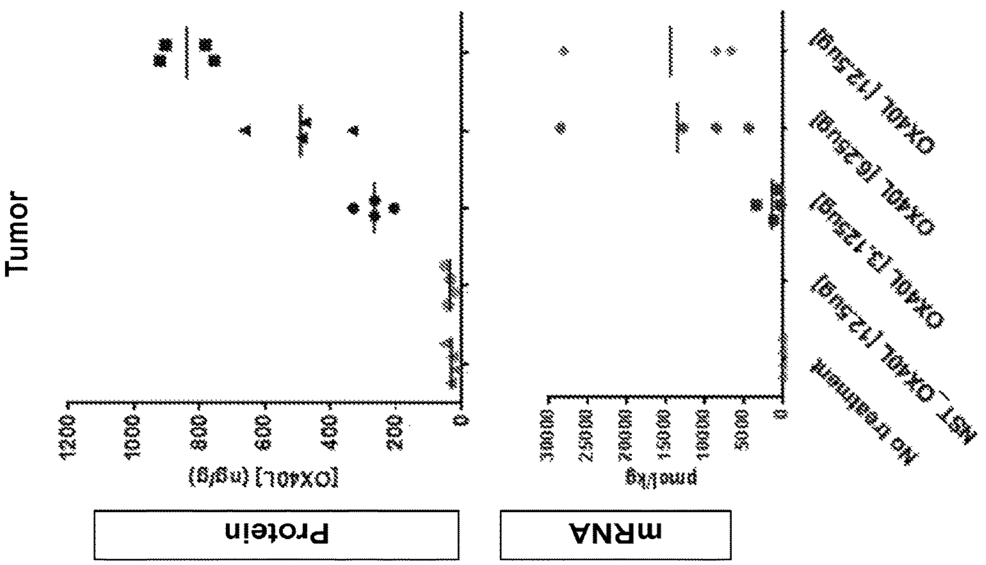
Figure 31A:
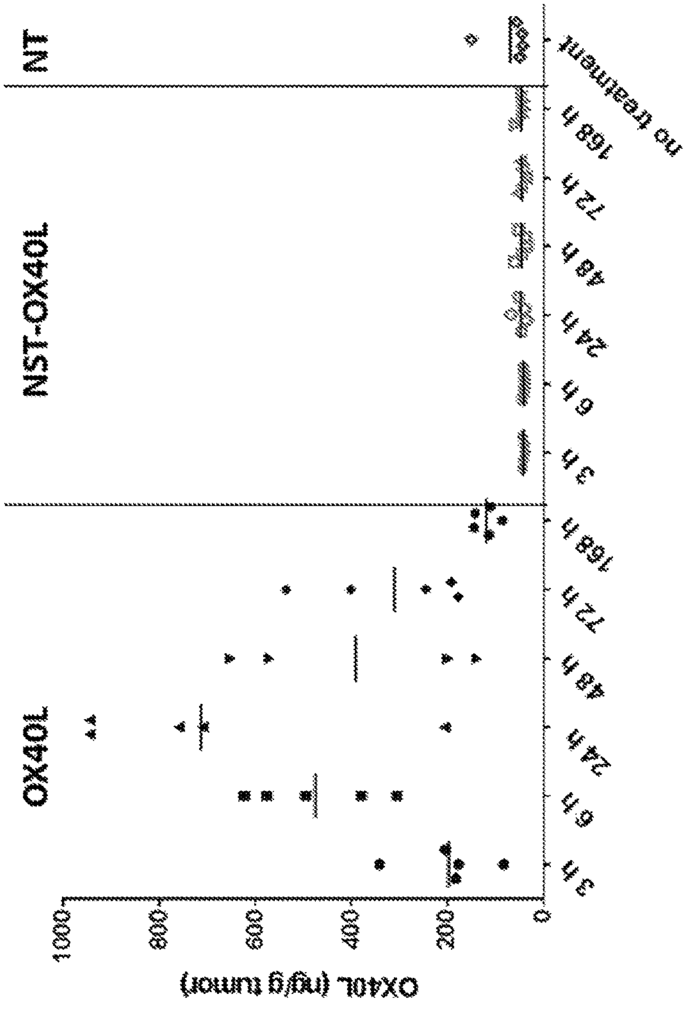

FIG. 31A shows the amount of OX40L polypeptide present in colon adenocarcinoma tumor tissue in animals treated with a polynucleotide comprising an mRNA encoding an OX40L polypeptide, a polynucleotide comprising an mRNA encoding a NST-OX40L (non translatable OX40L mRNA), or no treatment. The OX40L expression was measured at 3 hours, 6 hours, 24 hours, 48 hours, 72 hours, and 168 hours.

FIG. 31B shows the amount of OX40L polypeptide (upper) and mRNA (lower) present in tumor tissue following administration of increasing doses of a polynucleotide comprising an mRNA encoding an OX40L polypeptide.

Figure 31C:
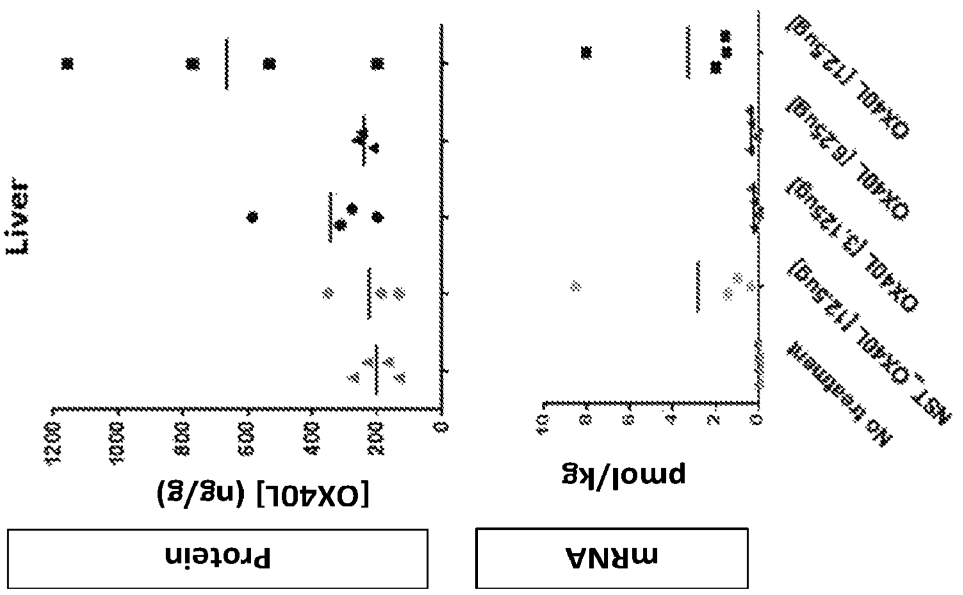

FIG. 31C shows the amount of OX40L polypeptide (upper) and mRNA (lower) present in liver tissue following administration of the same polynucleotide.

Figure 31D:
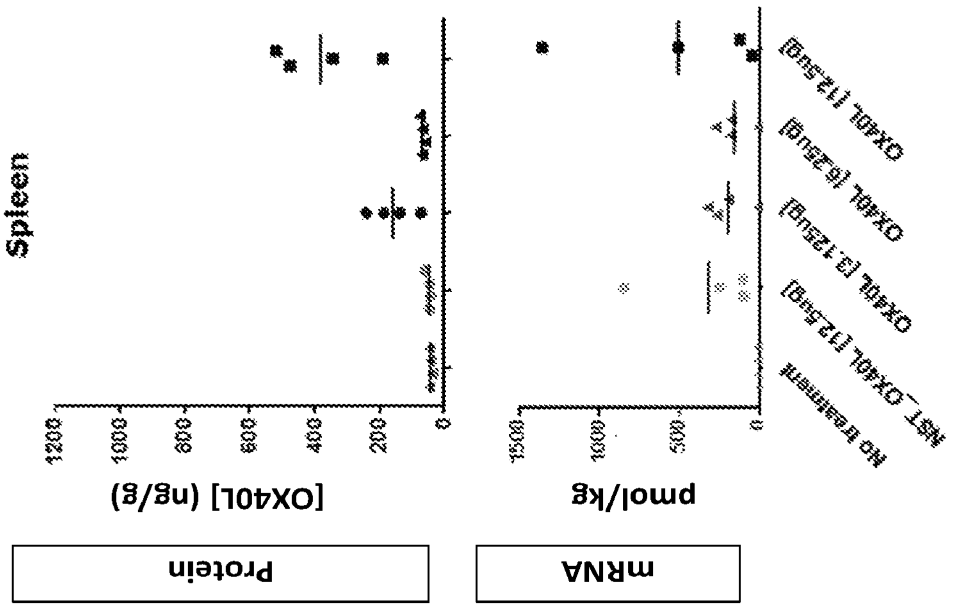

FIG. 31D shows the amount of OX40L polypeptide (upper) and mRNA (lower) present in spleen tissue following administration of the same polynucleotide.

Figure 32B:
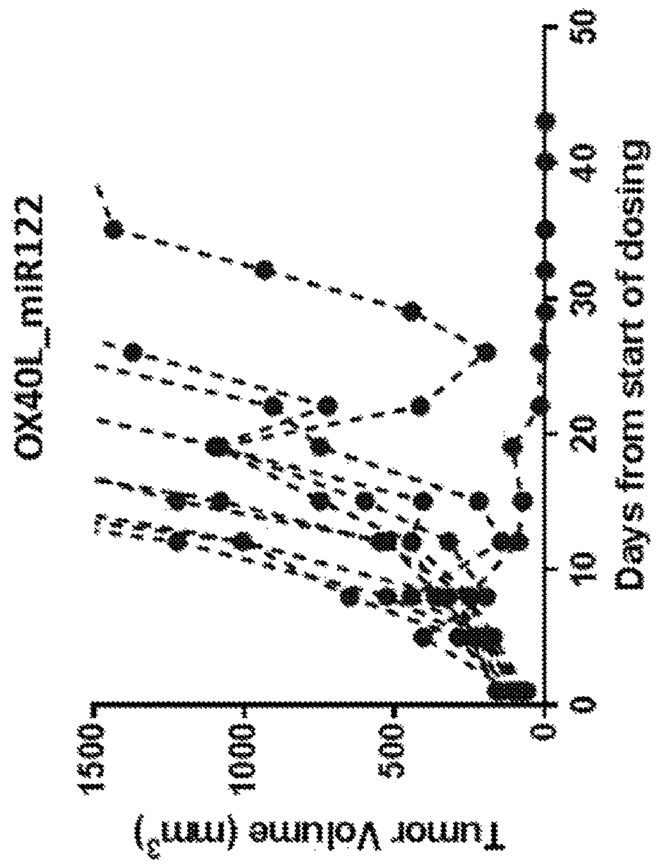
Figure 32A:
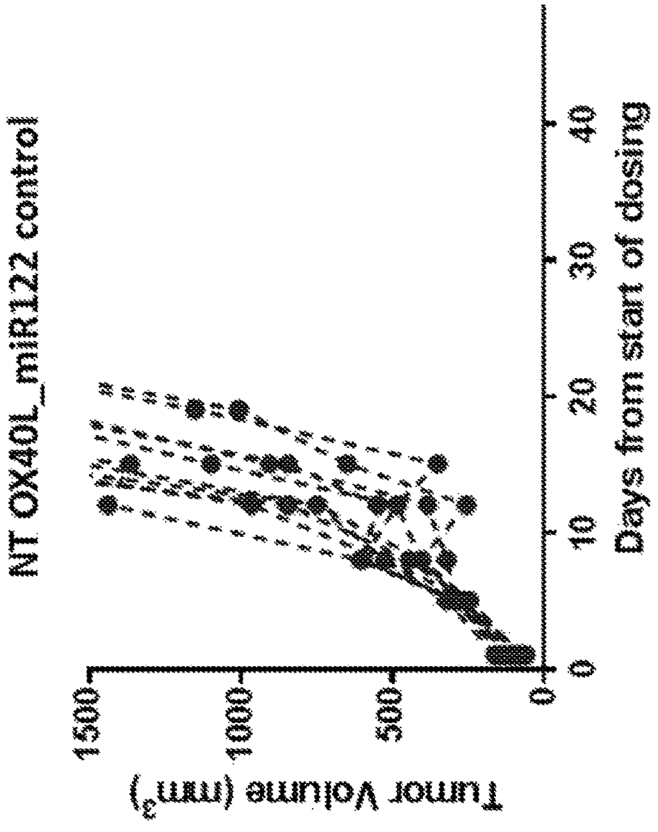
Figure 32C:
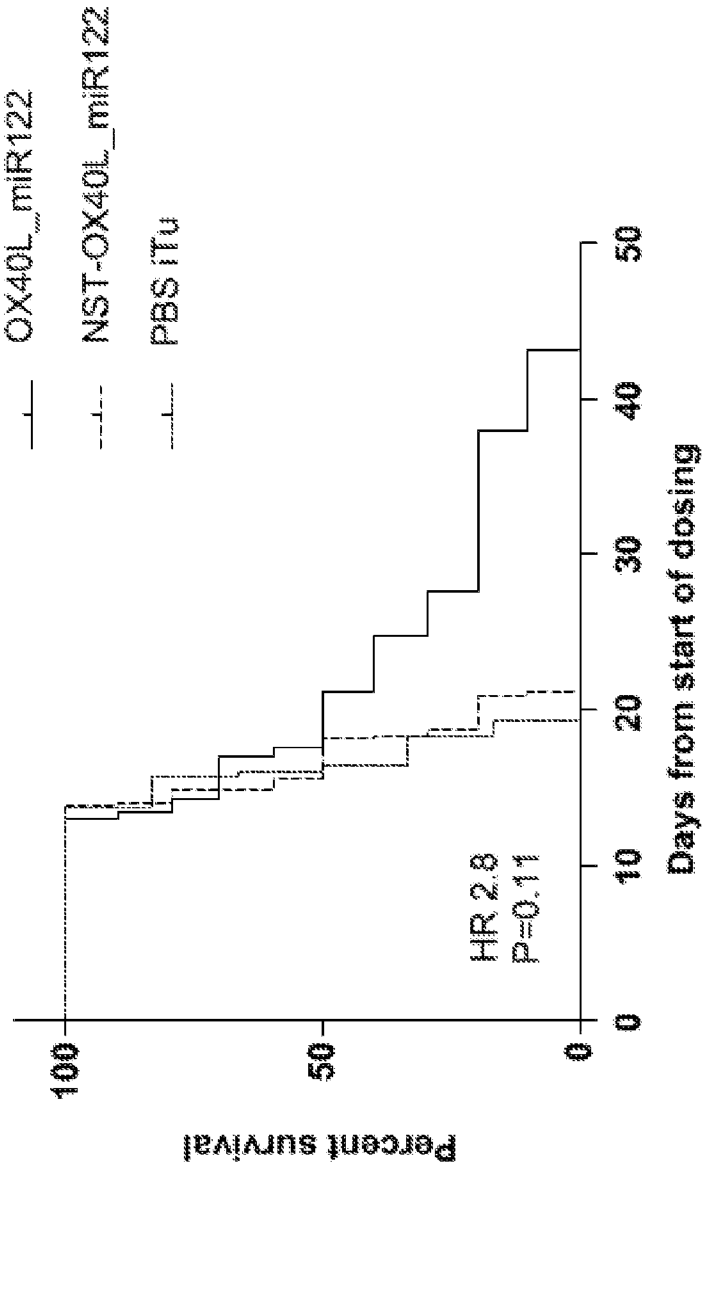

FIGS. 32A to 32C show the in vivo efficacy (as measured at Day 42) of administering a polynucleotide comprising an mRNA encoding an OX40L polypeptide in a colon adenocarcinoma model. FIG. 32A shows tumor growth for animals treated with a control mRNA (NT OX40L_miR122 control). FIG. 32B shows tumor growth for animals treated with a polynucleotide comprising an mRNA encoding an OX40L polypeptide (OX40L_miR122). FIG. 32C shows a Kaplan-Meier survival curve for all treatment groups. (OX40L_miR122, NST_OX40L_miR122, and PBS).

Figure 33A:
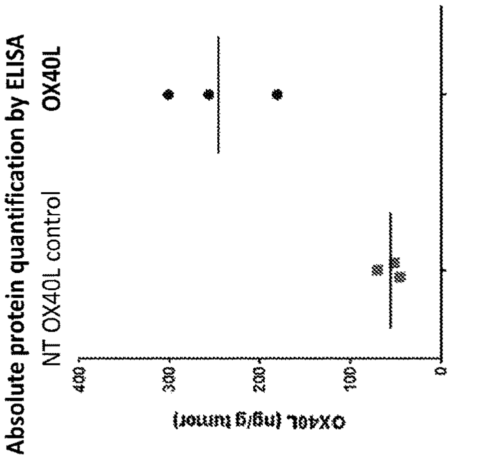
Figure 33B:
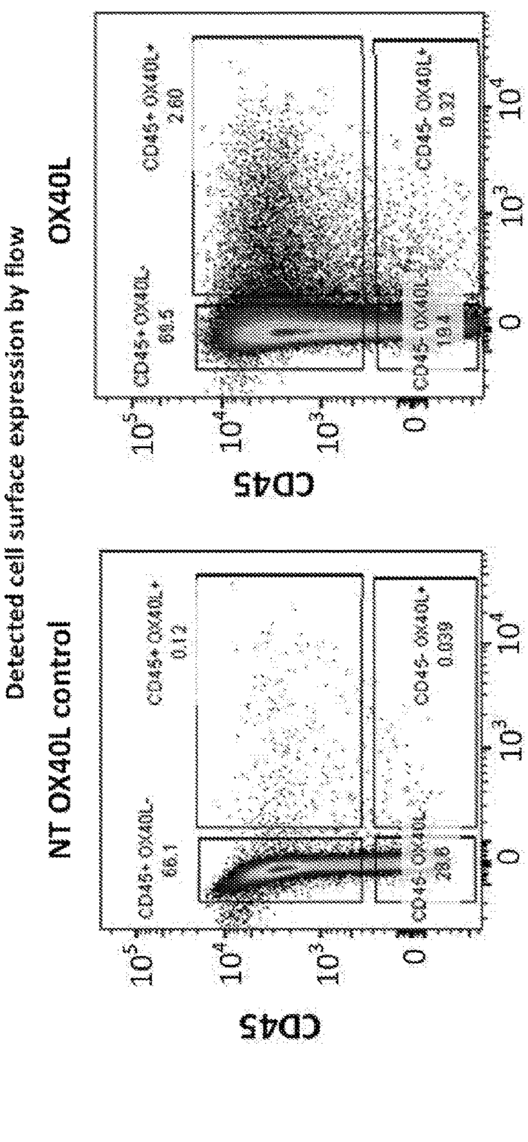
Figure 33C:
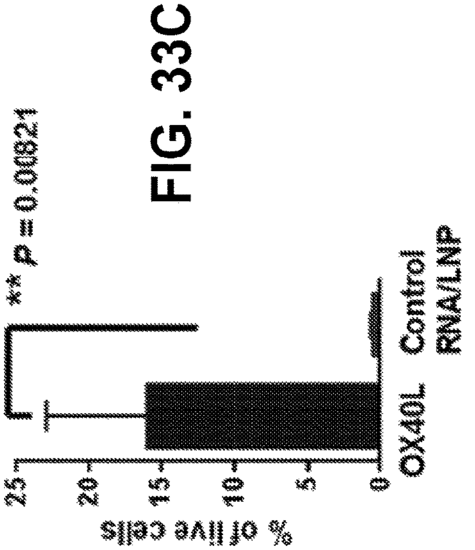

FIGS. 33A to 33C show OX40L expression in A20 B-cell lymphoma tumors in animals treated with a polynucleotide comprising an mRNA encoding an OX40L polypeptide. FIG. 33A shows OX40L expression quantitated in nanograms per gram of tumor tissue, as measured by ELISA. FIG. 33B shows OX40L expression on the cell surface of tumor cells, as measured by flow cytometry. FIG. 33C shows OX40L expression on the cell surface of tumor cells as measured by flow cytometry.

Figure 34B:
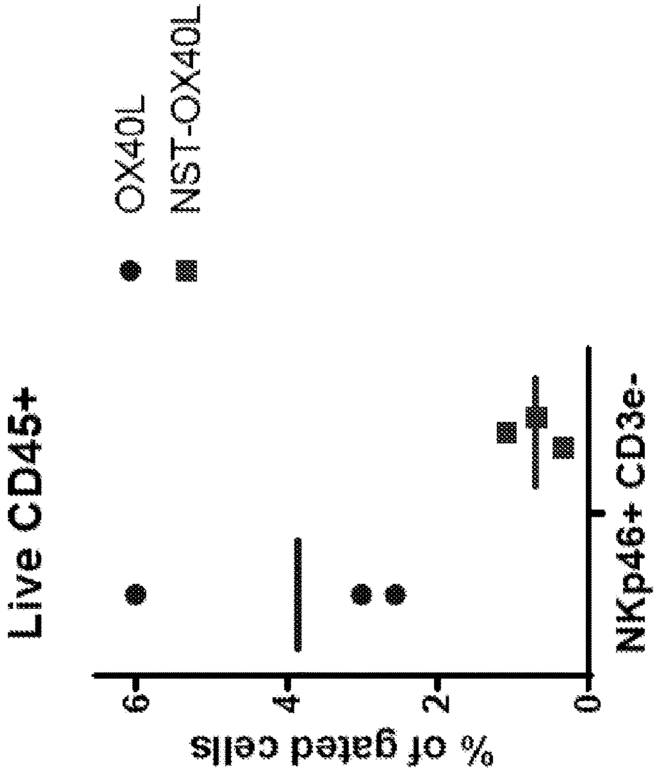
Figure 34A:
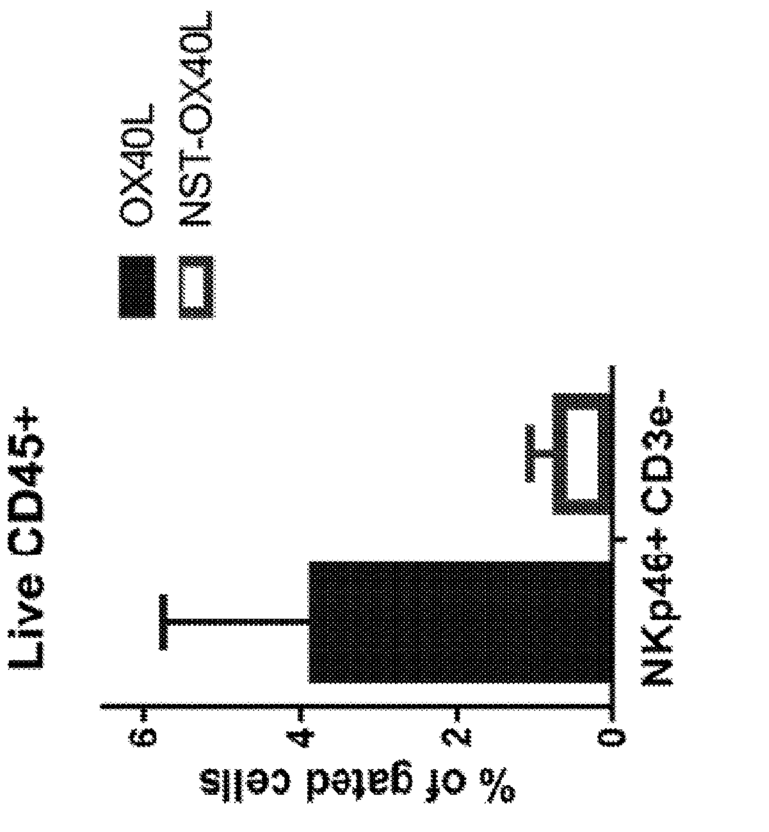

FIGS. 34A and 34B show Natural Killer (NK) cell infiltration into the tumor microenvironment in animals treated with a polynucleotide comprising an mRNA encoding an OX40L polypeptide. FIG. 34A shows the average percentage of live NK cells present in the tumor microenvironment. The left bar shows the percentage of the NK cells increased after administration of mOX40L_mRNA. The right bar shows the percentage of the NK cells increased after administration of NST mOX40L_mRNA. FIG. 34B shows individual animal data from the same study.

Figure 35B:
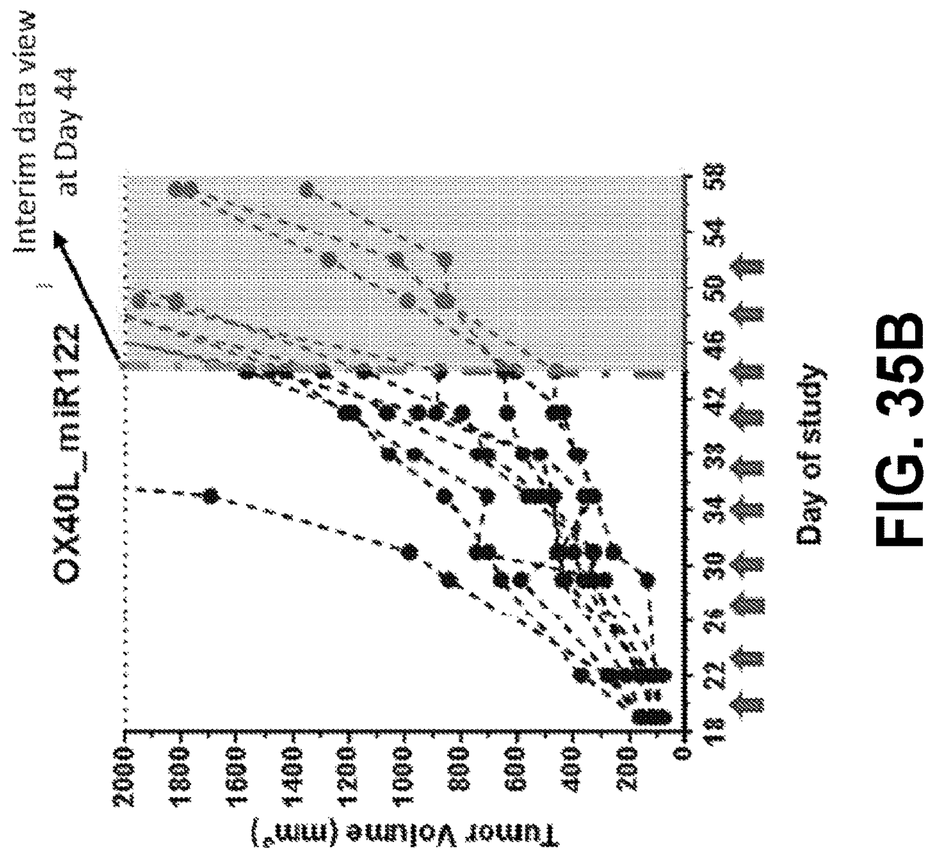
Figure 35A:
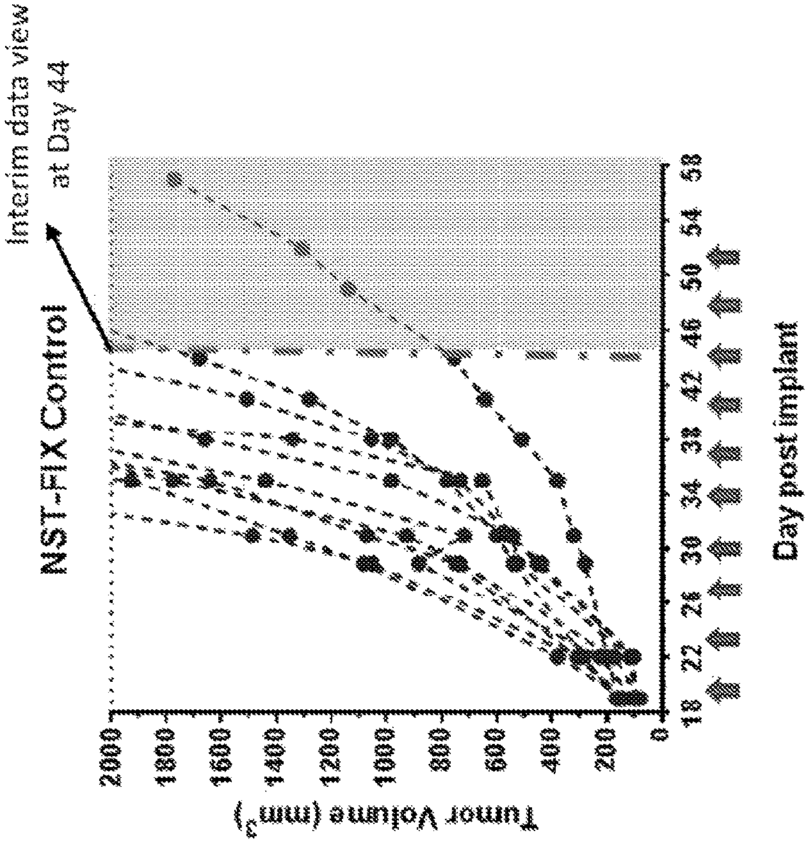
Figure 35C:
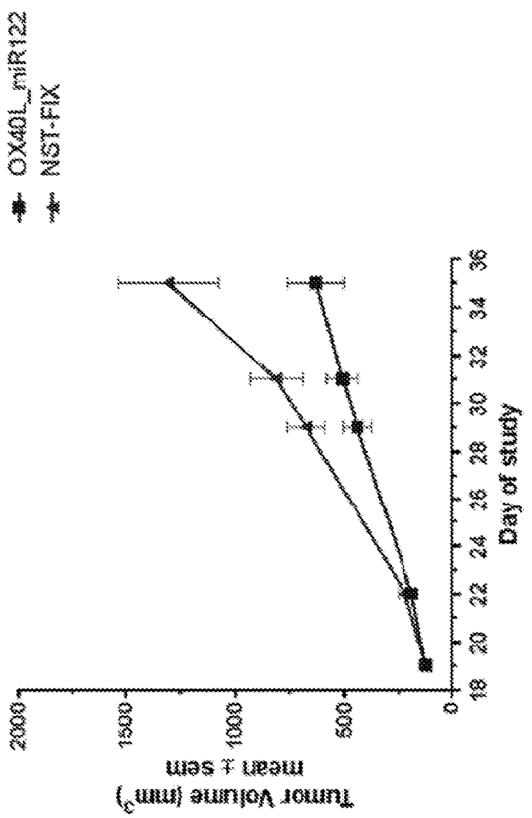
Figure 35D:
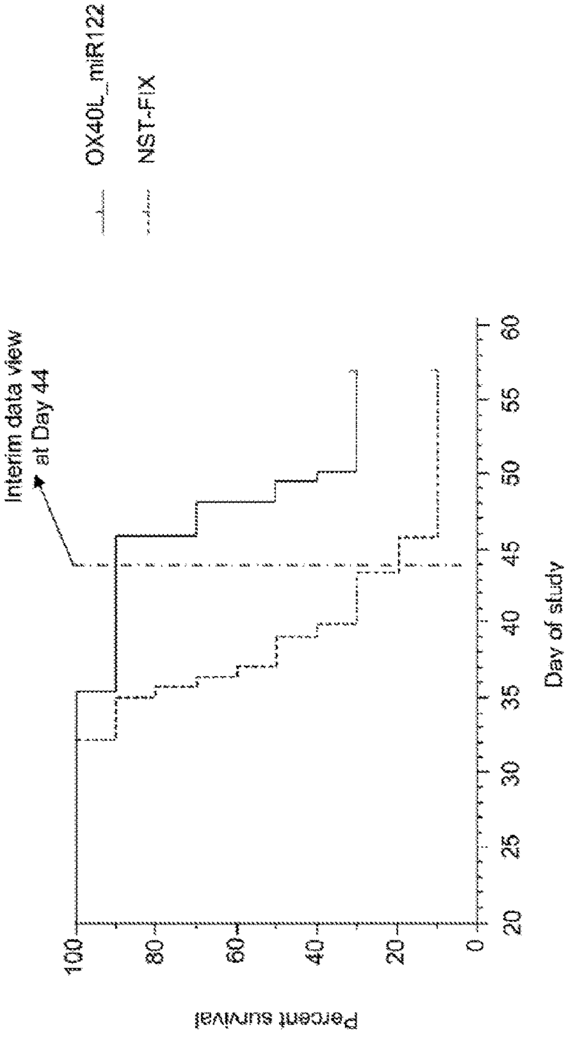

FIGS. 35A to 35D show in vivo efficacy of administering a polynucleotide comprising an mRNA encoding an OX40L polypeptide in a B-cell lymphoma tumor model. FIG. 35A shows tumor growth in animals treated with a control mRNA (NST-FIX control). FIG. 35B shows tumor growth in animals treated with a polynucleotide comprising an mRNA encoding an OX40L polypeptide (OX40L_miR122). FIG. 35C shows the average tumor volume for each group, as measured at Day 35. FIG. 35D shows Kaplan-Meier survival curves for each treatment group. The squares show the tumor volume after administration of OX40L_miR122. The triangles show the tumor volume after administration of NST-FIX (control).

Figures 36A, 36B:
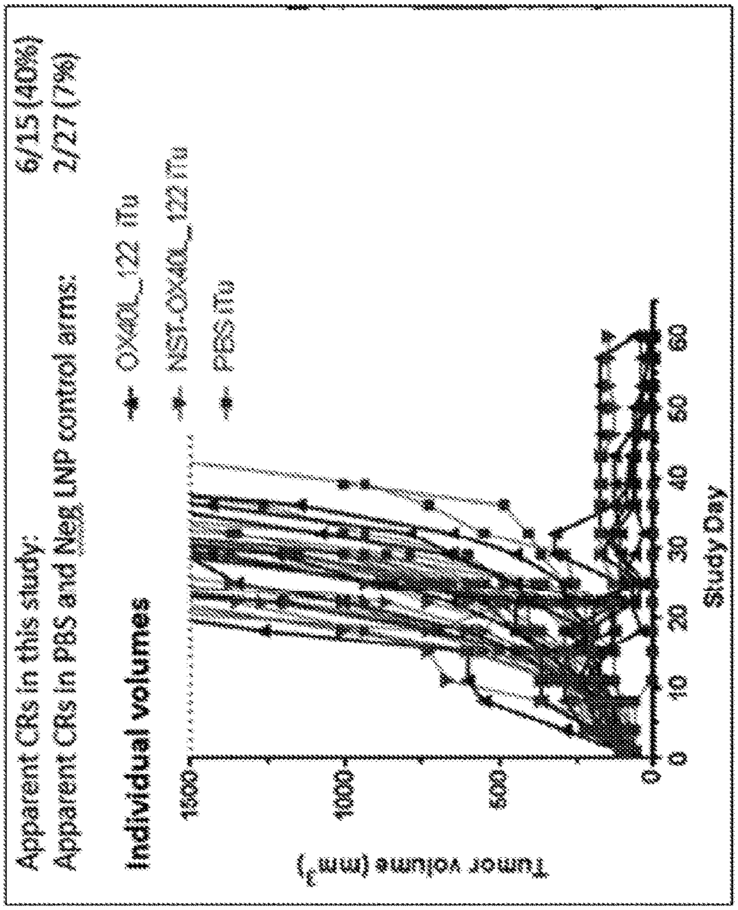

FIGS. 36A and 36B. shows in vivo immune response after administering a polynucleotide comprising an mRNA encoding an OX40L polypeptide. Mice were inoculated with MC-38 colon adenocarcinoma cells. Once the tumors reached palpable size, mice were administered a polynucleotide comprising an mRNA encoding an OX40L polypeptide (OX40L_122; triangle), a control nonsense mRNA (NST-OX40L_122; inverted triangle), or PBS (square). Sixty days following administration of the polypeptide, mice were re-challenged with a second MC-38 tumor cell inoculation. FIG. 36A shows the individual animal tumor during the first period through Day 60. FIG. 36B shows the number of animals presenting with tumor growth 23 days after re-challenge.

Figure 37:
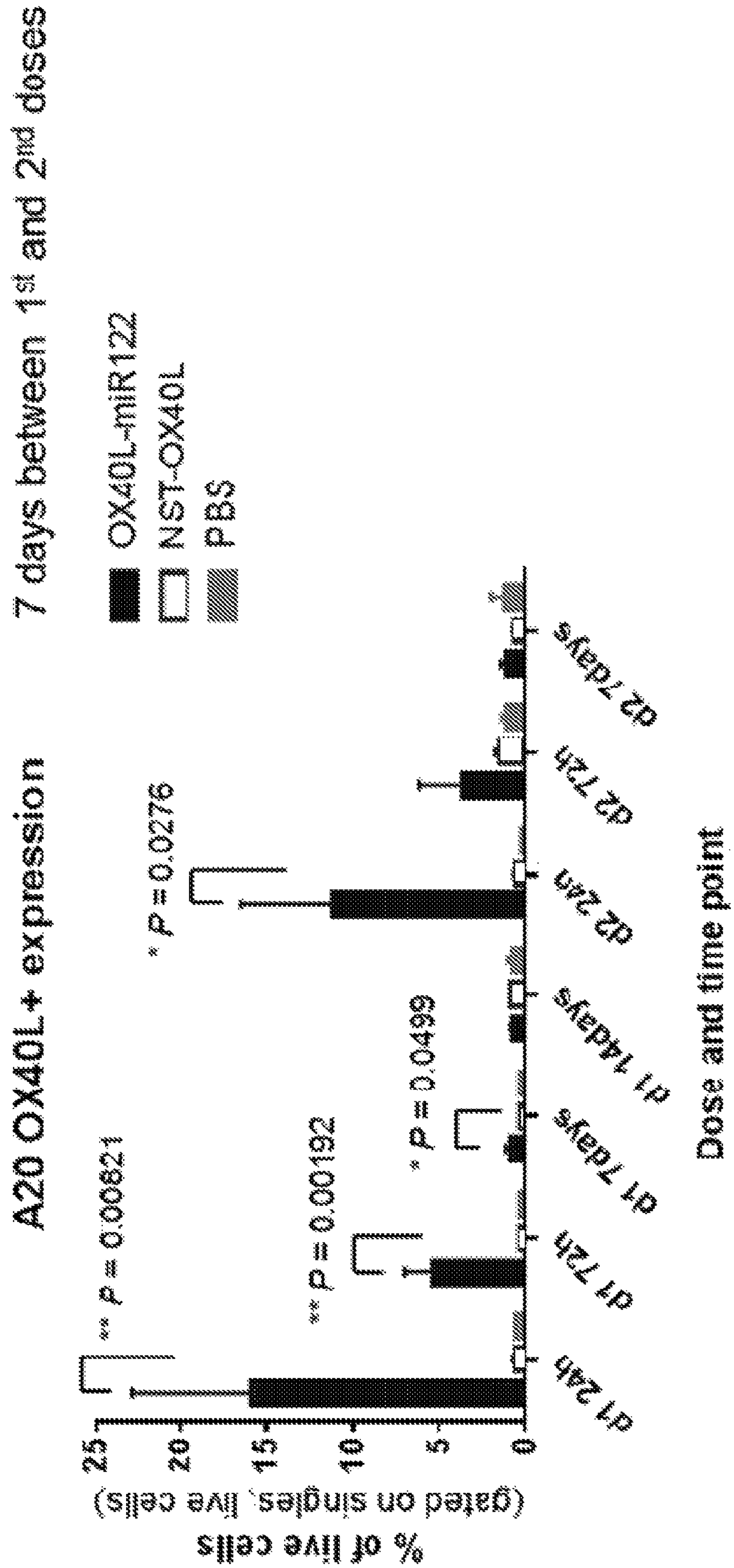

FIG. 37 shows OX40L expression in A20 tumors at various time points after a first and/or second dose of a polynucleotide comprising an mRNA encoding an OX40L polypeptide. Expression is shown at 24 hours, 72 hours, 7 days, and 14 days after administration of a first dose of the polynucleotide and 24 hours, 72 hours, and 7 days after administration of a second dose of the polynucleotide.

Figure 38A:
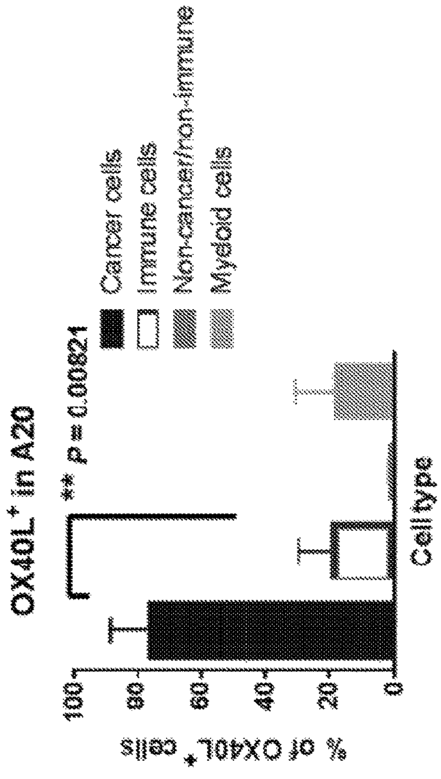
Figure 38B:
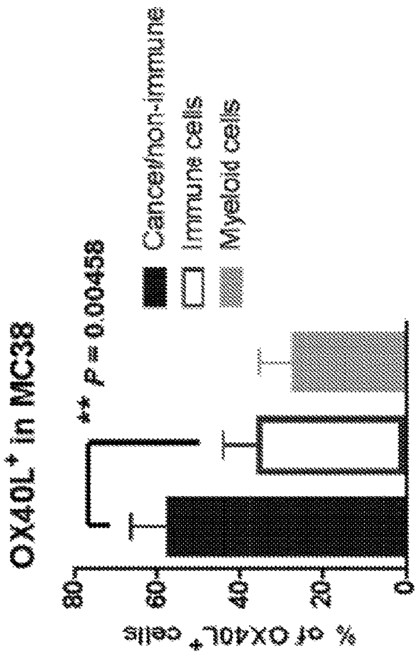
Figure 38C:
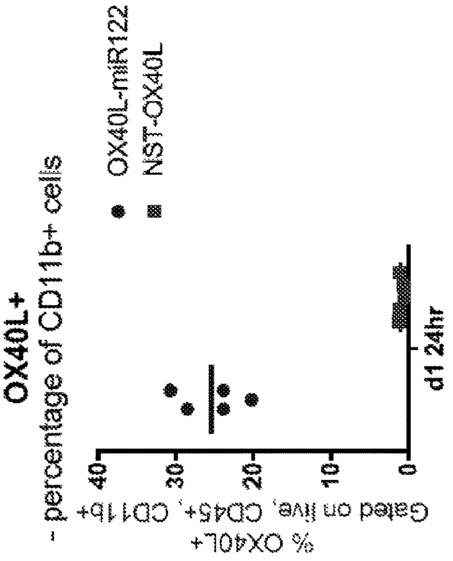

FIGS. 38A to 38C show different cell types present in the tumor microenvironment following administration of a polynucleotide comprising an mRNA encoding an OX40L polypeptide. FIG. 38A shows the percentage of OX40L-expressing cells in A20 tumors that are cancer cells, immune cells, non-cancer/non-immune cells, and cells of myeloid lineage. FIG. 38B shows the percentage of OX40L-expressing cells in MC38 tumors that are tumor cells, immune cells, and cells of myeloid lineage. FIG. 38C shows the percentage of myeloid cells in the tumor microenvironment that are OX40L-expressing cells following administration of the polynucleotide.

Figure 39C:
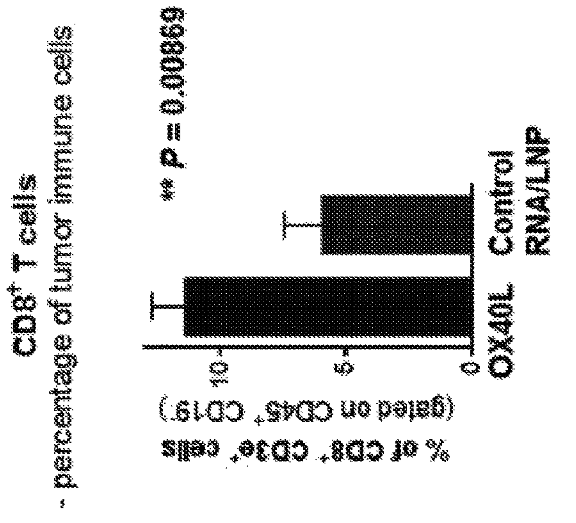
Figure 39B:
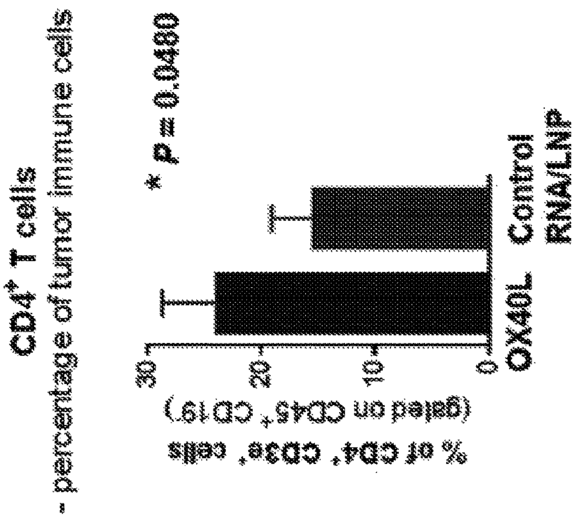
Figure 39A:
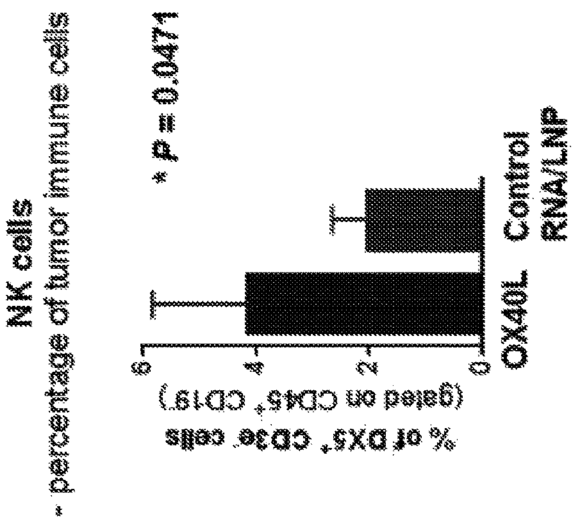

FIGS. 39A to 39D show the different types of immune cells that infiltrate the tumor microenvironment in A20 tumors following administration of a polynucleotide comprising an mRNA encoding an OX40L polypeptide. FIG. 39A shows the percentage of NK cells in the tumor infiltrate 24 hours after treatment, as detected by the DX5 marker. FIG. 39B shows the percentage of $CD4^+$ T-cells in the tumor infiltrate 14 days after treatment, as detected by the CD4 marker. FIG. 39C shows the percentage of $CD8^+$ T-cells in the tumor infiltrate 14 days after treatment, as detected by the CD8 marker.

Figure 39D:
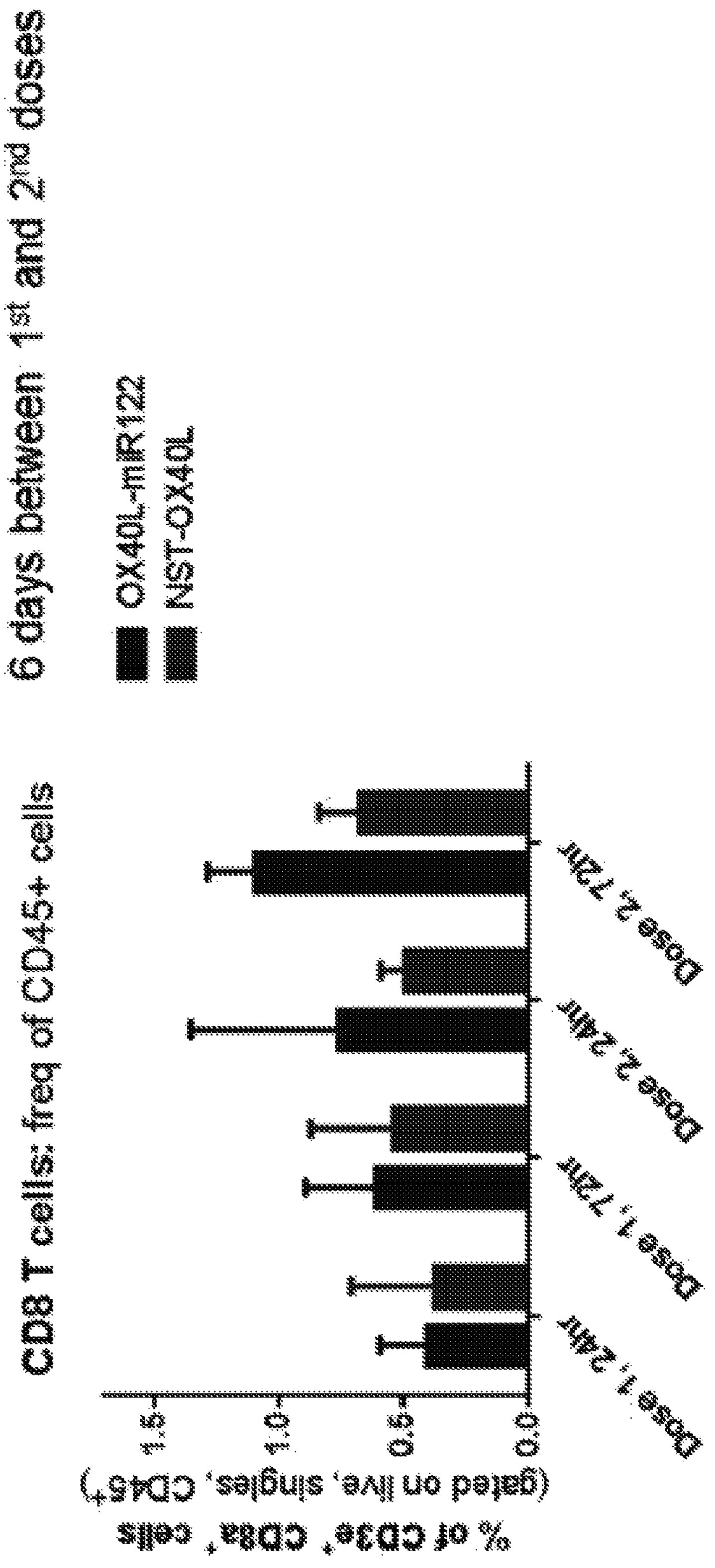

FIG. 39D shows the percentage of $CD8^+$ T-cells in the tumor infiltrate of MC38 tumors 24 and 72 hours after a first and second dose of a polynucleotide comprising an mRNA encoding an OX40L polypeptide.

Figure 40A:
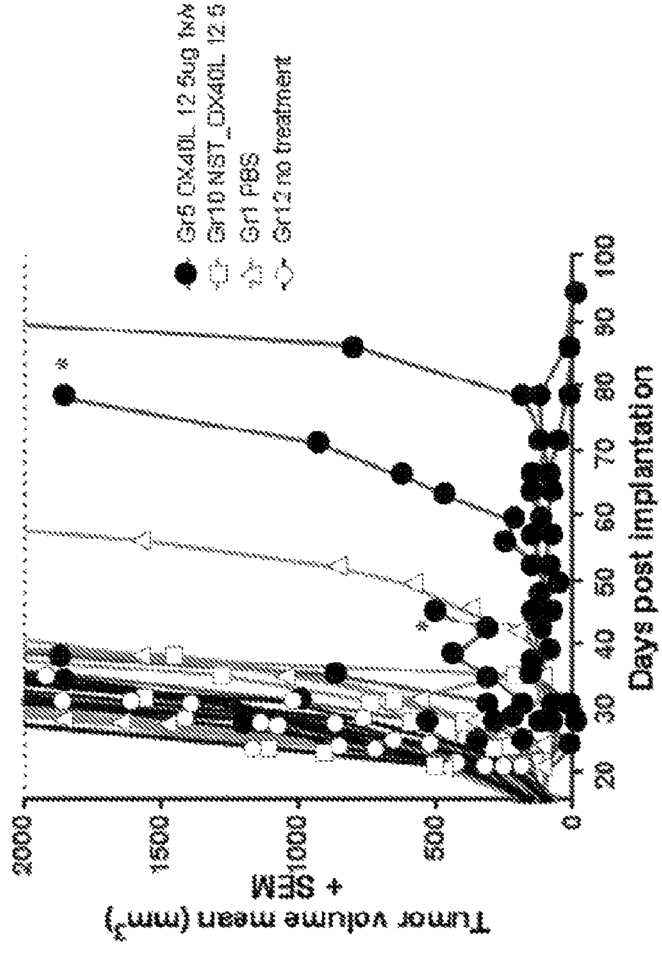
Figure 40B:
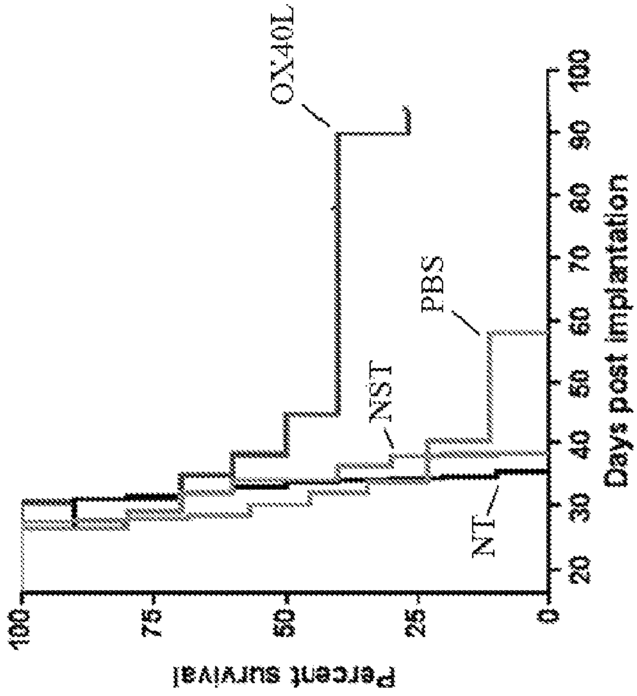

FIGS. 40A and 40B show in vivo efficacy of administration of a polynucleotide comprising an mRNA encoding an OX40L polypeptide in A20 tumors. FIG. 40A shows tumor volume (measured in $mm^3$) over time. Treatments are shown as follows: mOX40L_miR122 (filled circles); control mRNA (NST) (open squares); PBS (open triangles); and untreated (open circles). FIG. 40B shows a Kaplan-Meier survival curve for the same animals.

Figure 41A:
Figure 41B:

FIGS. 41A and 41B show expression of OX40L protein in primary human hepatocytes, human liver cancer cells (Hep3B), and human cervical carcinoma cells (HeLa) at 6 hours, 24 hours, and 48 hours post-transfection. FIG. 41A shows expression of human OX40L polypeptide as measured in nanograms per well. FIG. 41B shows expression of mouse OX40L polypeptide as measured in nanograms per well.

Figures 42A, 42B, 42C:
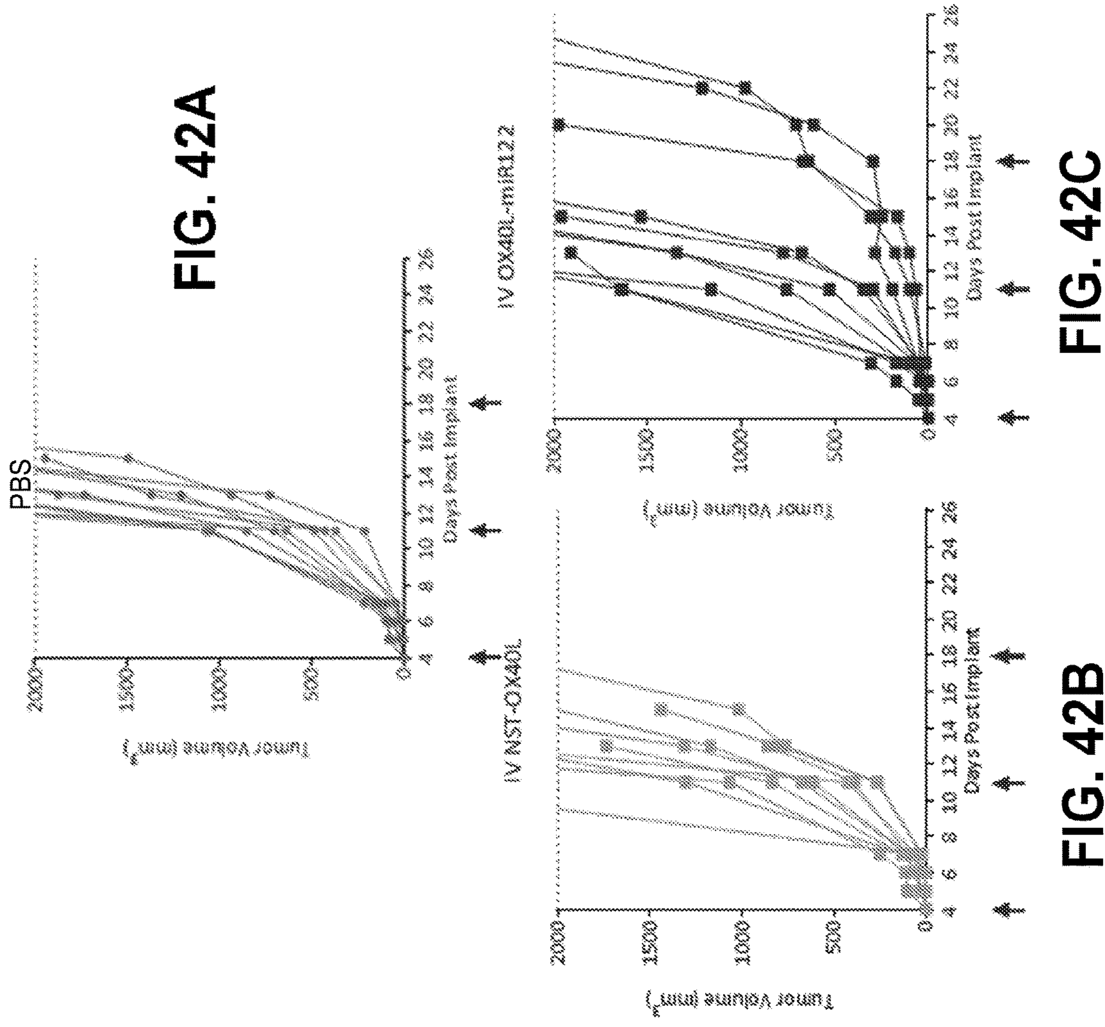

FIGS. 42A to 42C show in vivo anti-tumor efficacy of mOX40L_miR122 delivered intratumorally or intravenously. FIG. 42A shows tumor growth in animals treated intravenously with PBS (arrows mark injection days). FIG. 42B shows tumor growth in animals treated intravenously with control mRNA ("NST-OX40L") (arrows mark injection days). FIG. 42C shows tumor growth in animals treated intravenously with mOX40L_miR122 mRNA ("OX40L-miR122") (arrows mark injection days).

Figure 43:
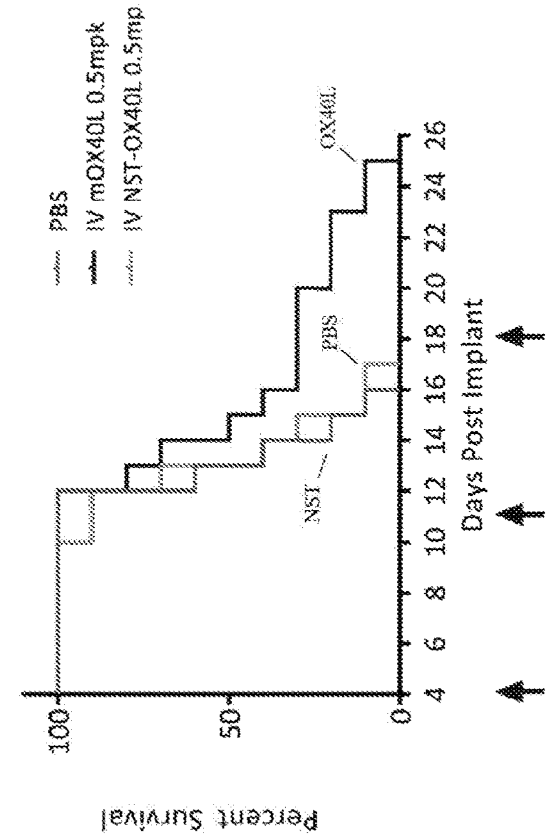

FIG. 43 shows survival curves for animals treated intravenously with PBS, negative control mRNA ("NST-OX40L"), or mOX40L-miR122 mRNA ("OX40L"). Dose days are indicated by arrows.

Figure 44:
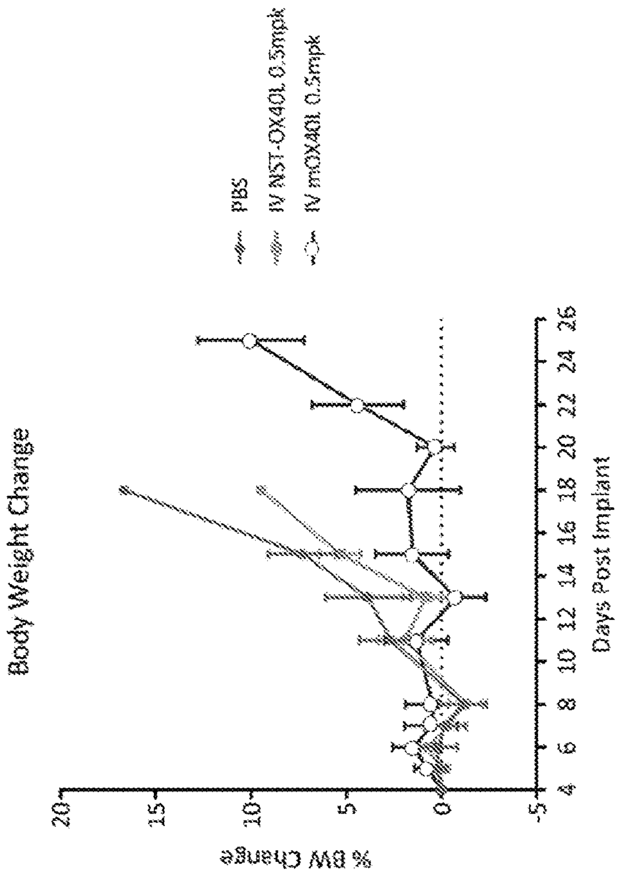

FIG. 44 shows percent change in body weight over time for animals treated intravenously with PBS (filled circles), negative control mRNA (filled squares), and mOX40L-miR122 mRNA (open circles).

FIG. 45 is a table showing increase in protein expression for different sequence optimized IL12 mRNA constructs with respect to wild type mRNA encoding IL12.

Figure 46:
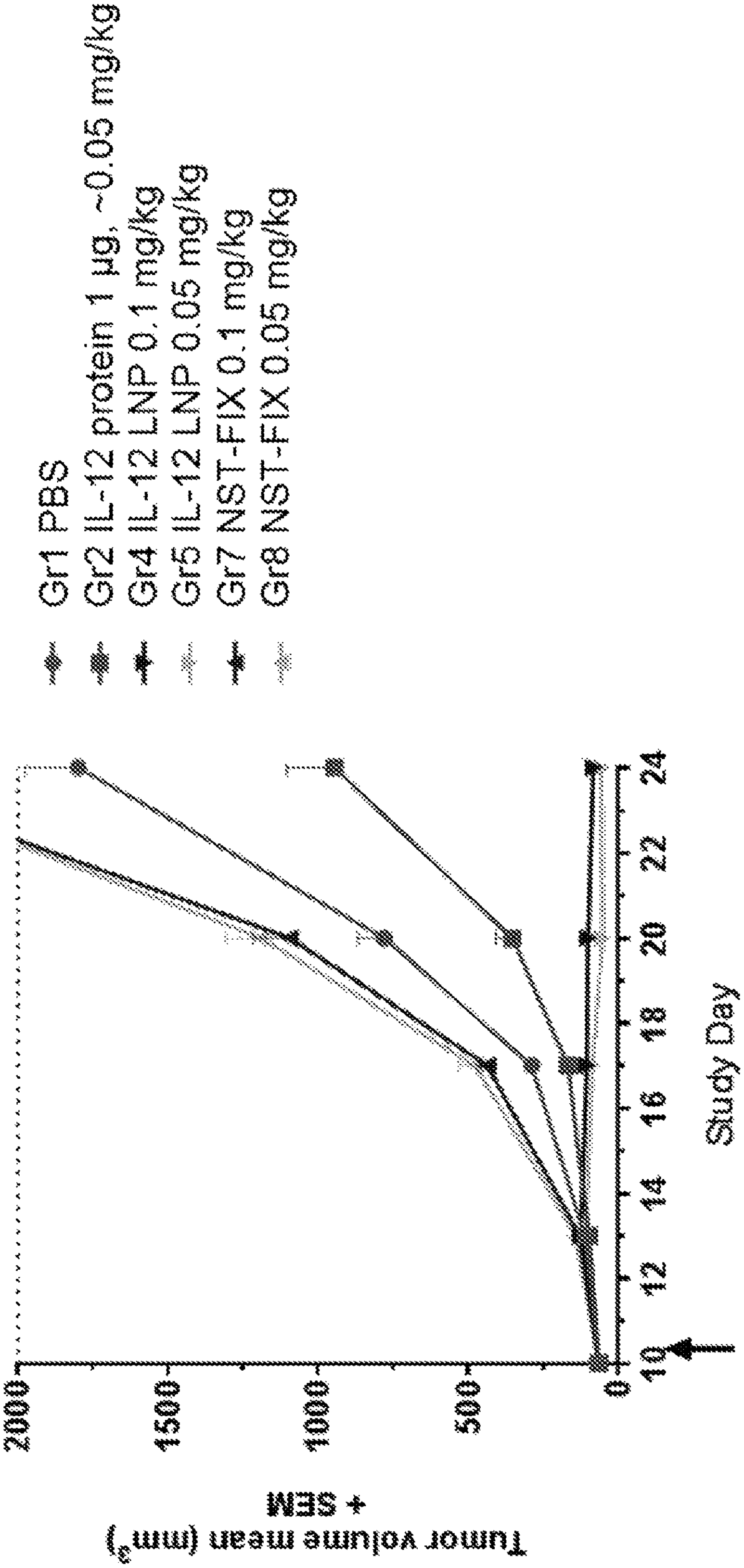

FIG. 46 is a graph depicting the robust efficacy of a single intravenous (IV) dose of IL12 mRNA in lipid nanoparticle (LNP), at doses of 0.1 mg/kg (Group 4) and 0.05 mg/kg (Group 5)(as indicated by lines with the inverted triangles), compared to Groups 1 (PBS), 2 (IL12 protein), 7 and 8 (controls NST-FIX, 0.1 mg/kg and 0.05 mg/kg, respectively).

FIG. 47A is a graph depicting the higher AUC and $C_{max}$ for IL12 plasma levels observed following administration of IL12 mRNA in lipid nanoparticle (LNP) compared to the corresponding IL12 recombinant protein.

FIG. 47B is a graph depicting the higher AUC and $C_{max}$ for IFNγ plasma levels observed following administration of IL12 mRNA administered in lipid nanoparticle (LNP) compared to IL12 recombinant protein.

FIG. 47C is a table depicting the higher AUC levels for IL12 and IFNγ plasma levels observed following treatment with IL12 mRNA administered in lipid nanoparticle (LNP) at 0.1 mpk and 0.05 mpk, compared to treatment with IL12 recombinant protein at approximately 0.05 mpk. The numbers in parentheses indicate the x-fold increase for mRNA over protein.

Figure 48A:
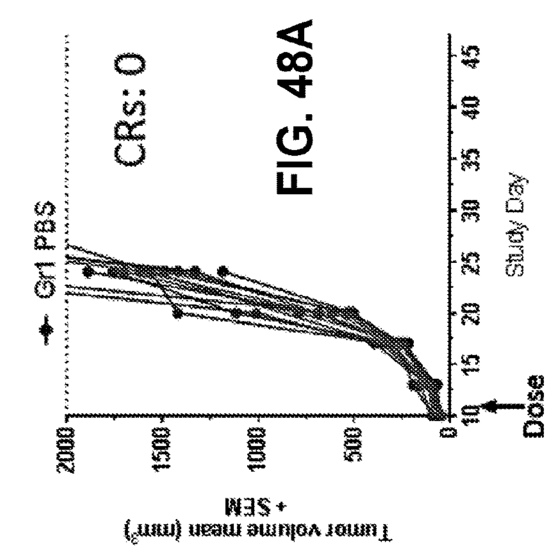
Figure 48B:
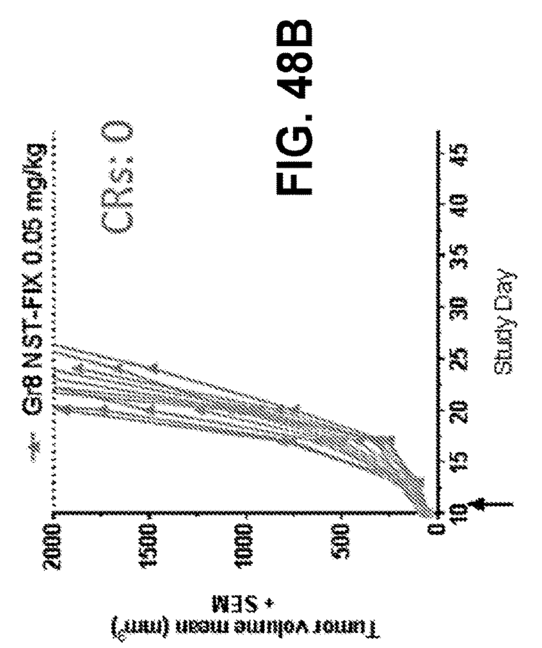
Figure 48C:
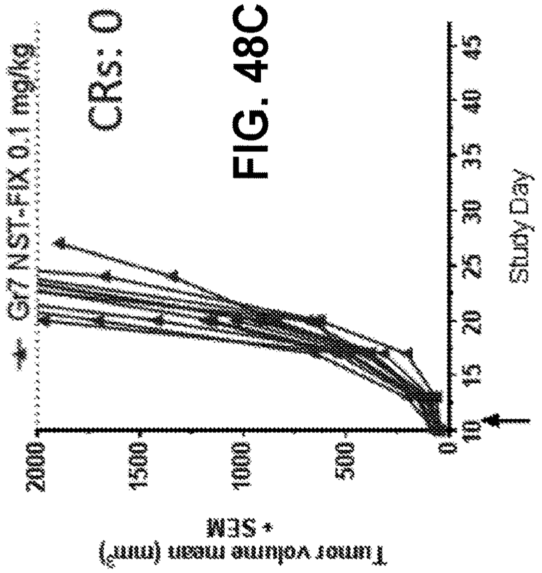
Figure 48D:
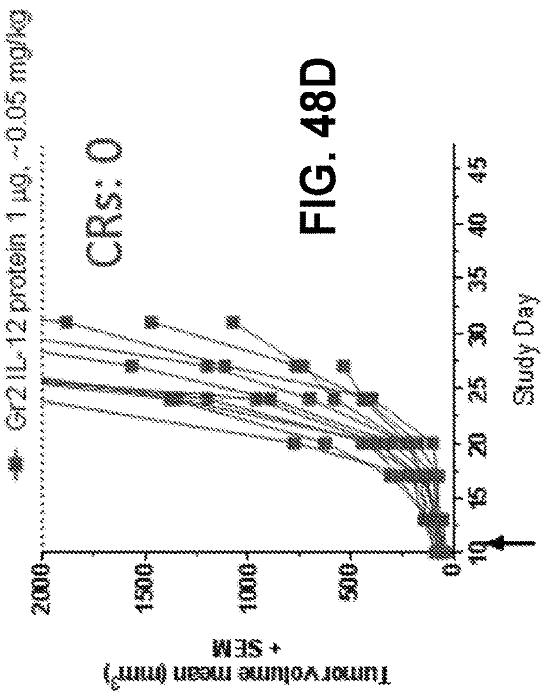
Figure 48F:
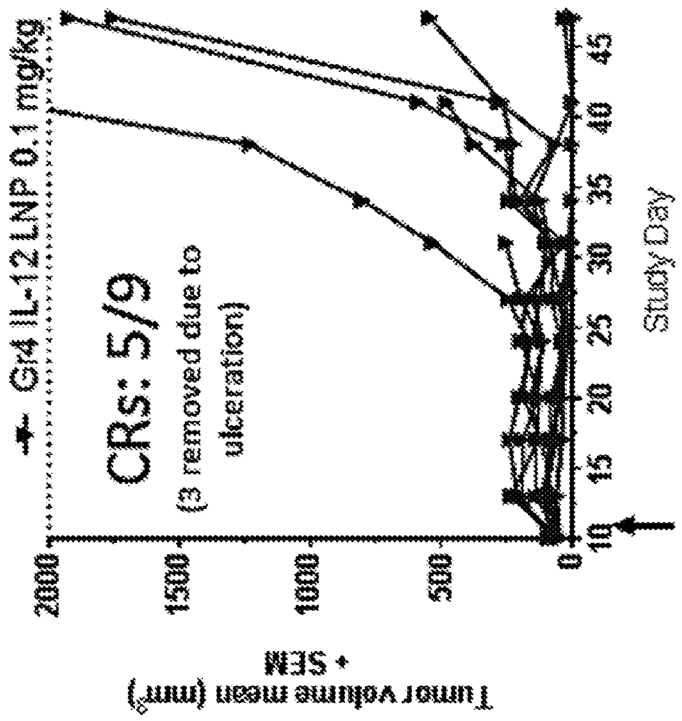
Figure 48E:
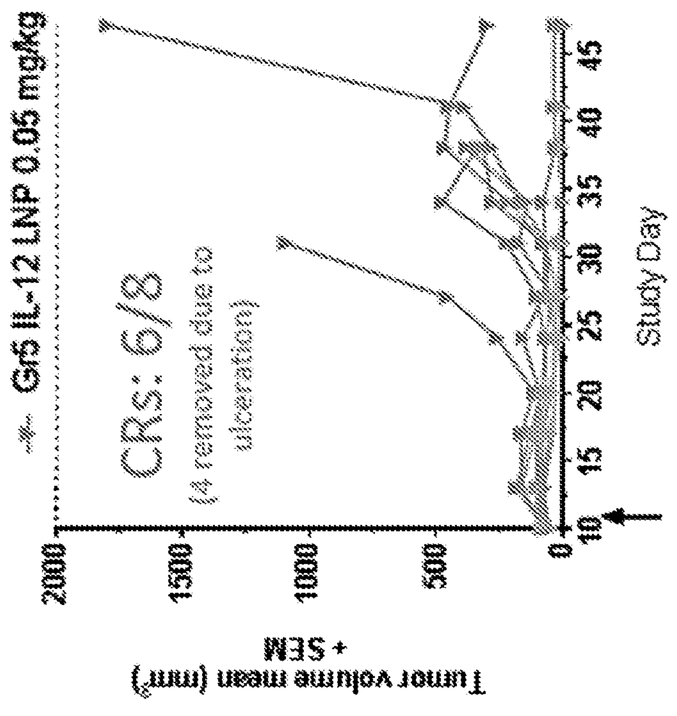

FIGS. 48A to 48F are graphs depicting the mean tumor volume and the number of complete responses (CR) seen following administration of a single intravenous (IV) dose of: IL12 mRNA in lipid nanoparticle (LNP), at doses of 0.1 mg/kg (Group 4) (FIG. 48F) and 0.05 mg/kg (Group 5) (FIG. 48E), PBS (Group 1) (FIG. 48A), IL12 protein (Group 2) (FIG. 48D), controls NST-FIX, 0.1 mg/kg and 0.05 mg/kg (Groups 7 and 8, respectively) (FIG. 48C and FIG. 48B, respectively). Complete responses (CRs) are shown in FIG. 48E and FIG. 48F only. FIG. 48E shows that 6 of 8 CRs were seen in Group 5 (IL12 mRNA in lipid nanoparticle (LNP), at a dose of 0.05 mg/kg). FIG. 48F shows that 5 of 9 CRs were seen in Group 4 (IL12 mRNA in lipid nanoparticle (LNP), at a dose of 0.1 mg/kg). Aside from the IL12 mRNA groups, all other groups did not observe any CRs.

Figures 49, 50:
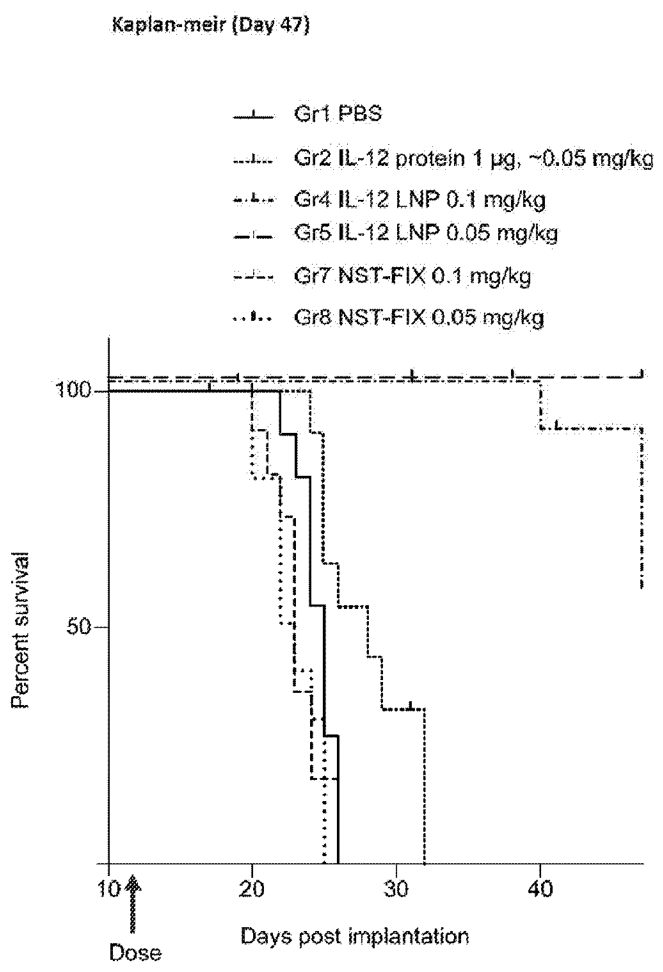

FIG. 49 is a graph depicting the survival benefit at day 47 post tumor-implantation from a single intravenous (IV) dose of IL12 mRNA in lipid nanoparticle (LNP) at a dose of 0.05 mg/kg (Group 5) and a dose of 0.1 mg/kg (Group 4) compared to a single IV dose of IL12 protein at 1 g (~0.05 mg/kg) (Group 2), NST-FIX at 0.1 mg/kg (Group 7) or 0.05 mg/kg (Group 8), or PBS (Group 1).

FIG. 50 is a Table depicting a tolerability advantage of local (intratumoral) administration of IL12 mRNA over systemic (intravenous) administration. Nine (9) of 10 mice intratumorally administered IL12 mRNA at about 0.2 mg/kg (4 μg fixed) were viable at day 20 compared to 3 of 12 mice intravenously administered IL12 mRNA at 0.2 mg/kg. The intravenous administration shows the plasma level of IL12 24 hours post dose (ng/ml) about 18 fold higher than the intratumoral administration (1592 ng/ml v. 89 ng/ml).

Figure 51B:
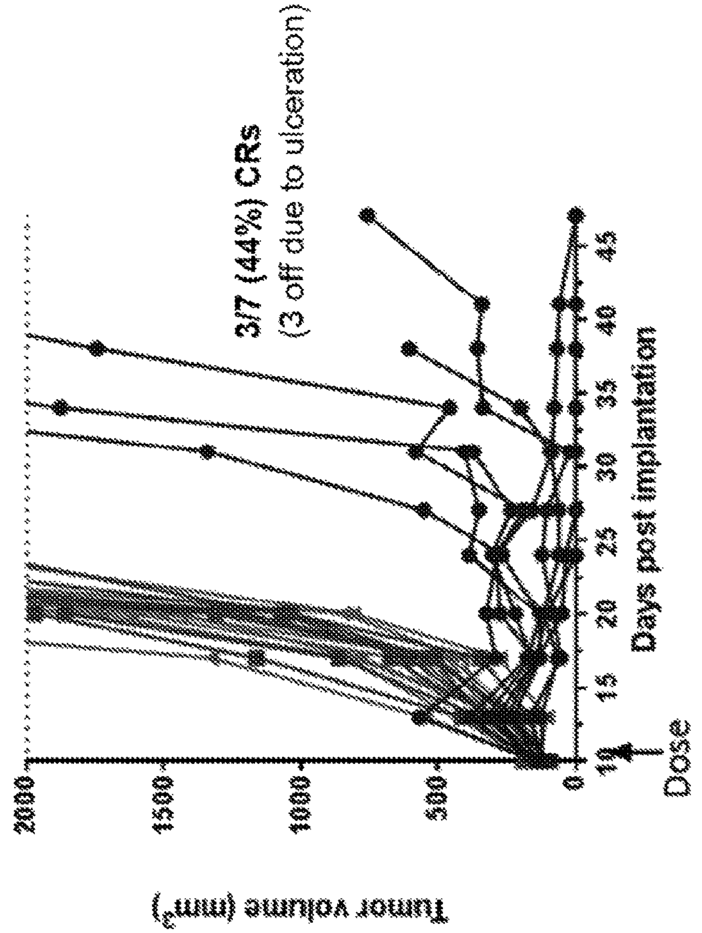
Figure 51A:
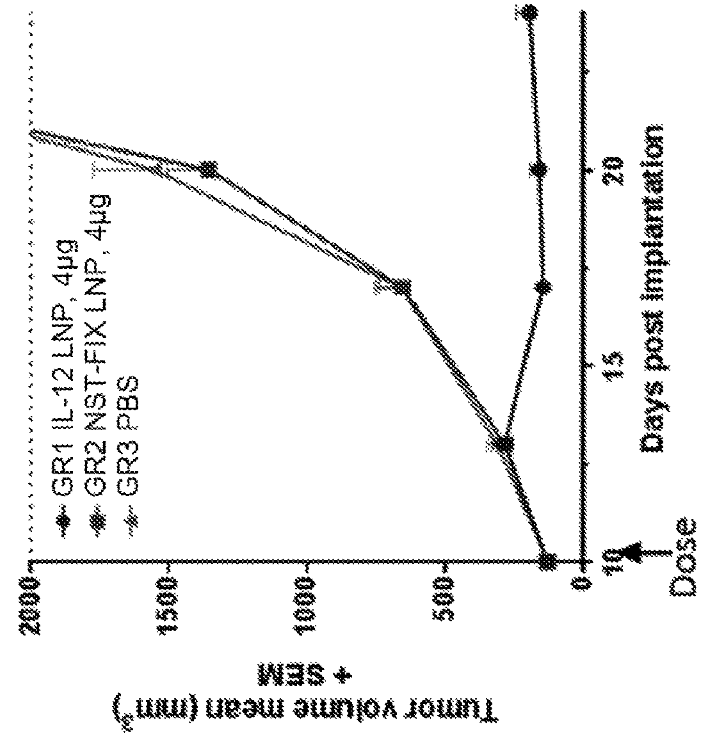

FIGS. 51A and 51B are graphs showing the in vivo anti-tumor efficacy of a single intratumoral dose of IL12 mRNA (4 μg) in a lipid nanoparticle (LNP) administered to mice bearing adenocarcinoma (MC38) tumors. FIG. 51A shows the tumor volume means ($mm^3$), up to day 24, starting at day 10 post implantation. Group 1 (circles) represents mice (n=7) administered 4 μg IL12 mRNA LNP at day 10 post-implantation; Group 2 (squares) represents mice (n=7) administered 4 μg of control mRNA encoding non-translated factor IX (NST-FIX LNP); and Group 3 (triangles) represents another control group of mice (n=7) administered PBS. FIG. 51B shows the individual tumor volumes ($mm^3$) for each group of mice, up to day 47, starting at day 10 post implantation. Complete responses (CR) were achieved in 3 of 7 (44%) animals administered 4 μg IL12 mRNA LNP (circles).

Figure 52A:
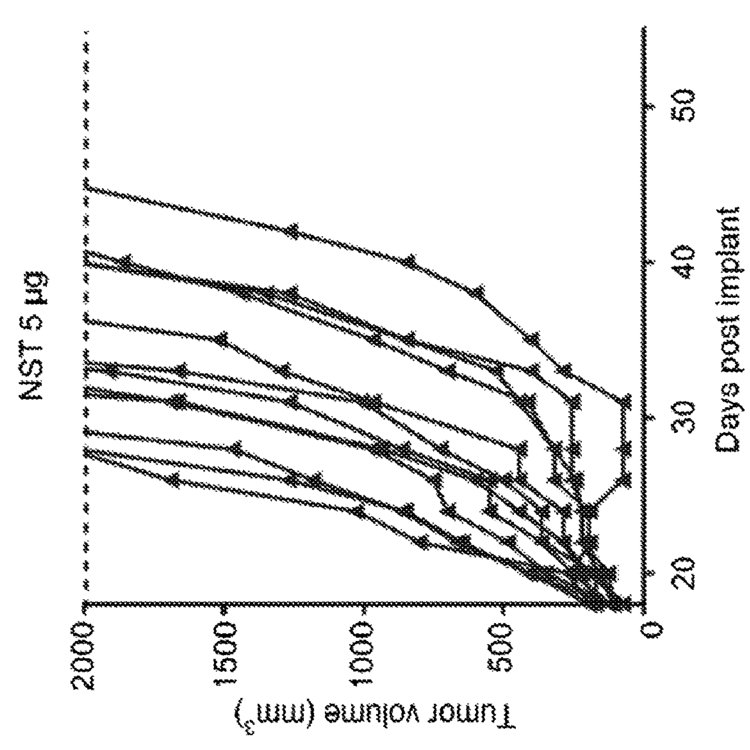
Figure 52B:
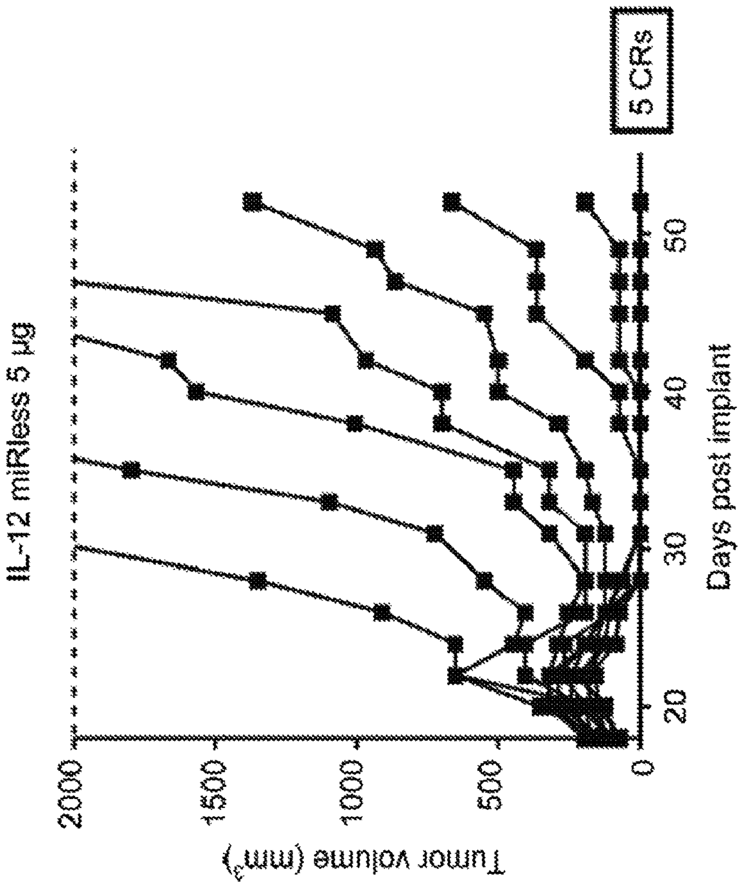

FIGS. 52A and 52B are graphs showing the in vivo anti-tumor efficacy of an intratumoral dose of IL12 mRNA (5 μg) in MC3-based lipid nanoparticle (LNP) administered to mice bearing A20 B-cell lymphoma tumors. FIG. 52A shows the individual tumor volume ($mm^3$) for mice (n=12) administered 5 μg non-translated control mRNA (NST). FIG. 52B shows the individual tumor volumes for mice (n=12) administered 5 g of IL12 (miRless) mRNA. Complete responses (CR) were achieved in 5 of 12 animals that received IL12 mRNA.

Figure 53B:
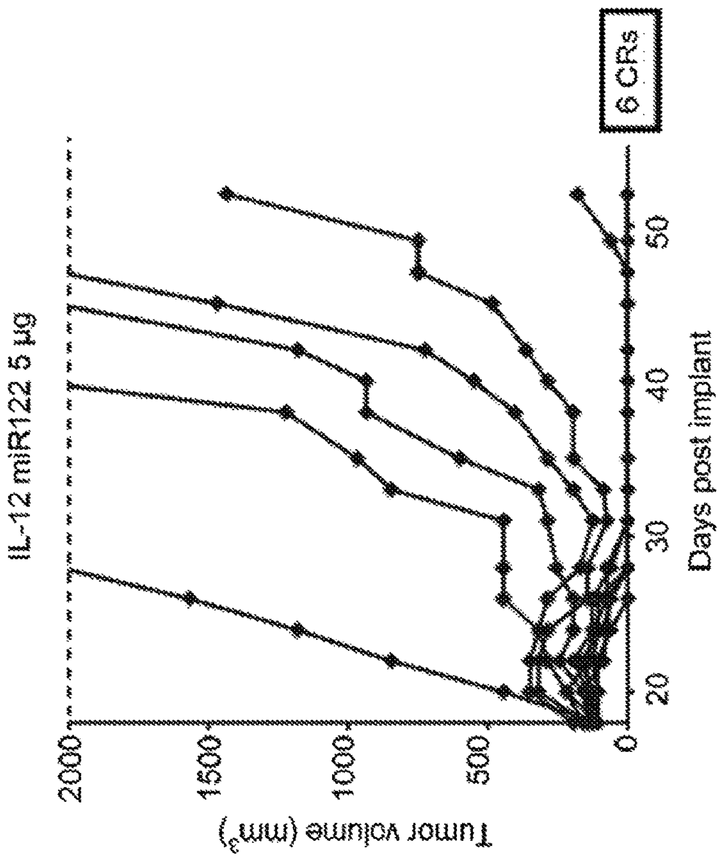
Figure 53A:
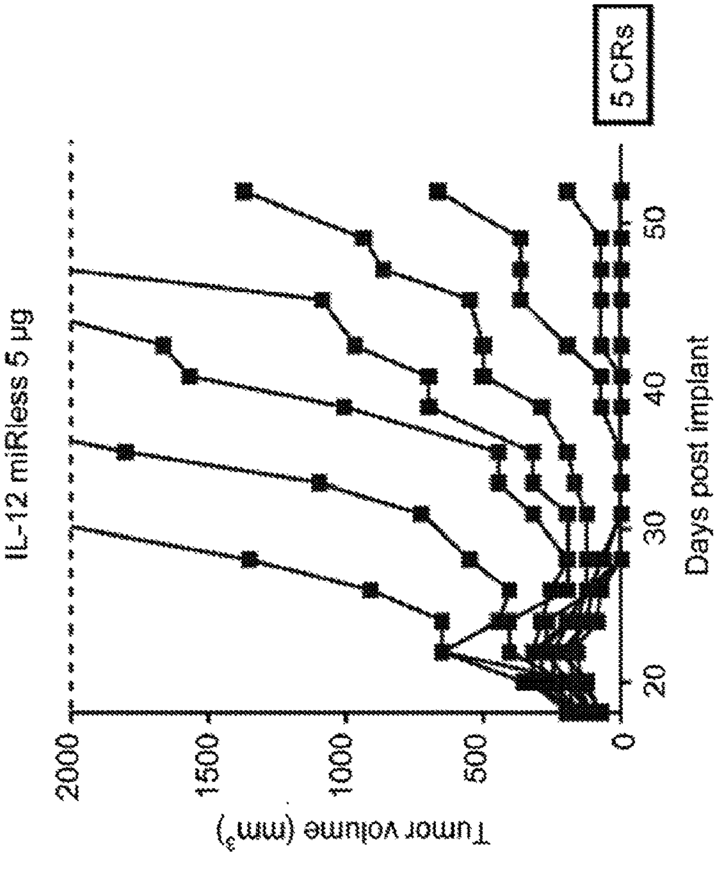

FIGS. 53A and 53B are graphs showing comparable in vivo anti-tumor efficacy of IL12 mRNA (5 μg) containing a miR122 binding site (FIG. 53A) to miRless L12 mRNA (FIG. 53B) in a B-cell lymphoma tumor model (A20). Both IL12 mRNAs (with miR122 binding site and without (i.e., miRless)) were formulated in an MC3-based lipid nanoparticle (LNP). The IL12 mRNAs were administered to mice bearing A20 B-cell lymphoma tumors. Complete responses (CR) were achieved in 5 out of 12 mice in the IL12 miRless group (FIG. 53A) and 6 out of 12 mice in the IL12 miR122 group (FIG. 53B).

Figure 54B:
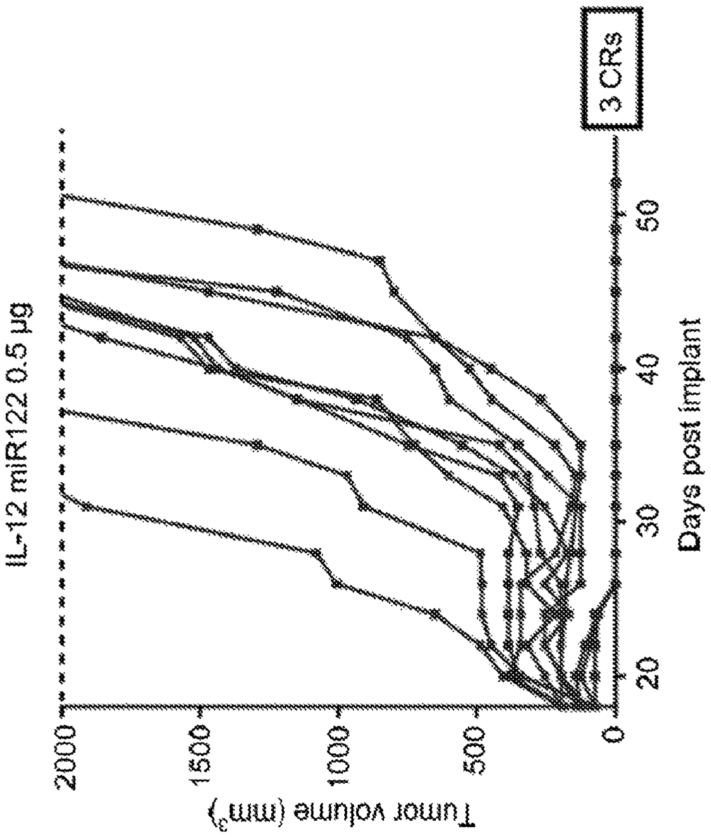
Figure 54A:
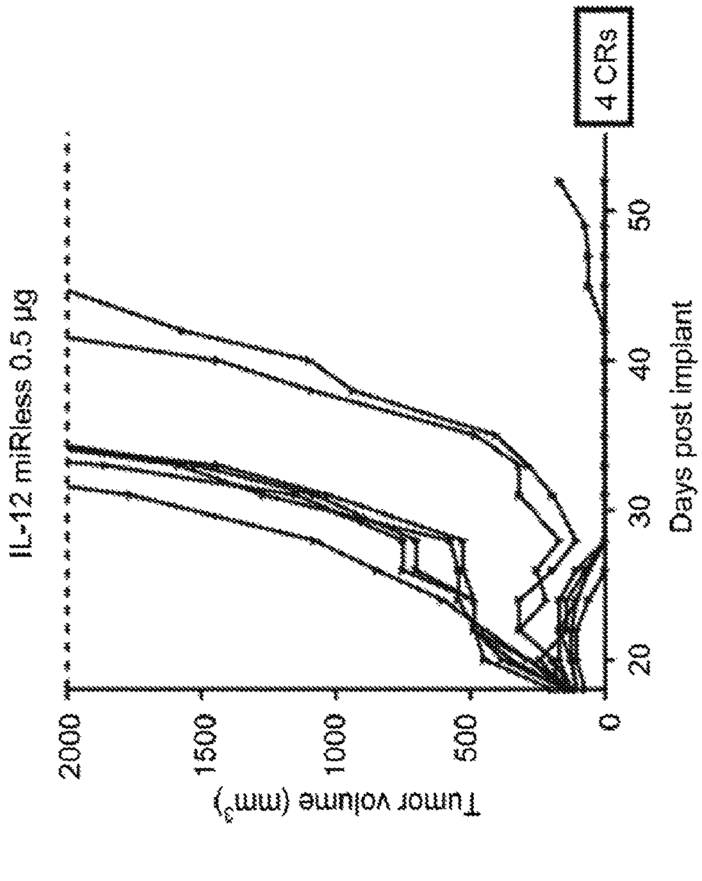

FIGS. 54A and 54B are graphs showing in vivo anti-tumor efficacy of a single dose of 0.5 μg IL12 mRNA in MC3-based lipid nanoparticle (LNP) administered to mice bearing A20 B-cell lymphoma tumors. Complete responses (CR) were achieved in 4 of 12 mice in the IL12 miRless (0.5 μg) group (FIG. 54A) and 3 of 12 mice in the L12 miR122 (0.5 μg) group (FIG. 54B).

Figure 55A:
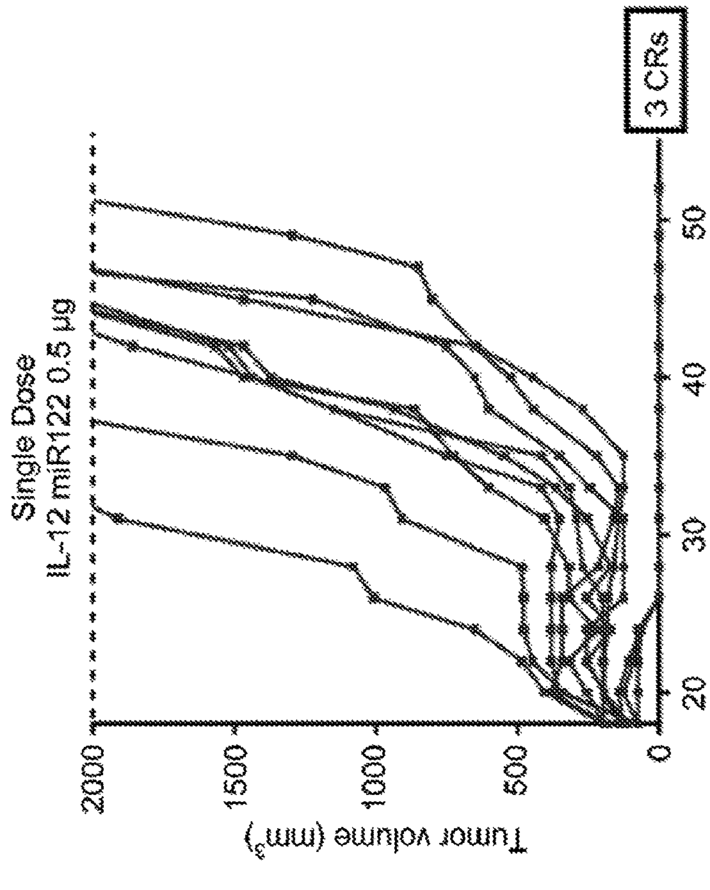
Figure 55B:
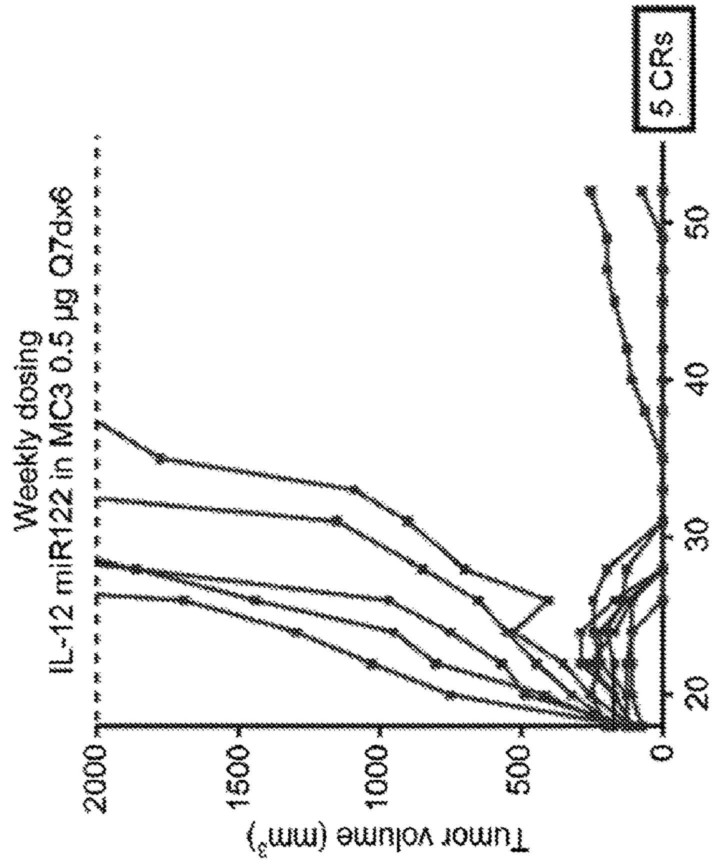

FIGS. 55A and 55B are graphs showing enhanced in vivo anti-tumor efficacy in a B-cell lymphoma tumor model (A20) by administering multiple doses of 0.5 μg IL12 mRNA in MC3-based lipid nanoparticle (LNP) to mice bearing A20 tumors. Complete responses (CR) were achieved in 3 out of 12 mice (FIG. 55A) administered a single dose of 0.5 μg IL12 miR122 and 5 out of 12 mice (FIG. 55B) administered weekly dosing of 0.5 μg IL12 miR122 for seven (7) days×6.

Figure 56B:
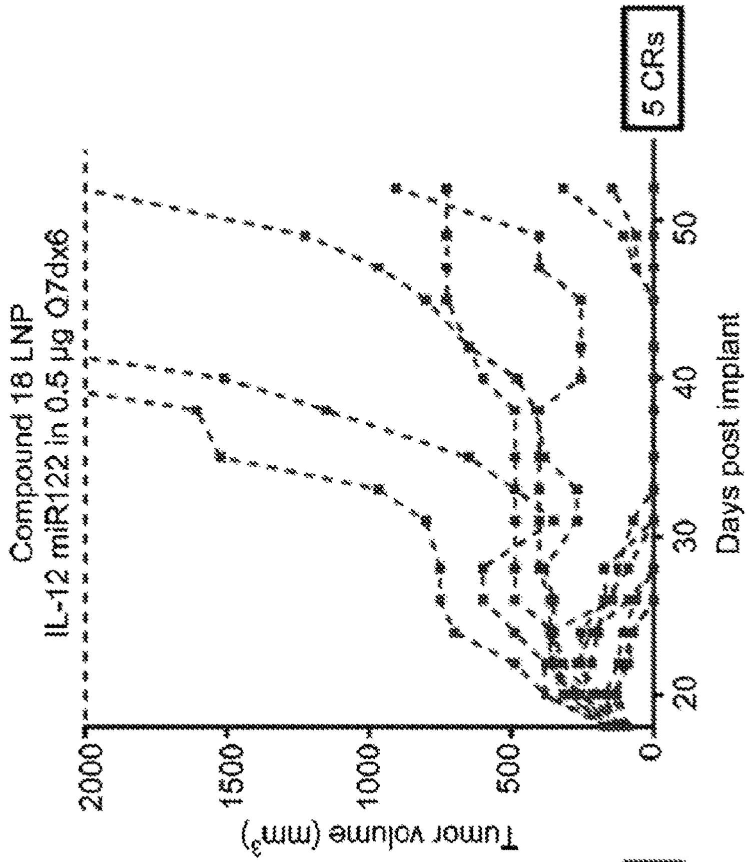
Figure 56A:
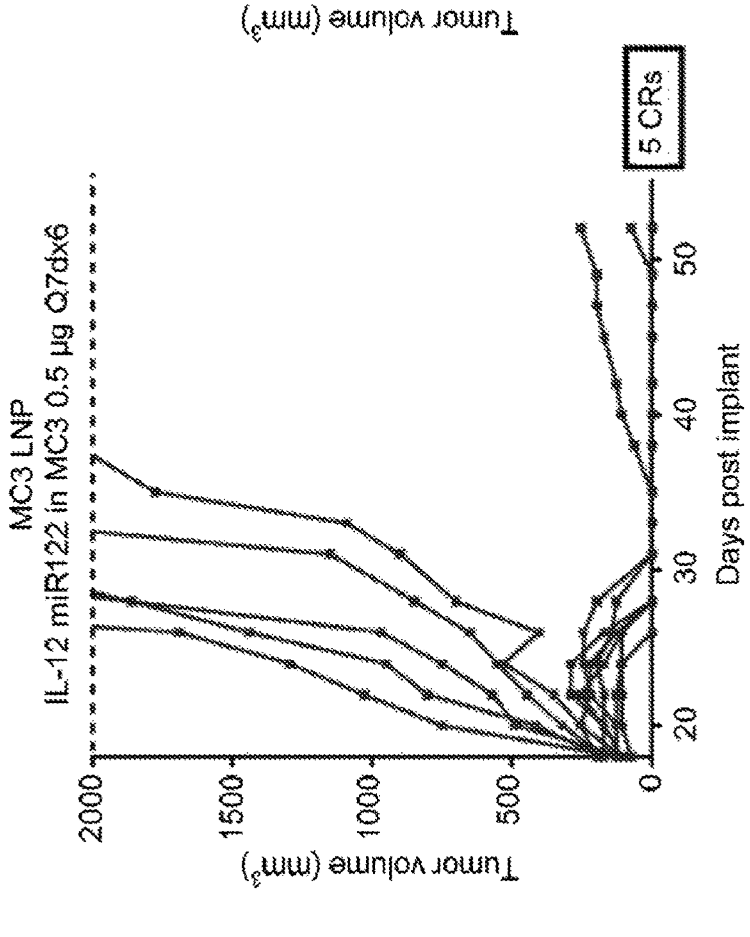

FIGS. 56A and 56B are graphs showing that the in vivo anti-tumor efficacy of weekly intratumoral doses of 0.5 μg IL12 mRNA in lipid nanoparticle (LNP) (i.e., compound 18) administered to mice bearing A20 B-cell lymphoma tumors is similar to the in vivo anti-tumor efficacy of 0.5 μg IL12 mRNA in MC3-based LNP. FIG. 56A shows the individual tumor volume ($mm^3$) for 12 mice administered 0.5 μg IL12 miR122 in MC3-based LNP for 7 days×6. Complete responses (CR) were achieved in 5 out of 12 animals. FIG. 56B shows the individual tumor volumes for 12 mice administered 0.5 μg of IL12 mRNA in compound 18-based LNP for 7 days×6. Complete responses (CR) were also achieved in 5 out of 12 animals.

Figure 57B:
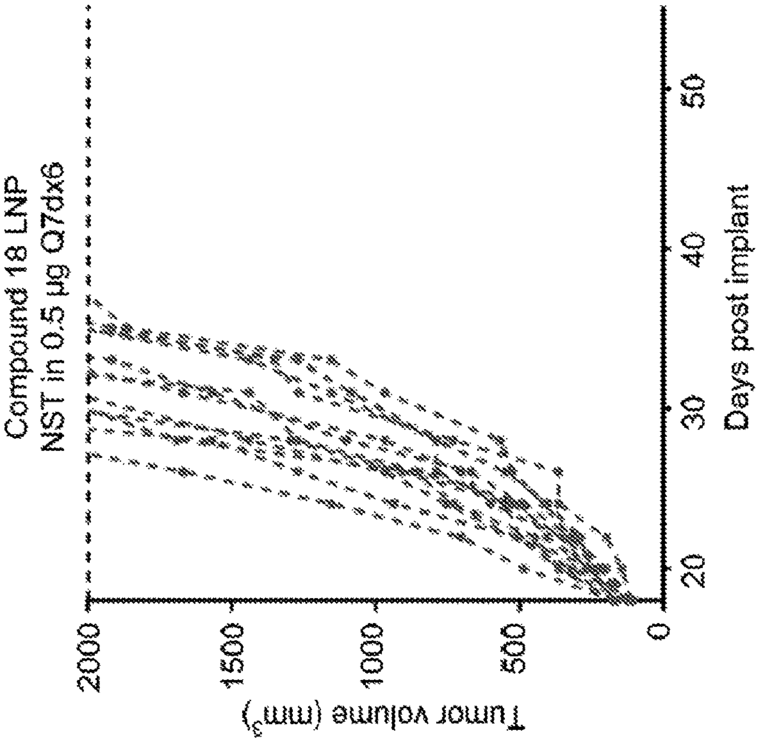
Figure 57A:
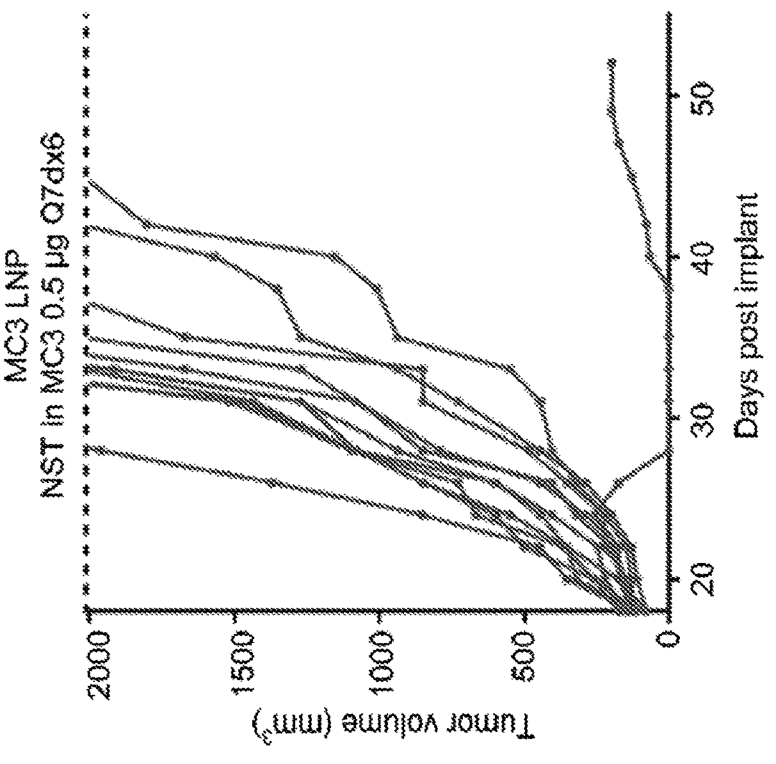

FIGS. 57A and 57B are graphs showing tumor growth in mice bearing A20 tumors administered weekly dosing (7 days×6) of 0.5 μg non-translated negative control mRNA (NST) in MC3-based lipid nanoparticle (LNP) (FIG. 57A) and 0.5 μg non-translated negative control mRNA (NST) in compound 18-based LNP (FIG. 57B).

Figure 58A:
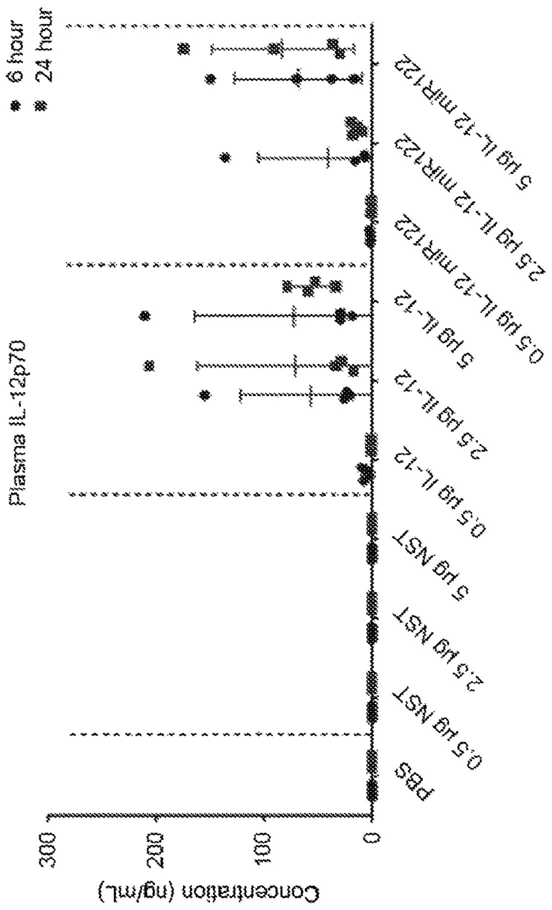
Figure 58B:
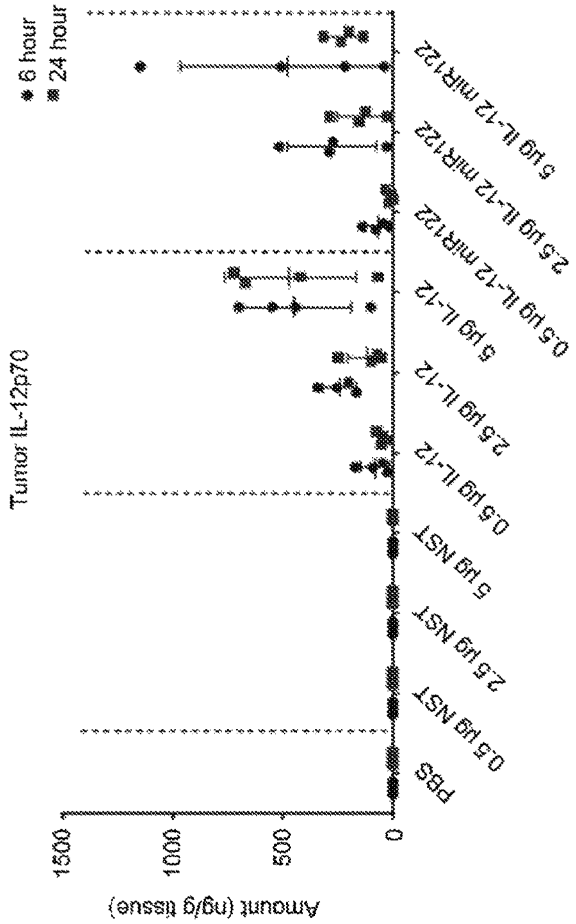

FIGS. 58A and 58B are graphs showing dose-dependent levels of IL12 in plasma (FIG. 58A) and tumor (FIG. 58B) at 6 hours and 24 hours following intratumoral administration of the indicated doses of IL12 mRNA to mice bearing A20 tumors. From left to right, the mice were given (i) PBS, (ii) 0.5 μg NST, (iii) 2.5 μg NST, (iv) 5 μg NST, (v) 0.5 μg IL12, (vi) 2.5 μg IL12, (vii) 5 μg IL12, (viii) 0.5 μg IL12 miR122, (ix) 2.5 μg IL12 miR122, and (x) 5 μg IL12 miR122.

FIGS. 59A to 59C are graphs showing elevated levels of IL12 in plasma and tumor following administration of indicated doses of IL12 mRNA in compound 18-based LNPs compared to IL12 mRNA in MC3-based LNPs. FIG. 59A shows plasma L12 levels at 6 hours and 24 hours; FIG. 59B shows tumor IL12 levels at 6 hours and 24 hours. From left to right, the mice were given (i) PBS, (ii) 0.5 μg NST in MC3, (iii) 2.5 μg NST in MC3, (iv) 0.5 μg IL12 miR122 in MC3, (v) 2.5 μg IL12 miR122 in MC3, (vi) 0.5 μg NST in Compound 18, (vii) 2.5 μg NST in Compound 18, (viii) 5 μg L12 miR122, (ix) 0.5 μg IL12 miR122 in Compound 18, and (x) 2.5 μg IL12 miR122 in Compound 18. FIG. 59C shows the fold increase of IL12 from Compound 18 formulated composition compared to MC3 formulated composition.

Figure 60A:
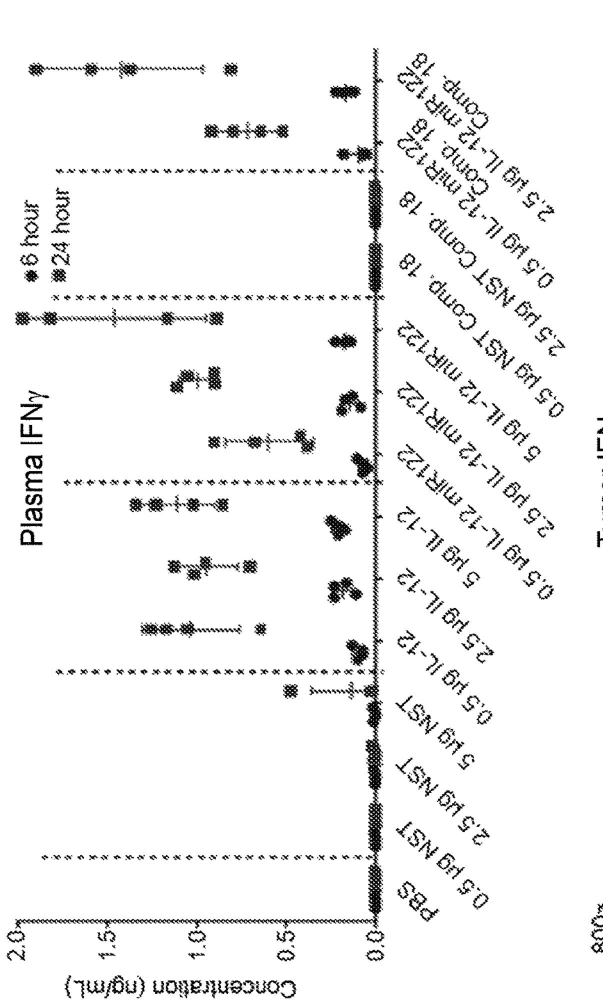
Figure 60B:
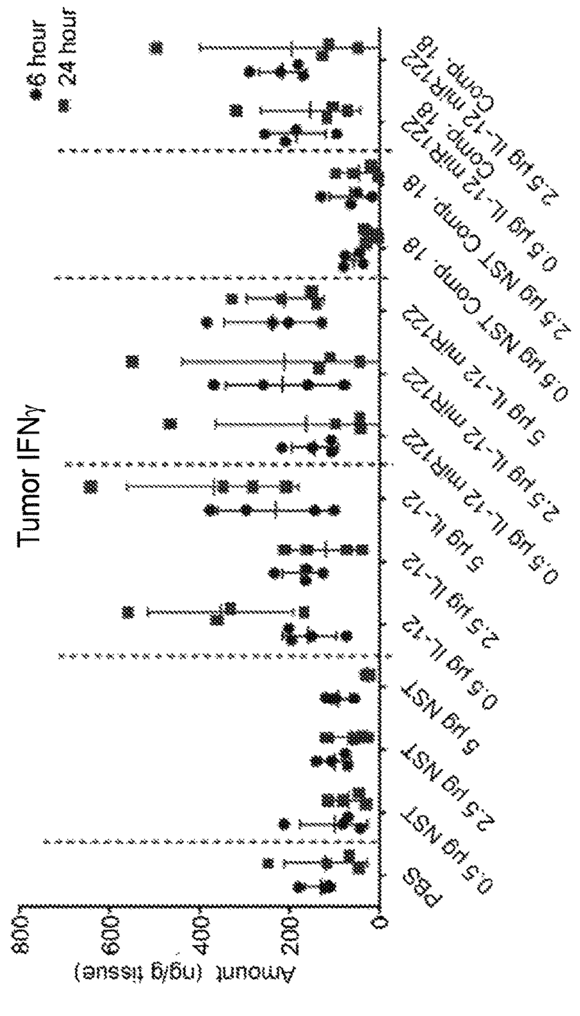

FIGS. 60A and 60B are graphs showing increased levels of IFNγ at 6 hours and 24 hours in plasma (FIG. 60A) and in tumor (FIG. 60B) following administration of IL12 mRNA to mice bearing A20 tumors. From left to right, the mice were given (i) PBS, (ii) 0.5 μg NST in MC3, (iii) 2.5 μg NST in MC3, (iv) 5 μg NST in MC3, (v) 0.5 μg IL12 in MC3, (vi) 2.5 μg IL12 in MC3, (vii) 5 μg IL12 in MC3, (viii) 0.5 μg IL12 miR122 in MC3, (ix) 2.5 μg IL12 miR122 in MC3, (x) 5 μg IL12 miR122 in MC3, (xi) 0.5 μg NST in Compound 18, (xii) 2.5 μg NST in Compound 18, (xiii) 0.5 μg IL12 miR122 in Compound 18, and (xiv) 2.5 μg IL12 miR122 in Compound 18.

Figure 61A:
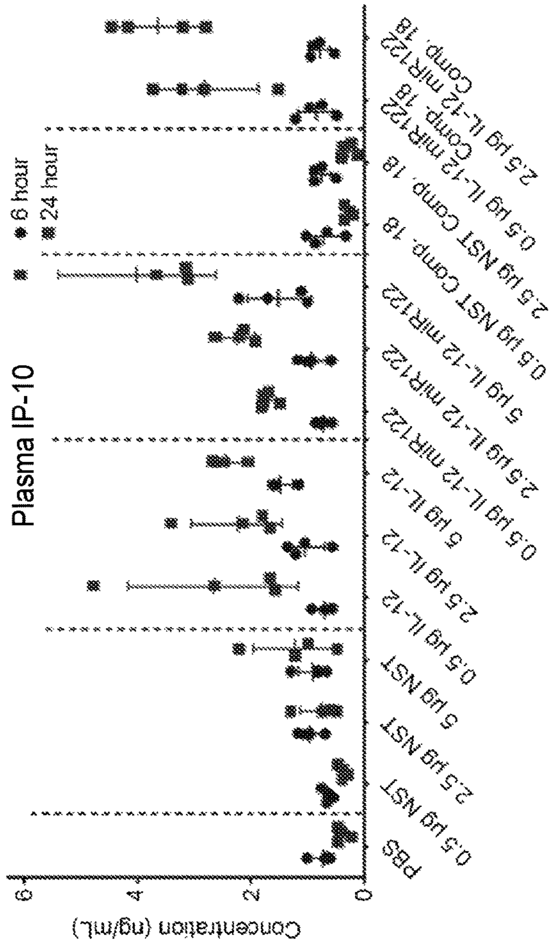
Figure 61B:
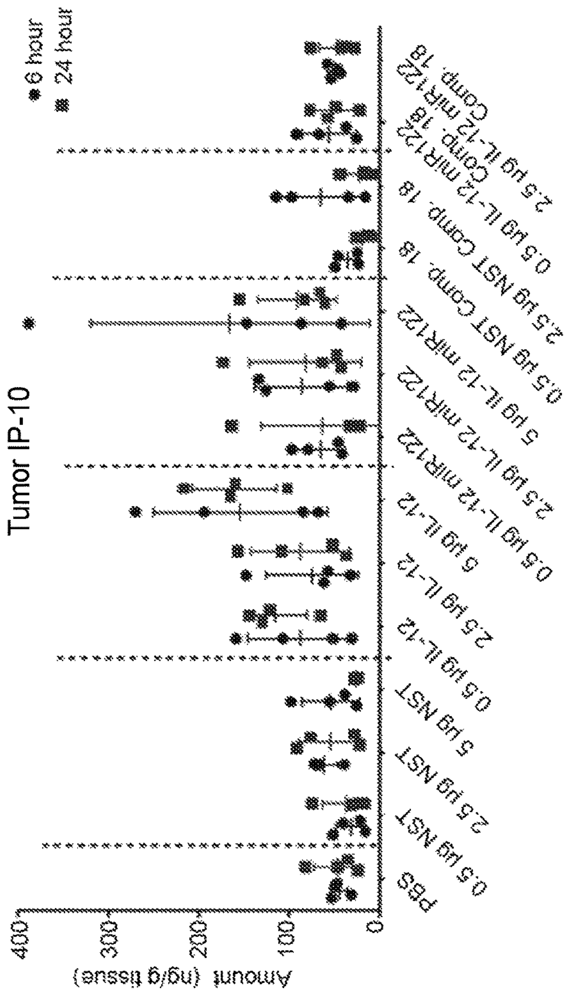

FIGS. 61A and 61B are graphs showing increased levels of IP10 at 6 hours and 24 hours in plasma (FIG. 61A) and in tumor (FIG. 61B) following administration of IL12 mRNA to mice bearing A20 tumors. From left to right, the mice were given (i) PBS, (ii) 0.5 μg NST in MC3, (iii) 2.5 μg NST in MC3, (iv) 5 μg NST in MC3, (v) 0.5 μg IL12 in MC3, (vi) 2.5 μg IL12 in MC3, (vii) 5 μg IL12 in MC3, (viii) 0.5 μg IL12 miR122 in MC3, (ix) 2.5 μg IL12 miR122 in MC3, (x) 5 μg IL12 miR122 in MC3, (xi) 0.5 μg NST in Compound 18, (xii) 2.5 μg NST in Compound 18, (xiii) 0.5 μg IL12 miR122 in Compound 18, and (xiv) 2.5 μg IL12 miR122 in Compound 18.

Figure 62A:
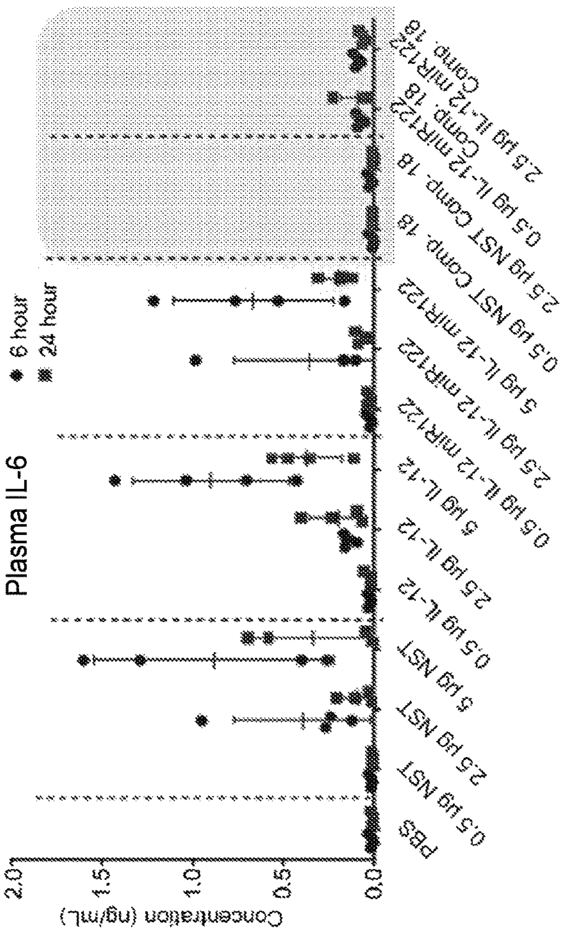
Figure 62B:
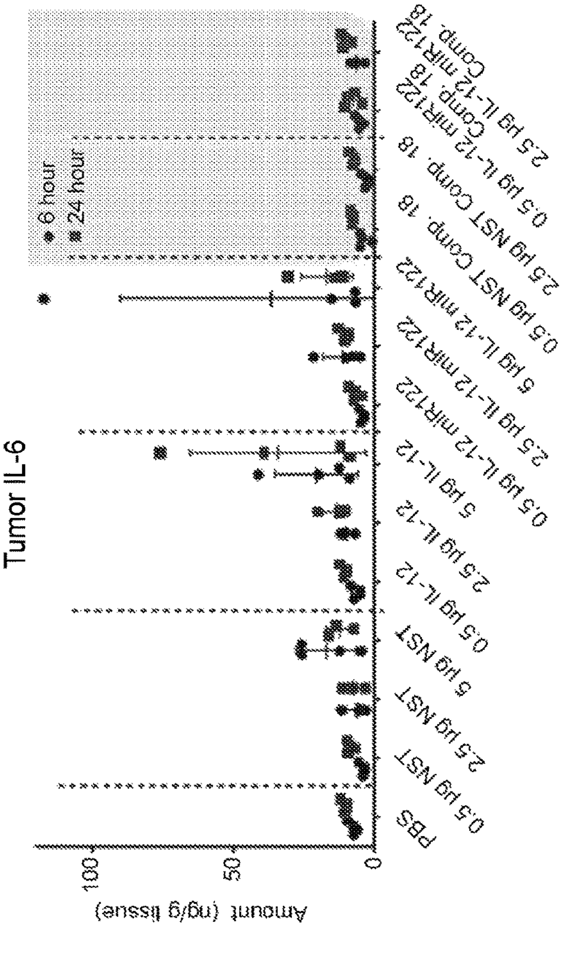

FIGS. 62A and 62B are graphs showing decreased levels of IL6 at 6 hours and 24 hours in plasma (FIG. 62A) and in tumor (FIG. 62B) following administration of IL12 mRNA. From left to right, the mice were given (i) PBS, (ii) 0.5 μg NST in MC3, (iii) 2.5 μg NST in MC3, (iv) 5 μg NST in MC3, (v) 0.5 μg IL12 in MC3, (vi) 2.5 μg IL12 in MC3, (vii) 5 μg IL12 in MC3, (viii) 0.5 μg IL12 miR122 in MC3, (ix) 2.5 μg IL12 miR122 in MC3, (x) 5 μg IL12 miR122 in MC3, (xi) 0.5 μg NST in Compound 18, (xii) 2.5 μg NST in Compound 18, (xiii) 0.5 μg IL12 miR122 in Compound 18, and (xiv) 2.5 μg IL12 miR122 in Compound 18.

Figure 63A:
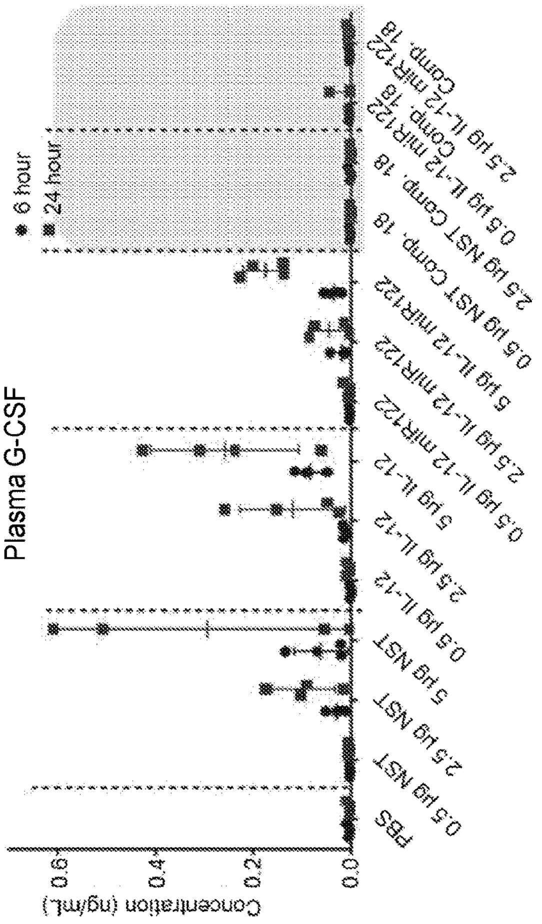
Figure 63B:
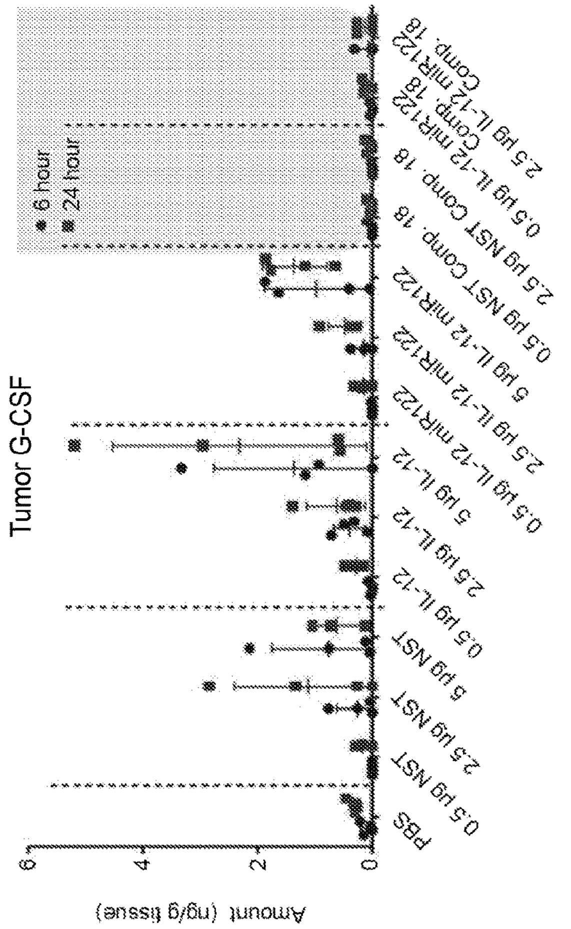

FIGS. 63A and 63B are graphs showing decreased levels of G-CSF at 6 hours and 24 hours in plasma (FIG. 63A) and in tumor (FIG. 63B) following administration of IL12 mRNA. From left to right, the mice were given (i) PBS, (ii) 0.5 μg NST in MC3, (iii) 2.5 μg NST in MC3, (iv) 5 μg NST in MC3, (v) 0.5 μg IL12 in MC3, (vi) 2.5 μg IL12 in MC3, (vii) 5 μg IL12 in MC3, (viii) 0.5 μg IL12 miR122 in MC3, (ix) 2.5 μg IL12 miR122 in MC3, (x) 5 μg IL12 miR122 in MC3, (xi) 0.5 μg NST in Compound 18, (xii) 2.5 μg NST in Compound 18, (xiii) 0.5 μg IL12 miR122 in Compound 18, and (xiv) 2.5 μg IL12 miR122 in Compound 18.

Figure 64A:
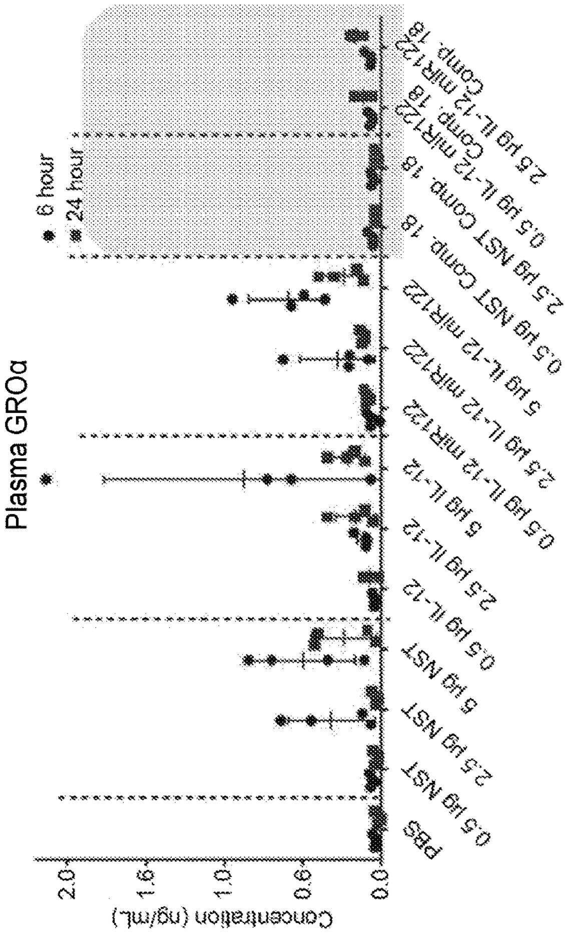
Figure 64B:
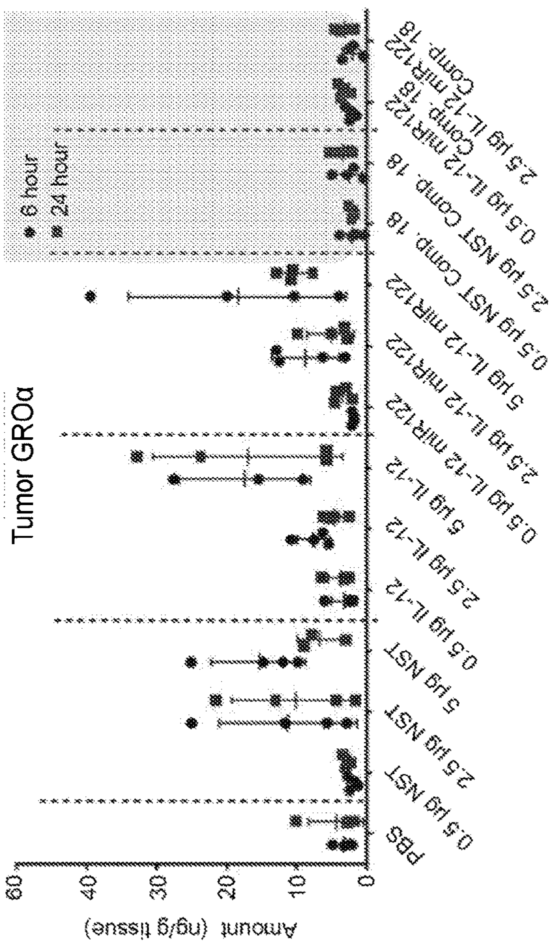

FIGS. 64A and 64B are graphs showing decreased levels of GROα at 6 hours and at 24 hours in plasma (FIG. 64A) and tumor (FIG. 64B) following administration of IL12 mRNA. From left to right, the mice were given (i) PBS, (ii) 0.5 μg NST in MC3, (iii) 2.5 μg NST in MC3, (iv) 5 μg NST in MC3, (v) 0.5 μg IL12 in MC3, (vi) 2.5 μg IL12 in MC3, (vii) 5 μg IL12 in MC3, (viii) 0.5 μg IL12 miR122 in MC3, (ix) 2.5 μg IL12 miR122 in MC3, (x) 5 μg IL12 miR122 in MC3, (xi) 0.5 μg NST in Compound 18, (xii) 2.5 μg NST in Compound 18, (xiii) 0.5 μg IL12 miR122 in Compound 18, and (xiv) 2.5 μg IL12 miR122 in Compound 18.

Figure 65B:
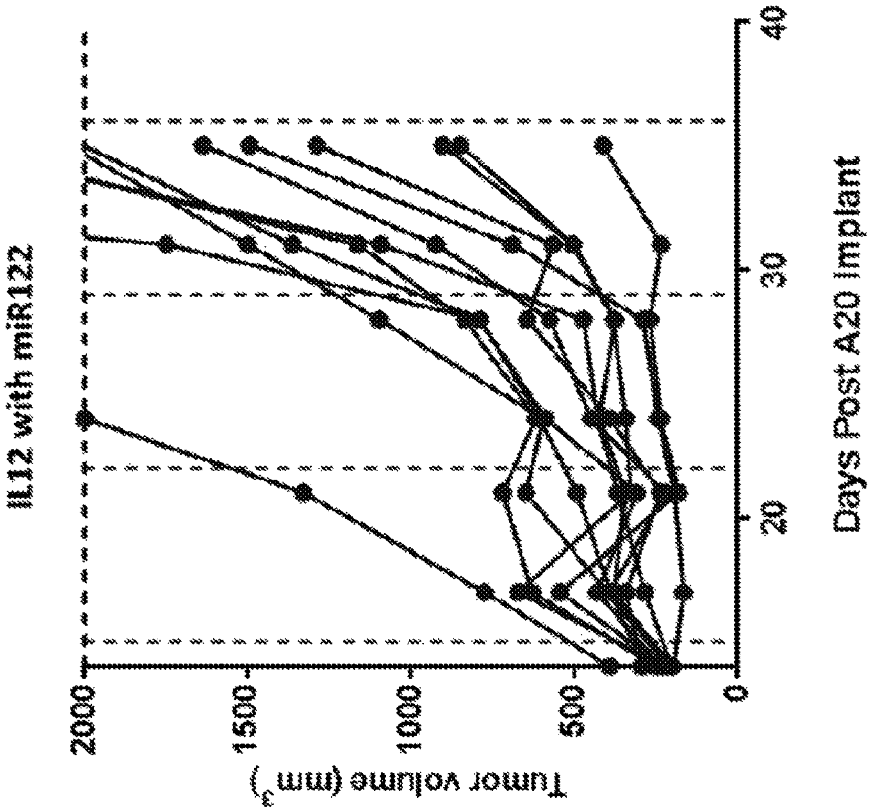
Figure 65A:
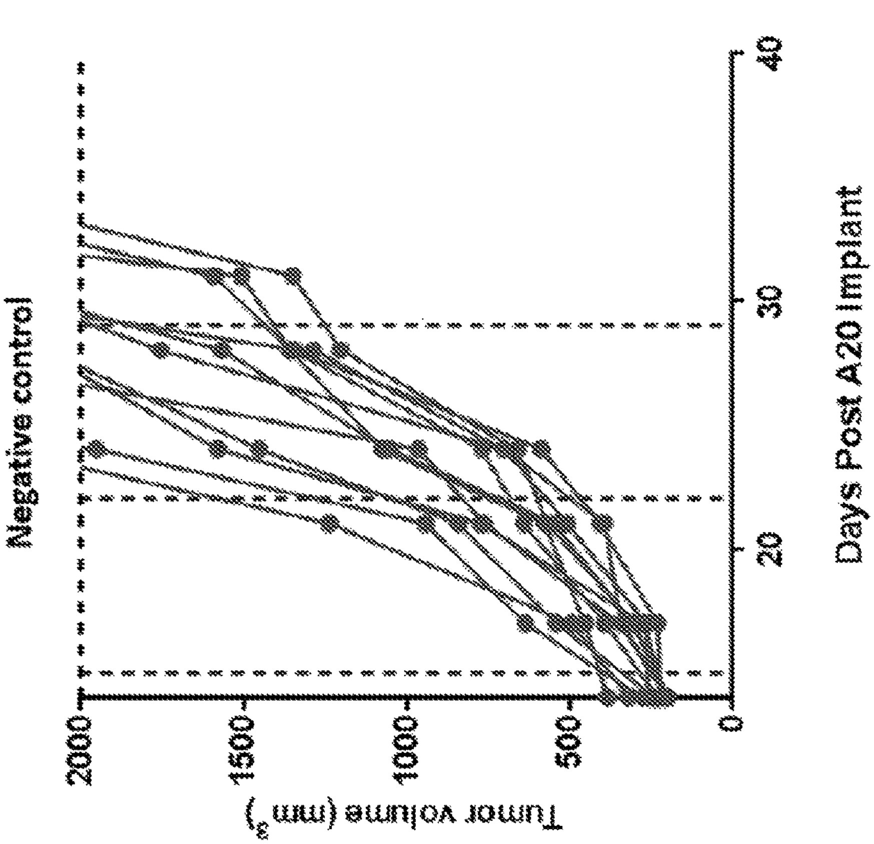

FIGS. 65A and 65B are graphs showing individual tumor volumes through day 35 post disease induction with A20 tumor following treatment with IL12_miR122 mRNA (FIG. 65B) compared to negative control mRNA (FIG. 65A).

Figure 66B:
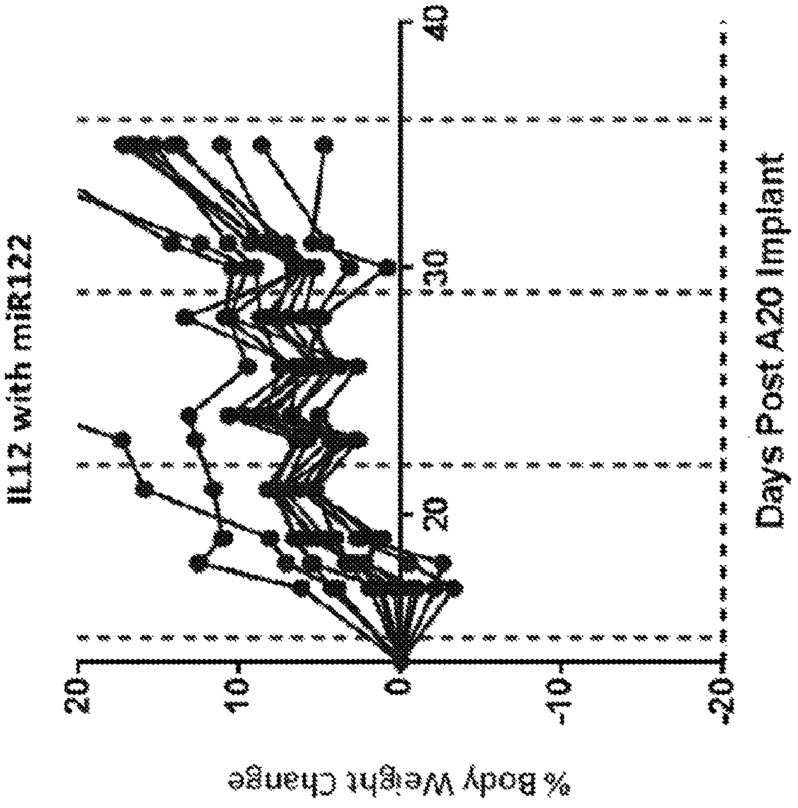
Figure 66A:
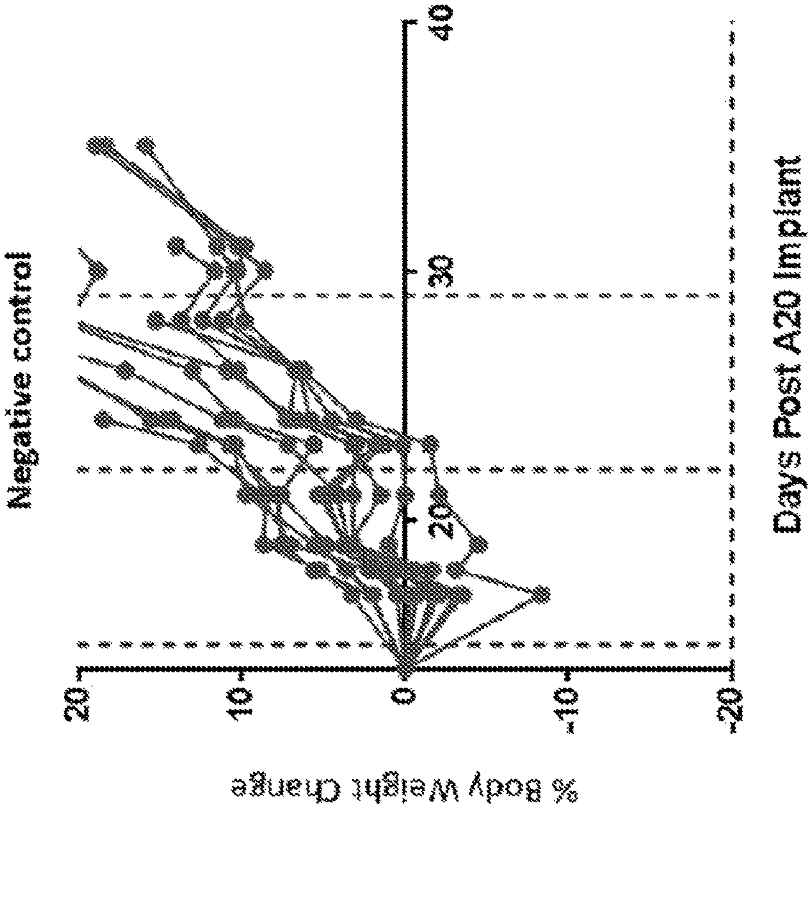

FIGS. 66A and 66B are graphs showing body weight measurements of mice through day 35 post disease induction with A20 tumor following treatment with IL12_miR122 mRNA (FIG. 66B) compared to negative control mRNA (FIG. 66A).

Figure 67:
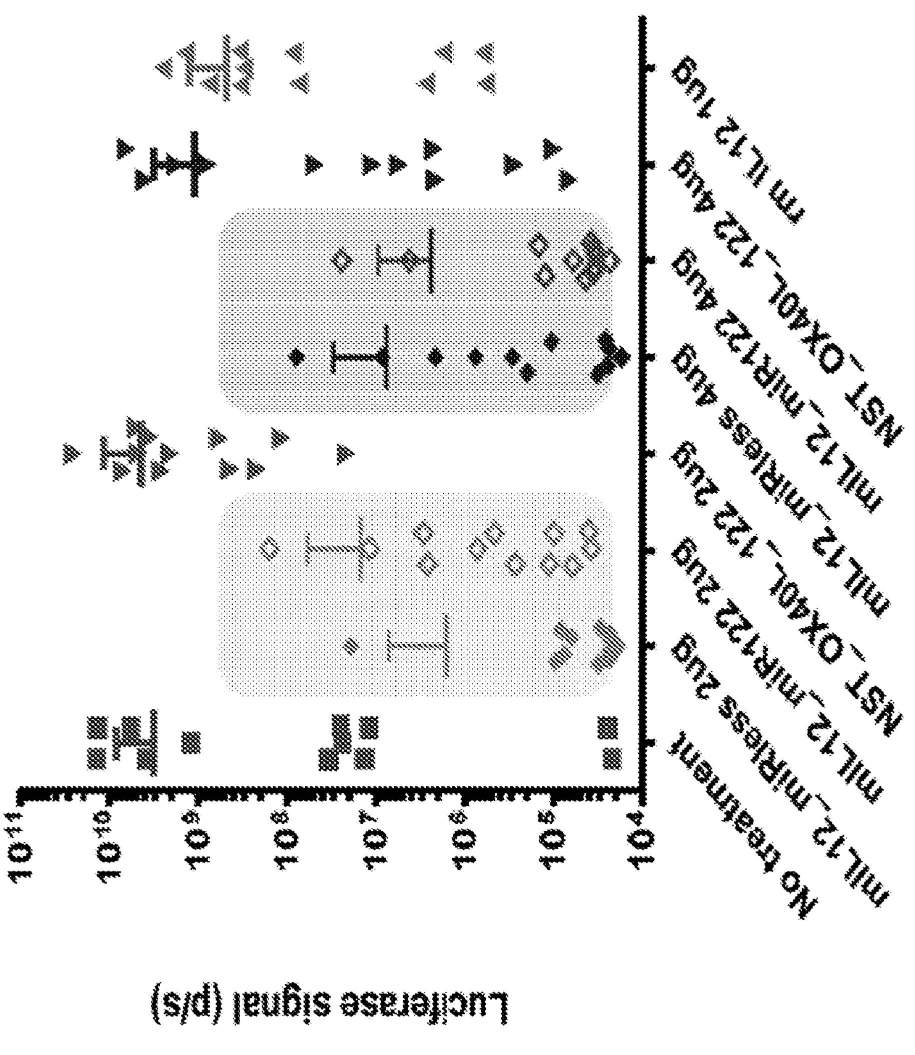

FIG. 67 is a graph depicting bioluminescence (BL) as a surrogate for tumor burden at day 22 post disease induction with a luciferase-enabled MC38 colon cancer cell line in mice. From left to right, mice were administered no treatment, 2 μg mIL12_miRless, 2 μg mIL12_miR122, 2 μg NST_OX40L_122, 4 μg mIL12_miRless, 4 μg mIL12_miR122, 4 μg NST_OX40L_122, and rm IL12 1 μg.

Figure 68:
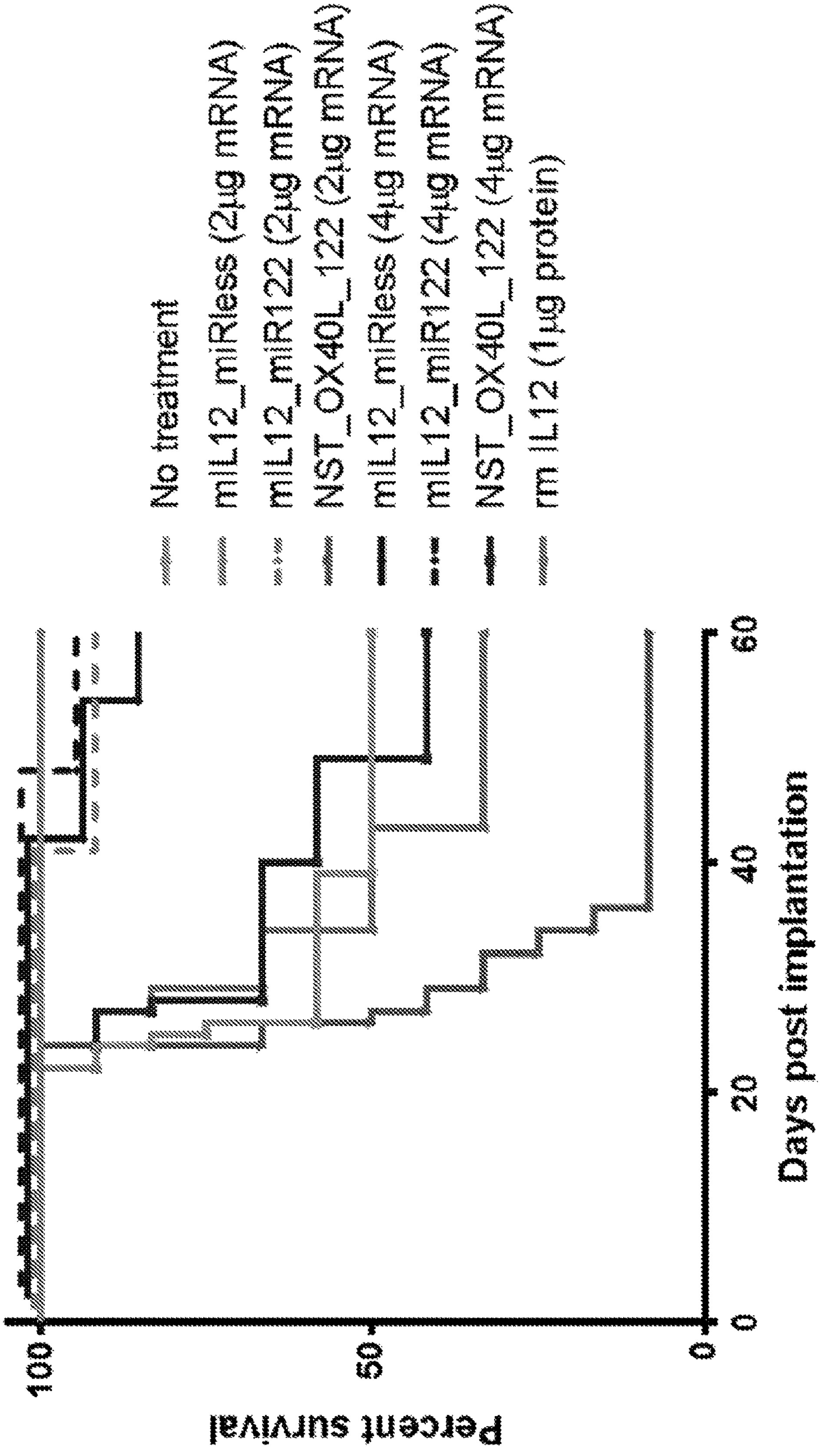

FIG. 68 is a Kaplan-Meier curve showing the percent survival of mice treated with LNPs carrying IL12 mRNA compared to NST-OX40L negative controls. The graph shows survival to day 60 post implantation with A20 tumor.

Figure 69A:
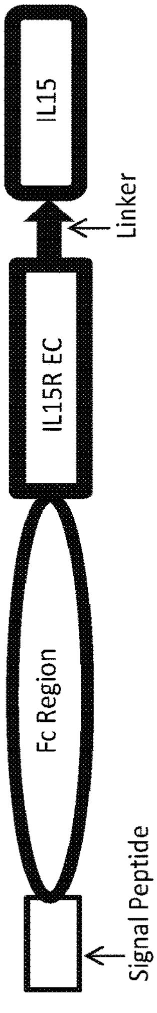

FIG. 69A shows a graphic representation of the Fc-IL15R-IL15 fusion construct. The construct comprises a (i) signal peptide, (ii) an Fc region, and (iii) an IL15R joined at its 3'end to the 5'end of an IL15 by a linker.

Figure 69B:
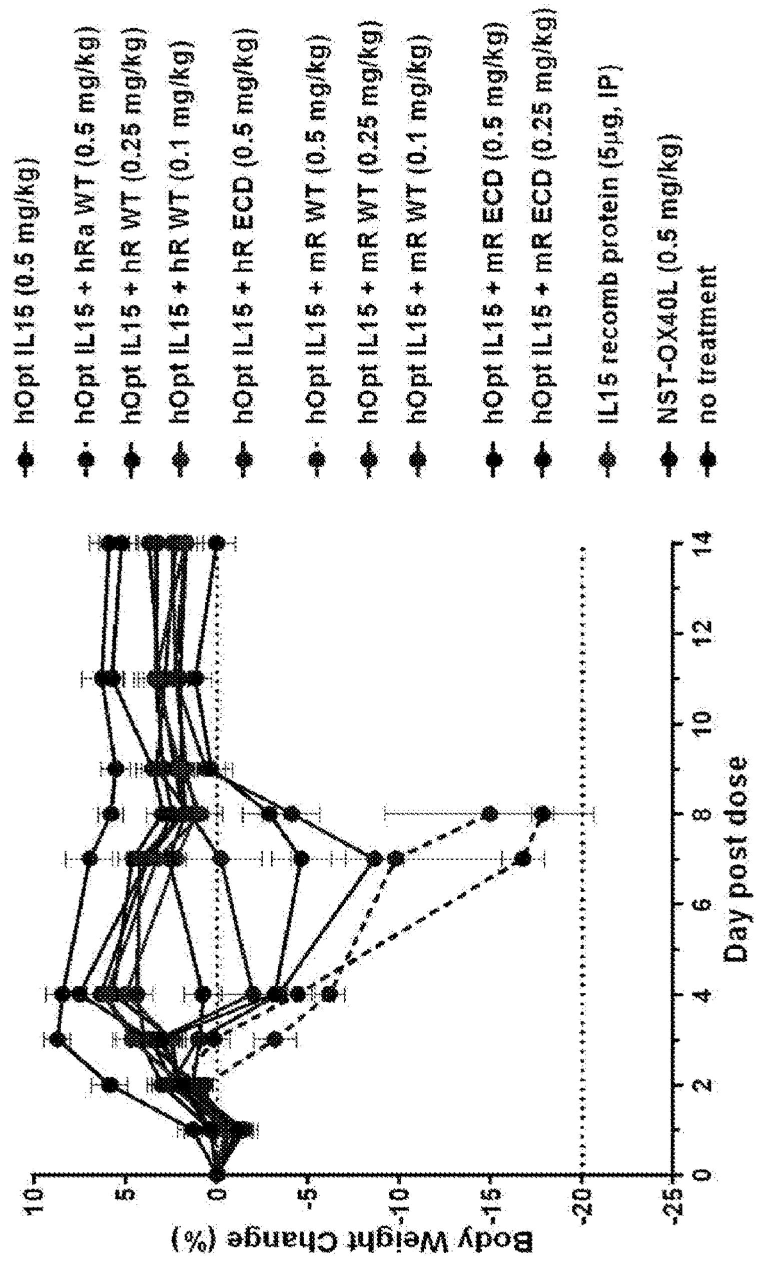

FIG. 69B shows change in body weight after administration of a modified mRNA encoding the wild-type IL15 (hOptIL15) with or without another agent. Other agents include modified mRNAs encoding either the wild-type IL15Ra or IL15Ra ECD (mouse or human), recombinant IL15 protein, or NST-OX40L. Change in body weight was measured at various time points for up to 2 weeks after administration.

Figure 70:
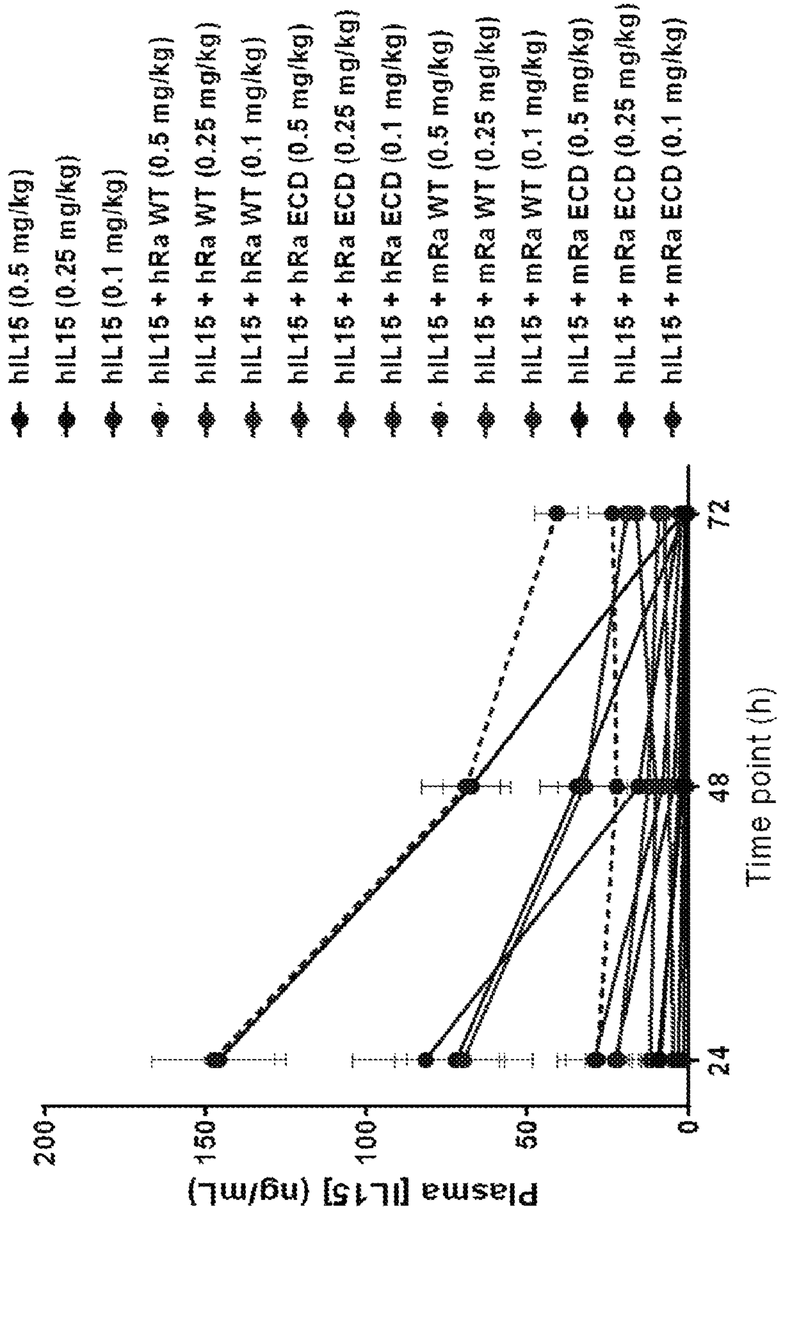

FIG. 70 shows IL15 protein levels measured in plasma after a single IV administration of a modified mRNA encoding the wild-type IL15 (hOptIL15) with or without another agent.

Figure 71:
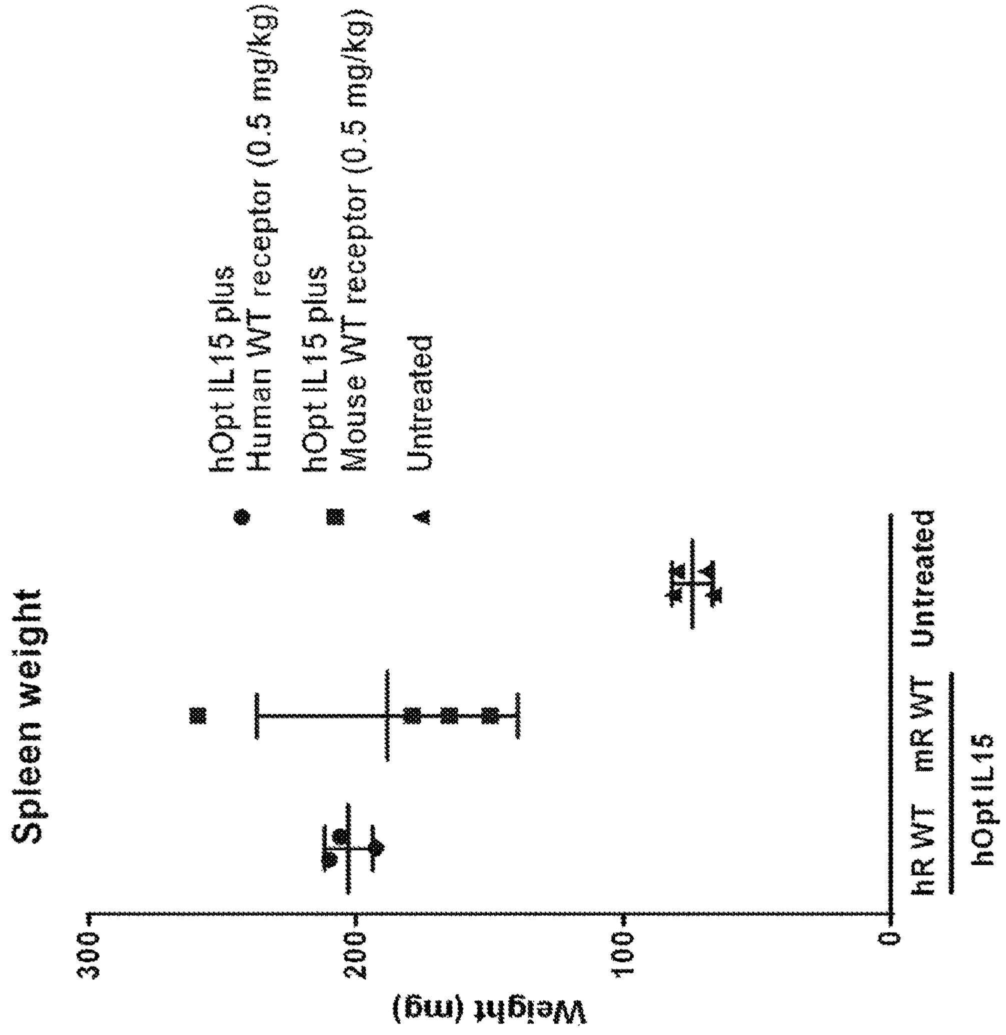

FIG. 71 shows the weight of the spleen after a single IV co-administration of a modified mRNA encoding the wild-type IL15 (hOptIL15) with a modified mRNA encoding the wild-type IL15Ra.

Figure 72:
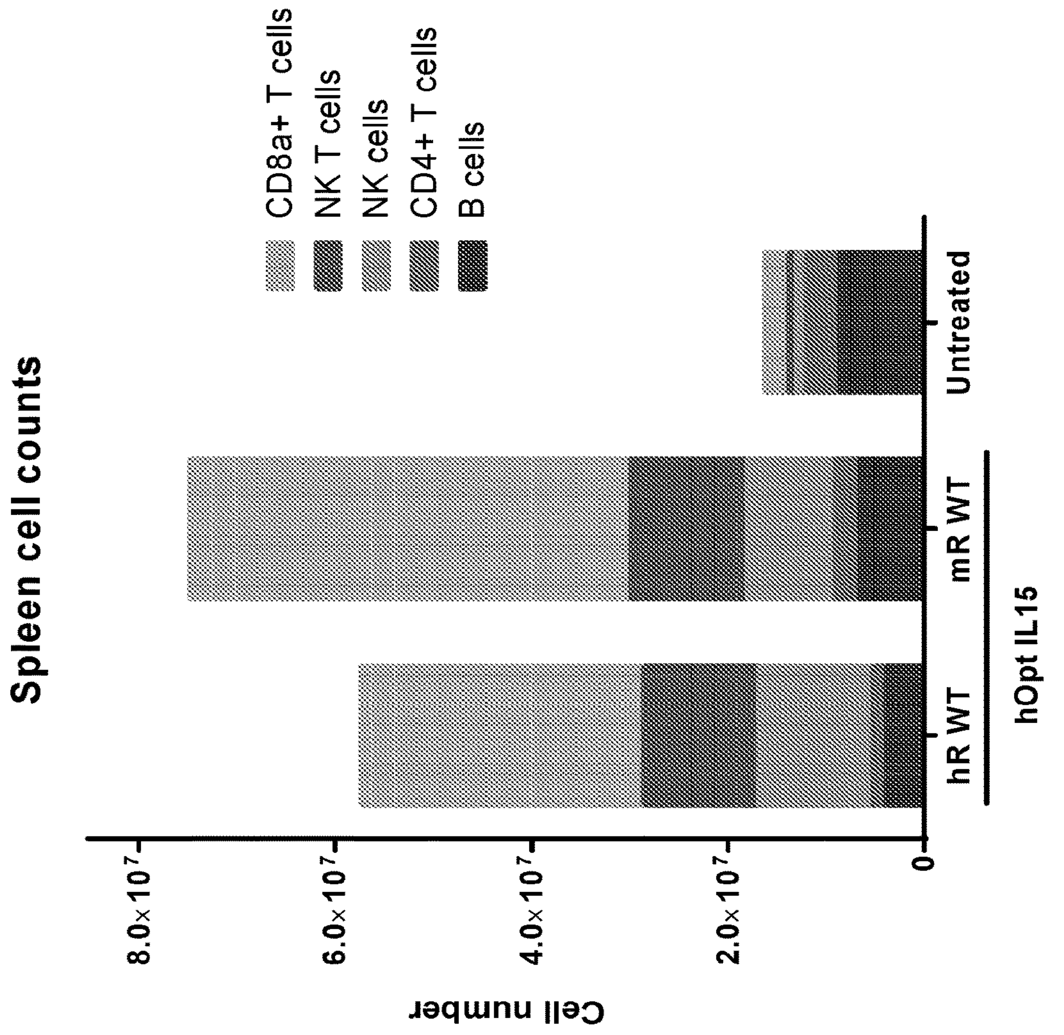

FIG. 72 shows the spleen cell count after a single IV co-administration of a modified mRNA encoding the wild-type IL15 (hOptIL15) with a modified mRNA encoding the wild-type IL15Ra. Spleen cells were further categorized into CD8a+ T cells, NK T cells, NK cells, CD4+ T cells, and B cells.

Figure 73:
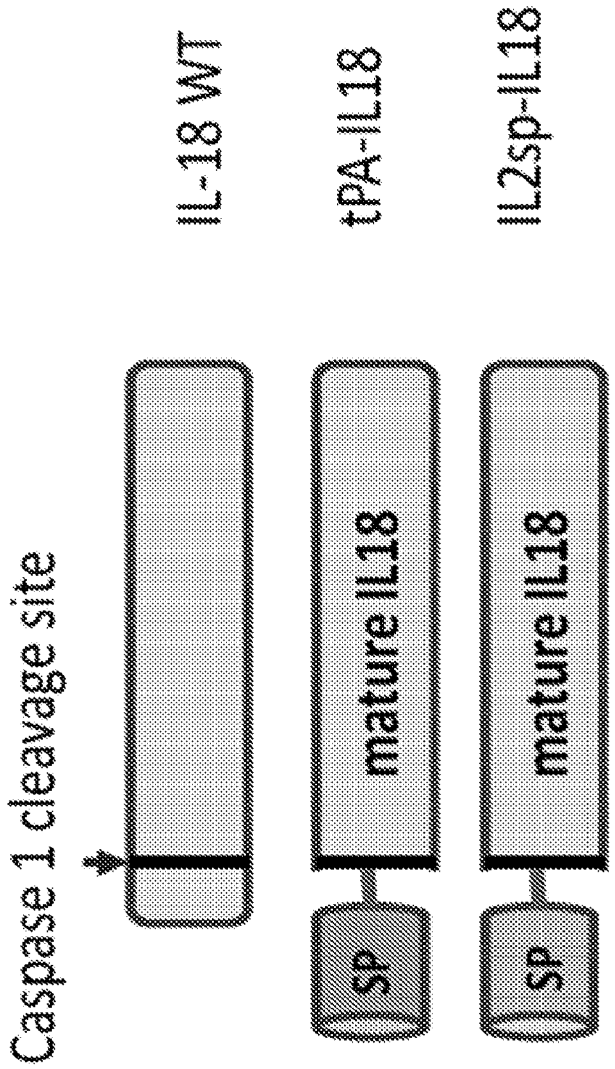

FIG. 73 is a diagram of IL18 polypeptides as used herein. The IL18 WT polypeptide represents the wild-type IL18 pre-polypeptide (SEQ ID NO: 564). The vertical line represents the cleavage site where caspase-1 removes the 35 amino acid signal peptide. The tPA-IL18 polypeptide is a wild-type IL18 mature peptide with a tissue plasminogen activator signal peptide on its N terminus (SEQ ID NO: 572). The IL2sp-IL18 peptide is a wild type IL18 mature peptide with the IL12 signal peptide on its N terminus (SEQ ID NO: 574).

Figure 74A:
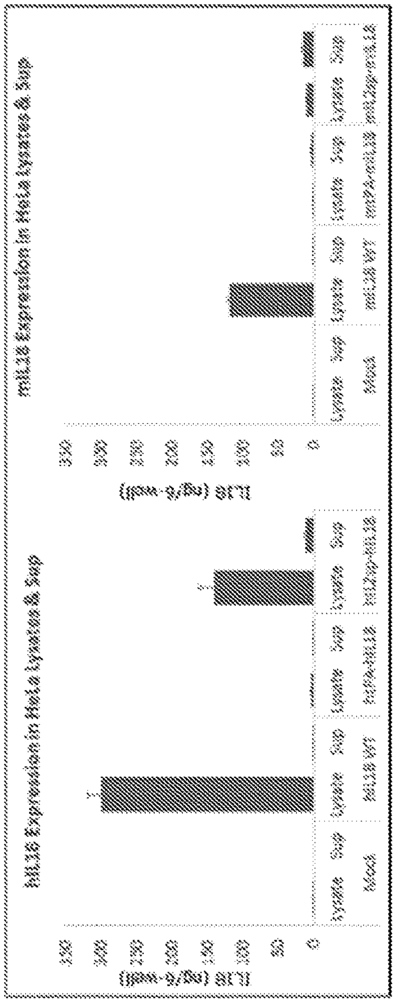

FIG. 74A is a plot showing expression of both human IL18 (hIL18) and mouse IL18 (mIL18) in HeLa cells. Detection of IL18 polypeptides was performed as described in the examples below. Mock represents cells transfected with control mRNA. mRNAs encoding wild type IL18 (IL18 WT), IL18 with the tissue plasminogen activator signal peptide (tPA-IL18) and IL18 with the IL12 signal peptide (IL2sp-IL18) were transfected as indicated. The presence of the IL18 polypeptide in the HeLa cell lysate indicates that the polypeptide was not secreted from the cell while the presence of the IL18 polypeptide in the supernatant indicates that the polypeptide was secreted.

Figure 74B:
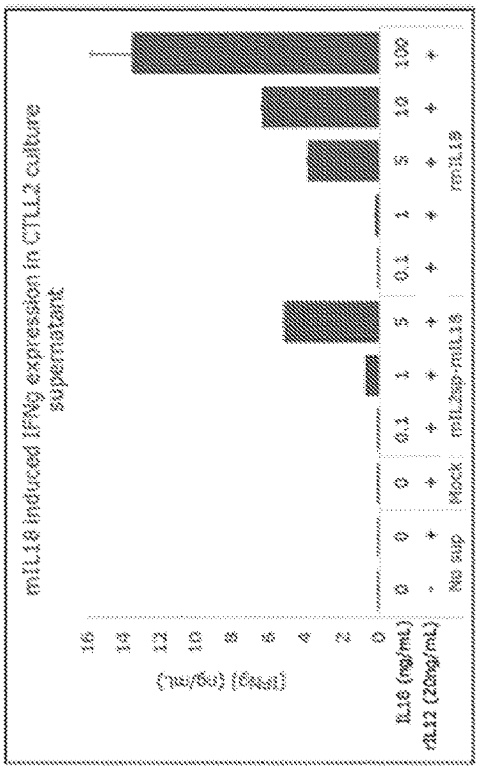

FIG. 74B is a plot showing the bioactivity of both mIL2sp-mIL18 and mIL18 polypeptides when contacted with CTLL2 cells in the presence of IL12. Bioactivity was measured by determining the amount of IFN-γ present in the CTLL2 cell supernatant as described in the examples.

Figure 75A:
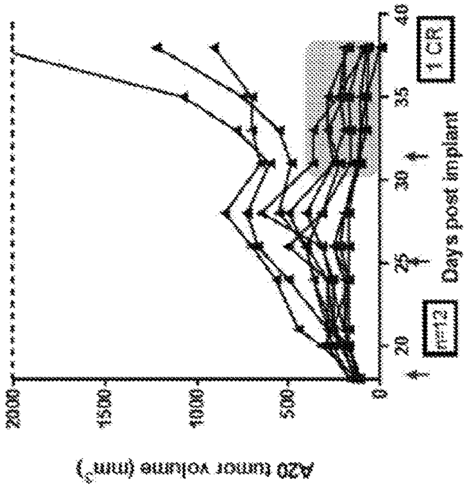
Figure 75B:
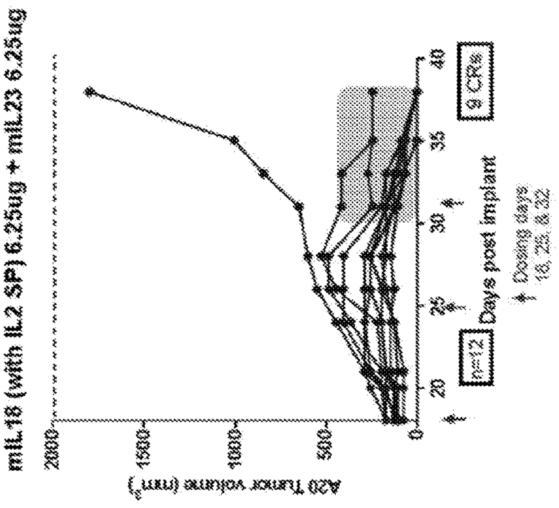

FIG. 75A and FIG. 75B show graphs of the in vivo efficacy of IL23 modified mRNA and IL18 modified mRNA in a B-cell lymphoma model. A20 B cell lymphoma cells were established subcutaneously in BALB/c mice, and subsequently dosed with 12.5·g mRNA on days 18, 25 and 32 after tumor implantation. Mice were dosed with either IL23 mRNA (FIG. 75A) or a mixture of IL23 mRNA and IL18 mRNA (FIG. 75B). The graphs present individual plots for the growth of each tumor over time, starting at day 18 post-implantation.

Figure 76:
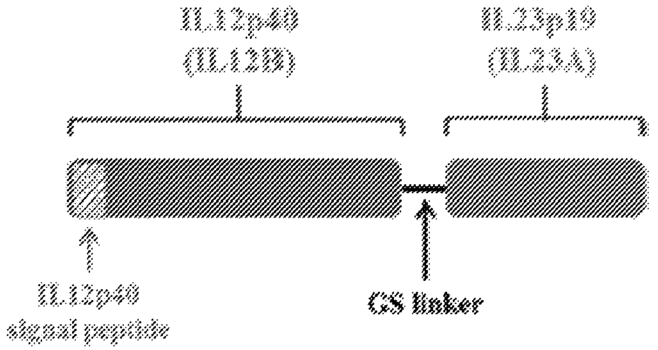

FIG. 76 shows a schematic diagram of a single-chain IL12B-linker (G6S)-IL23A fusion protein comprising an IL12B polypeptide joined at its 3'-end by a GS linker to the 5'-end of an IL23A polypeptide.

Figure 77B:
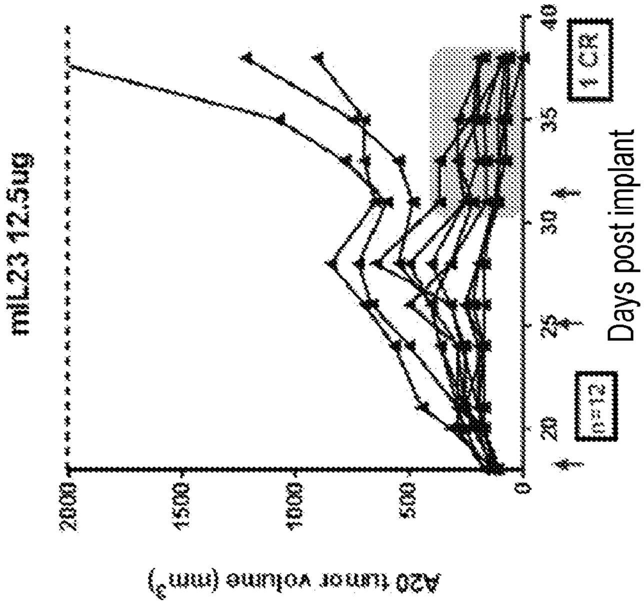
Figure 77A:
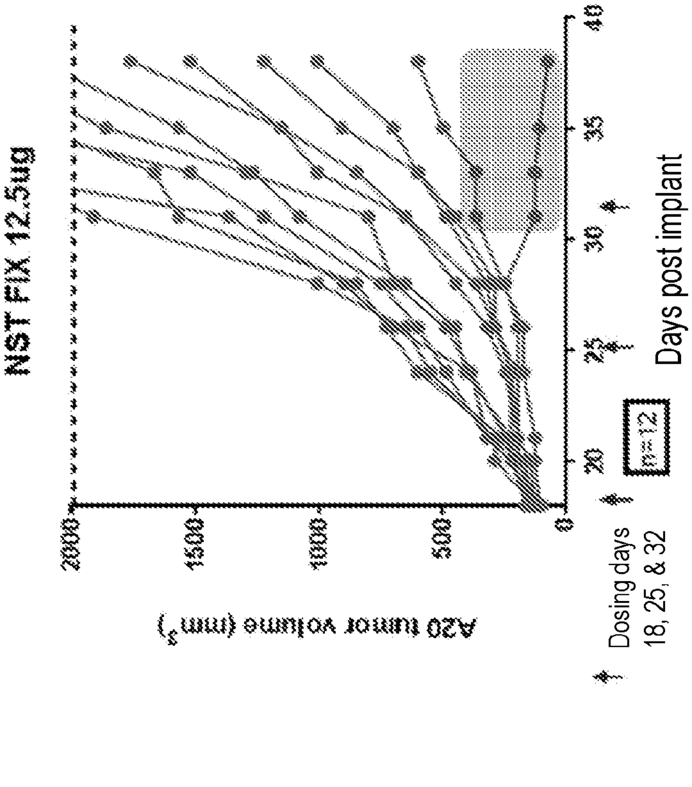

FIG. 77A and FIG. 77B provide graphs of the in vivo efficacy of mIL23 encoding mRNA in a B cell lymphoma model. A20 B cell lymphoma cells were established subcutaneously in BALB/c mice, and subsequently dosed with 12.5·g mRNA on days 18, 25 and 32 after tumor implantation. Mice were dosed with either IL23 mRNA (FIG. 77B) or a control mRNA, i.e., NST FIX (FIG. 77A). The graphs present individual plots for the growth of each tumor over time, starting at day 18 post-implantation.

Figure 78A:
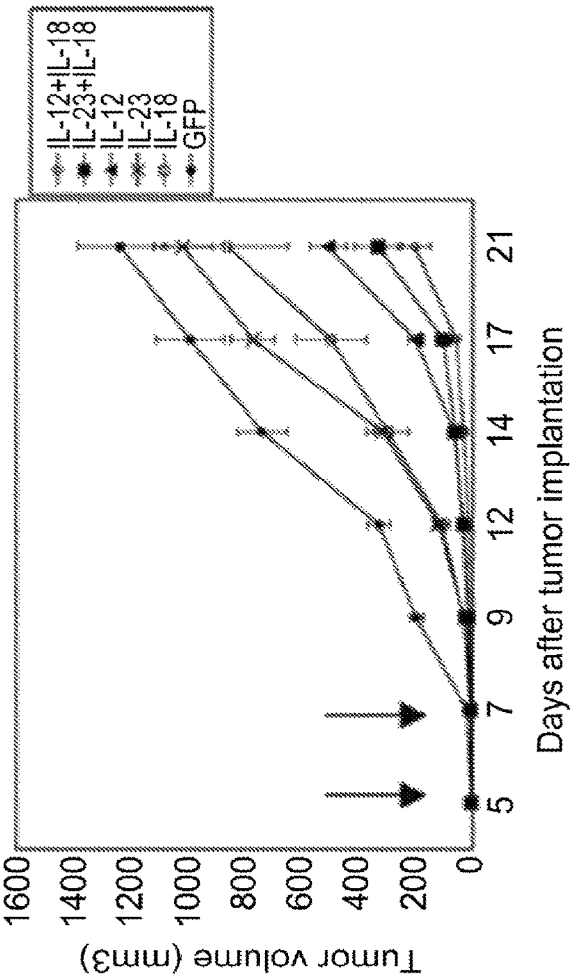
Figure 78B:
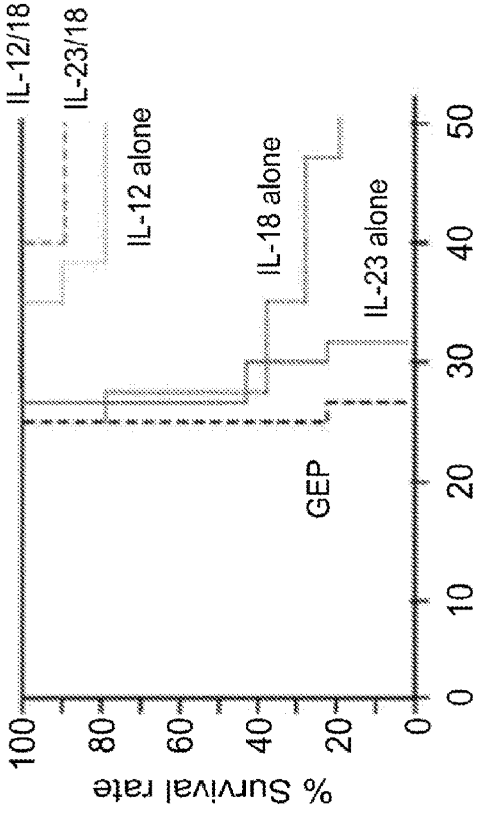

FIG. 78A and FIG. 78B provide graphs showing the effectiveness of interleukins in mouse models of melanoma, as drawn from Wang et al., *J. Dermatological Sci.* 36:66-68 (2004). B16 melanoma cells were established subcutaneously in C57BL/6J mice, and subsequently dosed with plasmid vectors designed to express IL12 (pcDNA-IL12), IL18 (pcDNA-mproIL 18/mice), IL23(pcDNA-IL23), or a GFP control (phGFP-105-C1). FIG. 78A presents the average tumor volume for each group. Final Kaplan-Meier survival curves were prepared and are shown in FIG. 78B.

Figure 79B:
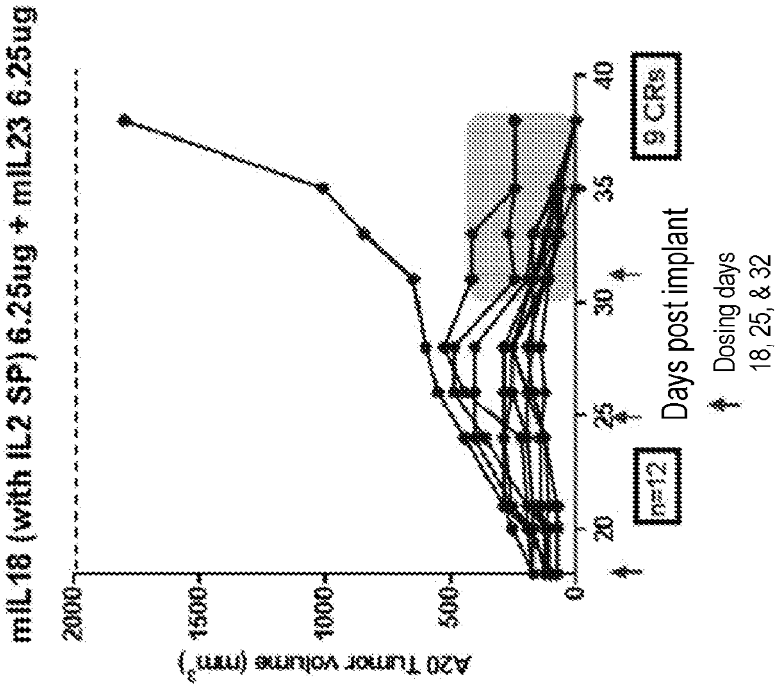
Figure 79A:
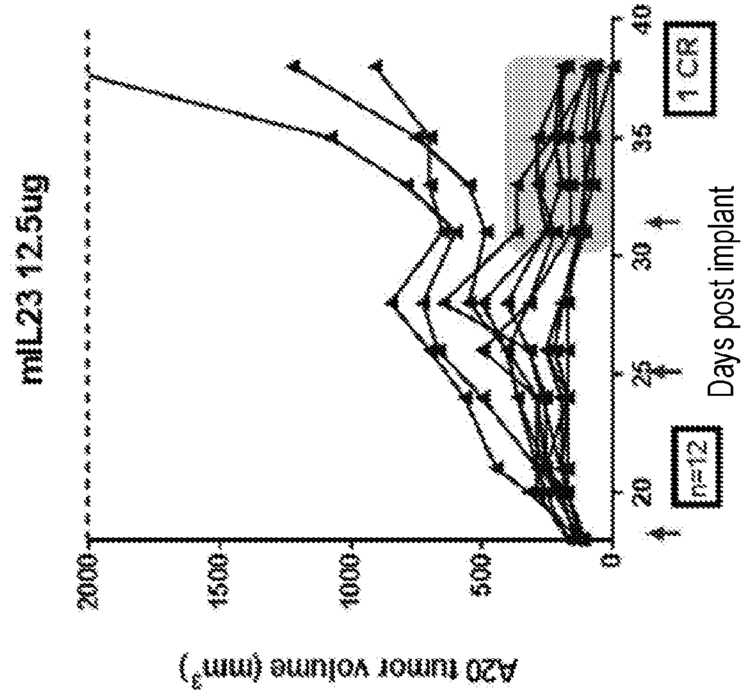

FIG. 79A and FIG. 79B provide graphs of the in vivo efficacy of IL23 encoding mRNA and IL18 encoding mRNA in a B-cell lymphoma model. A20 B cell lymphoma cells were established subcutaneously in BALB/c mice, and subsequently dosed with 12.5·g mRNA on days 18, 25 and 32 after tumor implantation. Mice were dosed with either IL23 mRNA alone (FIG. 79A) or a mixture of IL23 mRNA and IL18 mRNA (FIG. 79B). The graphs present individual plots for the growth of each tumor over time, starting at day 18 post-implantation.

FIGS. 80A to 103A present RNA composition metrics, e.g., (U) metrics, (G) metrics, (C) metrics, (G/C) metrics, and G/C compositional bias for codon positions 1, 2, 3. The columns labeled "U content (%)" correspond to the % $U_{TL}$ parameter. The columns labeled "U Content v. WT (%)" correspond to % $U_{WT}$. The columns labeled "U Content v. Theoretical Minimum (%)" correspond to % $U_{TM}$. The columns labeled "G Content (%)" correspond to % $G_{TL}$. The column labeled "G Content v. WT (%)" correspond to % $G_{WT}$. The columns labeled "G Content v. Theoretical Maximum (%)" correspond to % $G_{TMX}$. The columns labeled "C Content (%)" correspond to % $C_{TL}$. The columns labeled "C Content v. WT (%)" correspond to % $C_{WT}$. The columns labeled "C Content v. Theoretical Maximum (%)" correspond to % $C_{TMX}$. The columns labeled "G/C Content (%)" correspond to % $G/C_{TL}$. The columns labeled "G/C Content v. WT (%)" correspond to % $G/C_{WT}$. The columns labeled "G/C Content v. Theoretical Maximum (%)" correspond to % $G/C_{TMX}$. The statistical descriptors in each table (maximum, minimum, mean, median, and standard deviation) correspond to the population of sequence optimized polynucleotides.

For example, for FIG. 80A, the first row under the "Protein" header would show the construct analyzed ("Treme-LC-VL"), followed by the length of the protein construct in amino acids ("107"), the theoretical minimum U (%) content of an encoding nucleic acid ("11.21%"), the theoretical minimum U (abs) content of an encoding nucleic acid ("36"), and the number of phenylalanine encoding codons ("5"). The first row under the "Nucleic acid header" includes again the name of the construct, its length in nucleobases, and compositional descriptors. The remaining rows provide the distribution of different compositional parameter (maximum, minimum, mean, median, standard deviation) for a population of 25 sequence optimized polynucleotides encoding the specified construct. The same structure use for the rest of composition tables in FIGS. 80A to 103A. The same organization applies to codon bias tables such as FIG. 88A, except that instead of nucleobase composition values, the columns correspond to total GC content in the polynucleotides ("GC') and GC content in the $1^{st}$, $2^{nd}$, and $3^{rd}$ position of each codon in the polynucleotide.

FIG. 80A shows uracil (U) metrics corresponding to the VL domain of the light chain of tremelimumab and 25 sequence optimized polynucleotides corresponding to that domain. FIG. 80B shows guanine (G) metrics corresponding to the VL domain of the light chain of tremelimumab and 25 sequence optimized polynucleotides corresponding to that domain. FIG. 80C shows cytosine (C) metrics corresponding to the VL domain of the light chain of tremelimumab and 25 sequence optimized polynucleotides corresponding to that domain. FIG. 80D shows guanine plus cytosine (G/C) metrics corresponding to the VL domain of the light chain of tremelimumab and 25 sequence optimized polynucleotides corresponding to that domain.

FIG. 81A shows uracil (U) metrics corresponding to the VH domain of the heavy chain of tremelimumab and 50 sequence optimized polynucleotides corresponding to that domain. FIG. 81B shows guanine (G) metrics corresponding to the VH domain of the heavy chain of tremelimumab and 50 sequence optimized polynucleotides corresponding to that domain. FIG. 81C shows cytosine (C) metrics corresponding to the VH domain of the heavy chain of tremelimumab and 50 sequence optimized polynucleotides corresponding to that domain. FIG. 81D shows guanine plus cytosine (G/C) metrics corresponding to the VH domain of the heavy chain of tremelimumab and 50 sequence optimized polynucleotides corresponding to that domain.

FIG. 82A shows uracil (U) metrics corresponding to the VL domain of the light chain of ipilimumab and 25 sequence optimized polynucleotides corresponding to that domain. FIG. 82B shows guanine (G) metrics corresponding to the VL domain of the light chain of ipilimumab and 25 sequence optimized polynucleotides corresponding to that domain. FIG. 82C shows cytosine (C) metrics corresponding the VL domain of the light chain of ipilimumab and 25 sequence optimized polynucleotides corresponding to that domain. FIG. 82D shows guanine plus cytosine (G/C) metrics corresponding the VL domain of the light chain of ipilimumab and 25 sequence optimized polynucleotides corresponding to that domain.

FIG. 83A shows uracil (U) metrics corresponding to the VH domain of the heavy chain of ipilimumab and 25 sequence optimized polynucleotides corresponding to that domain. FIG. 83B shows guanine (G) metrics corresponding to the VH domain of the heavy chain of ipilimumab and 25 sequence optimized polynucleotides corresponding to that domain. FIG. 83C shows cytosine (C) metrics corresponding to the VH domain of the heavy chain of ipilimumab and 25 sequence optimized polynucleotides corresponding to that domain. FIG. 83D shows guanine plus cytosine (G/C) metrics corresponding to the VH domain of the heavy chain of ipilimumab and 25 sequence optimized polynucleotides corresponding to that domain.

FIG. 84A shows uracil (U) metrics corresponding to the constant domain (CL) of the light chain used in tremelimumab and ipilimumab constructs and 25 sequence optimized polynucleotides corresponding to that domain. FIG. 84B shows guanine (G) metrics corresponding the constant domain (CL) of the light chain used in tremelimumab and ipilimumab and 25 sequence optimized polynucleotides corresponding to that domain. FIG. 84C shows cytosine (C) metrics corresponding the constant domain (CL) of the light chain used in tremelimumab and ipilimumab and 25 sequence optimized polynucleotides corresponding to that domain. FIG. 84D shows guanine plus cytosine (G/C) metrics corresponding to the constant domain (CL) of the light chain used in tremelimumab and ipilimumab and 25 sequence optimized polynucleotides corresponding to that domain.

FIG. 85A shows uracil (U) metrics corresponding to the constant region (CH) of the IgG2 heavy chain used in tremelimumab constructs and 25 sequence optimized polynucleotides corresponding to that domain. FIG. 85B shows guanine (G) metrics corresponding to the constant region (CH) of the IgG2 heavy chain used in tremelimumab constructs and 25 sequence optimized polynucleotides corresponding to that domain.

FIG. 85C shows cytosine (C) metrics corresponding to the constant region (CH) of the IgG2 heavy chain used in tremelimumab constructs and 25 sequence optimized polynucleotides corresponding to that domain. FIG. 85D shows guanine plus cytosine (G/C) metrics corresponding to the constant region (CH) of the IgG2 heavy chain used in tremelimumab constructs and 25 sequence optimized polynucleotides corresponding to that domain.

FIG. 86A shows uracil (U) metrics corresponding to the constant region (CH) of the IgG1 heavy chain used in tremelimumab and ipilimumab constructs and 50 sequence optimized polynucleotides corresponding to that domain. FIG. 86B shows guanine (G) metrics corresponding to the constant region (CH) of the IgG1 heavy chain used in tremelimumab and ipilimumab constructs and 50 sequence optimized polynucleotides corresponding to that domain. FIG. 86C shows cytosine (C) metrics corresponding to the constant region (CH) of the IgG1 heavy chain used in tremelimumab and ipilimumab constructs and 50 sequence optimized polynucleotides corresponding to that domain. FIG. 86D shows guanine plus cytosine (G/C) metrics corresponding to the constant region (CH) of the IgG1 heavy chain used in tremelimumab and ipilimumab constructs and 50 sequence optimized polynucleotides corresponding to that domain.

FIGS. 87A and 87B show uracil (U) metrics corresponding to wild type CD80 and 25 sequence optimized CD80 polynucleotides (FIG. 87A) and wild type Fc region and 25 sequence optimized Fc region polynucleotides (FIG. 87B). FIGS. 87C and 87D show guanine (G) metrics corresponding to wild type CD80 and 25 sequence optimized CD80 polynucleotides (FIG. 87C) and wild type Fc region and 25 sequence optimized Fc region polynucleotides (FIG. 87D). FIGS. 87E and 87F shows cytosine (C) metrics corresponding to wild type CD80 and 25 sequence optimized CD80 polynucleotides (FIG. 87E) and wild type Fc region and 25 sequence optimized Fc region polynucleotides (FIG. 87F). FIGS. 87G and 871H shows guanine plus cytosine (G/C) metrics corresponding to wild type CD80 and 25 sequence optimized CD80 polynucleotides (FIG. 87G) and wild type Fc region and 25 sequence optimized Fc region polynucleotides (FIG. 8711).

FIGS. 88A and 88B show a comparison between the G/C compositional bias for codon positions 1, 2, 3 corresponding to the wild type CD80 and 25 sequence optimized CD80 polynucleotides (FIG. 88A) and wild type Fc region and 25 sequence optimized Fc region polynucleotides (FIG. 88B).

FIG. 89A shows uracil (U) metrics corresponding to wild type caTLR4 and 25 sequence optimized caTLR4 polynucleotides. FIG. 89B shows guanine (G) metrics corresponding to wild type caTLR4 and 25 sequence optimized caTLR4 polynucleotides. FIG. 89C shows cytosine (C) metrics corresponding to wild type caTLR4 and 25 sequence optimized caTLR4 polynucleotides. FIG. 89D shows guanine plus cytosine (G/C) metrics corresponding to wild type caTLR4 and 25 sequence optimized caTLR4 polynucleotides.

FIG. 90 show a comparison between the G/C compositional bias for codon positions 1, 2, 3 corresponding to the wild type caTLR4 (TLR4ca-WT row) and 25 sequence optimized caTLR4 polynucleotides (Overall row).

FIG. 91A shows uracil (U) metrics corresponding to wild type IL12B and 20 sequence optimized IL12B polynucleotides (hIL12AB_001 to hIL12AB_020). FIG. 91B shows guanine (G) metrics corresponding to wild type IL12B and 20 sequence optimized IL12B polynucleotides (hIL12AB_001 to hIL12AB_020). FIG. 91C shows cytosine (C) metrics corresponding to wild type IL12B and 20 sequence optimized IL12B polynucleotides (hIL12AB_001 to hIL12AB_020). FIG. 91D shows guanine plus cytosine (G/C) metrics corresponding to wild type IL12B and 20 sequence optimized IL12B polynucleotides (hIL12AB_001 to hIL12AB_020).

FIG. 92A shows uracil (U) metrics corresponding to wild type IL12B and 20 sequence optimized IL12B polynucleotides (hIL12AB_021 to hIL12AB_040). FIG. 92B shows guanine (G) metrics corresponding to wild type IL12B and 20 sequence optimized IL12B polynucleotides (hIL12AB_021 to hIL12AB_040). FIG. 92C shows cytosine (C) metrics corresponding to wild type IL12B and 20 sequence optimized IL12B polynucleotides (hIL12AB_021 to hIL12AB_040). FIG. 92D shows guanine plus cytosine (G/C) metrics corresponding to wild type IL12B and 20 sequence optimized IL12B polynucleotides (hIL12AB_021 to hIL12AB_040).

FIG. 93A shows uracil (U) metrics corresponding to wild type IL12A and 20 sequence optimized IL12A polynucleotides (hIL12AB_001 to hIL12AB_020). FIG. 93B shows guanine (G) metrics corresponding to wild type IL12A and 20 sequence optimized IL12A polynucleotides (hIL12AB_001 to hIL12AB_020). FIG. 93C shows cytosine (C) metrics corresponding to wild type IL12A and 20 sequence optimized IL12A polynucleotides (hIL12AB_001 to hIL12AB_020). FIG. 93D shows guanine plus cytosine (G/C) metrics corresponding to wild type IL12A and 20 sequence optimized IL12A polynucleotides (hIL12AB_001 to hIL12AB_020).

FIG. 94A shows uracil (U) metrics corresponding to wild type IL12A and 20 sequence optimized IL12A polynucleotides (hIL12AB_021 to hIL12AB_040). FIG. 94B shows guanine (G) metrics corresponding to wild type IL12A and 20 sequence optimized IL12A polynucleotides (hIL12AB_021 to hIL12AB_040). FIG. 94C shows cytosine (C) metrics corresponding to wild type IL12A and 20 sequence optimized IL12A polynucleotides (hIL12AB_021 to hIL12AB_040). FIG. 94D shows guanine plus cytosine (G/C) metrics corresponding to wild type IL12A and 20 sequence optimized IL12A polynucleotides (hIL12AB_021 to hIL12AB_040). The column labeled "G/C Content (%)" corresponds to % G/Cm.

FIG. 95A shows a comparison between the G/C compositional bias for codon positions 1, 2, 3 corresponding to the wild type IL12B and 20 sequence optimized IL12B polynucleotides (hIL12AB_001 to hIL12AB_020). FIG. 95B shows a comparison between the G/C compositional bias for codon positions 1, 2, 3 corresponding to the wild type IL12B and 20 sequence optimized IL12B polynucleotides (hIL12AB_021 to hIL12AB_040). FIG. 95C shows a comparison between the G/C compositional bias for codon positions 1, 2, 3 corresponding to the wild type IL12A and 20 sequence optimized IL12A polynucleotides (hIL12AB_0-1 to hIL12AB_020). FIG. 95D shows a comparison between the G/C compositional bias for codon positions 1, 2, 3 corresponding to the wild type IL12A and 20 sequence optimized IL12A polynucleotides (hIL12AB_021 to hIL12AB_040).

FIG. 96A shows uracil (U) metrics corresponding to the wild-type IL15 in IL15opt-tPa6 and 50 sequence optimized IL15opt-tPa6 polynucleotides (IL15opt-tPa6-CO01 to IL15opt-tPa6-CO50). FIG. 96B shows guanine (G) metrics corresponding to the wild-type IL15 in IL15opt-tPa6 and 50 sequence optimized IL15opt-tPa6 polynucleotides (IL15opt-tPa6-CO001 to IL15opt-tPa6-CO50). FIG. 96C shows cytosine (C) metrics corresponding to the wild-type IL15 in IL15opt-tPa6 and 50 sequence optimized IL15opt-tPa6 polynucleotides (IL15opt-tPa6-CO01 to IL5opt-tPa6-CO50). FIG. 96D shows guanine plus cytosine (G/C) metrics corresponding to the wild-type IL5 in IL15opt-tPa6 and 50 sequence optimized IL15opt-tPa6 polynucleotides (IL15opt-tPa6-CO01 to IL15opt-tPa6-CO50). FIG. 96E shows a comparison between the G/C compositional bias for codon positions 1, 2, 3 corresponding to the wild-type IL15 in IL15opt-tPa6 and 50 sequence optimized IL15opt-tPa6 polynucleotides (IL15opt-tPa6-CO01 to IL15opt-tPa6-CO50).

FIG. 97A shows uracil (U) metrics corresponding to the Sushi Domain of wild-type IL15Ra in 25 sequence optimized IL15_RLI (IL15RLI-CO01 to IL15_RLI-CO25) and 25 sequence optimized IL15_Fc_RLI (IL15_Fc RLI-CO01 to IL15_Fc_RLI-CO25) polynucleotides. FIG. 97B shows guanine (G) metrics corresponding to the Sushi Domain of wild-type IL15Ra in 25 sequence optimized IL15_RLI (IL15_RLI-CO01 to IL15_RLI-CO25) and 25 sequence optimized IL15_FcRLI (IL15_Fc_RLI-CO01 to IL15_Fc_RLI-CO25) polynucleotides. FIG. 97C shows cytosine (C) metrics corresponding to the Sushi Domain of wild-type IL15Ra in 25 sequence optimized IL15_RLI (IL15_RLI-CO01 to IL15_RLI-CO25) and 25 sequence optimized IL15 FcRLI (IL15_Fc_RLI-CO01 to IL15_Fc_RLI-CO25) polynucleotides. FIG. 97D shows guanine plus cytosine (G/C) metrics corresponding to the Sushi Domain of wild-type IL15Ra in 25 sequence optimized IL15_RLI (IL15RLI-CO01 to IL15_RLI-CO25) and 25 sequence optimized IL15_Fc_RLI (IL15_Fc_RLI-CO01 to IL15_Fc_RLI-CO25) polynucleotides. FIG. 97E shows a comparison between the G/C compositional bias for codon positions 1, 2, 3 corresponding to the Sushi Domain of wild-type IL15Ra in 25 sequence optimized IL15_RLI (IL15_RLI-CO01 to IL15_RLI-CO25) and 25 sequence optimized IL15_Fc_RLI (IL15_Fc_RLI-CO01 to IL15_Fc_RLI-CO25) polynucleotides.

FIG. 98A shows uracil (U) metrics corresponding to wild-type IL15Ra in IL15Ra_WT_miR122 and 25 sequence optimized IL15Ra_WT_miR122 polynucleotides (IL15Ra_WT_miR122-CO01 to IL15Ra_WT_miR122-CO25). FIG. 98B shows guanine (G) metrics corresponding wild-type IL15Ra in IL15Ra_WT_miR122 and 25 sequence optimized IL15Ra_WT_miR122 polynucleotides (IL15Ra_WT_miR122-CO01 to IL15Ra_WT_miR122-CO25). FIG. 98C shows cytosine (C) metrics corresponding to wild-type IL15Ra in IL15Ra_WT_miR122 and 25 sequence optimized IL15Ra_WT_miR122 polynucleotides (IL15Ra_WT_miR122-CO01 to IL15Ra_WT_miR122-CO25). FIG. 98D shows guanine plus cytosine (G/C) metrics corresponding to wild-type IL15Ra in IL15Ra_WT_miR122 and 25 sequence optimized IL15Ra_WT_miR122 polynucleotides (IL15Ra_WT_miR122-CO01 to IL15Ra_WT_miR122-CO25). FIG. 98E shows a comparison between the G/C compositional bias for codon positions 1, 2, 3 corresponding to wild-type IL15Ra in IL15Ra_WT_miR122 and 25 sequence optimized IL15Ra_WT_miR122 polynucleotides (IL15Ra_WT_miR122-CO01 to IL15Ra_WT_miR122-CO25).

FIG. 99A shows uracil (U) metrics corresponding to wild-type IL15 in 25 IL15-RLI sequence optimized (IL15-RLI-CO01 to IL15-RLI-$CO_{25}$) and 25 IL15-Fc-RLI sequence optimized (IL15_Fc_RLI-CO01 to IL15_Fc_RLI-CO25) polynucleotides. wild-type IL15Rα and 20 sequence optimized IL15Rα polynucleotides (hIL15RαB_021 to hL15RαB_040). FIG. 99B shows guanine (G) metrics corresponding to wild-type IL15 in 25 IL15-RLI sequence optimized (IL15-RLI-CO01 to IL15-RLI-CO25) and 25 IL15-Fc-RLI sequence optimized (IL15_Fc_RLI-CO01 to IL15_Fc_RLI-CO25) polynucleotides. FIG. 99C shows cytosine (C) metrics corresponding to wild-type IL15 in 25 IL15-RLI sequence optimized (IL15-RLI-CO01 to IL15-RLI-CO25) and 25 IL15-Fc-RLI sequence optimized (IL15_Fc_RLI-CO01 to IL15_Fc_RLI-CO25) polynucleotides. FIG. 99D shows guanine plus cytosine (G/C) metrics corresponding to wild-type IL15 in 25 IL15-RLI sequence optimized (IL15-RLI-CO01 to IL15-RLI-$CO_{25}$) and 25 IL15-Fc-RLI sequence optimized (IL15_FcRLI-CO01 to IL15_Fc_RLI-$CO_{25}$) polynucleotides. FIG. 99E shows a comparison between the G/C compositional bias for codon positions 1, 2, 3 corresponding to wild-type IL15 in 25 IL15-RLI sequence optimized (IL15-RLI-CO01 to IL15-RLI-CO25) and 25 IL15-Fc-RLI sequence optimized (IL15_FcRLI-CO01 to IL15_Fc_RLI-CO25).

FIG. 100A shows uracil (U) metrics corresponding to wild-typeIL18 mature peptide with a tissue plasminogen activator (tPA) signal peptide on its N terminus (tPANIL18 wt) and 25 sequence optimized IL18 polynucleotides with tPA signal peptides. FIG. 100B shows guanine (G) metrics corresponding to tPANIL18 wt and 25 sequence optimized IL18 polynucleotides with tPA signal peptides. FIG. 100C shows cytosine (C) metrics corresponding to tPANIL18 wt and 25 sequence optimized IL18 polynucleotides with tPA signal peptides. FIG. 100D shows guanine plus cytosine (G/C) metrics corresponding tPANIL18 wt and 25 sequence optimized IL18 polynucleotides with tPA signal peptides. FIG. 100E shows a comparison between the G/C compositional bias for codon positions 1, 2, 3 corresponding to the tPANIL18 wt and 25 sequence optimized IL18 polynucleotides with tPA signal peptides.

FIG. 101A shows uracil (U) metrics corresponding to wild-typeIL18 mature peptide with an Interleukin-2 signal peptide (IL2sp) on its N terminus (IL2spIL18 wt) and 25 sequence optimizedIL18 polynucleotides with IL2 signal peptides. FIG. 101B shows guanine (G) metrics corresponding to IL2spIL18 wt and 25 sequence optimizedL18 polynucleotides with IL2 signal peptides. FIG. 101C shows cytosine (C) metrics corresponding to IL2spIL18 wt and 25 sequence optimizedL18 polynucleotides with L2 signal peptides. FIG. 101D shows guanine plus cytosine (G/C) metrics corresponding IL2spIL18 wt and 25 sequence optimized IL18 polynucleotides with IL2 signal peptides. FIG. 101E shows a comparison between the G/C compositional bias for codon positions 1, 2, 3 corresponding to the IL2sp IL18 wt and 25 sequence optimizedL18 polynucleotides with IL2 signal peptides.

FIG. 102A shows uracil (U) metrics corresponding to wild-type IL12B and 25 sequence optimized IL12B polynucleotides. FIG. 102B shows guanine (G) metrics corresponding to wild-type IL12B and 25 sequence optimized IL12B polynucleotides. FIG. 102C shows cytosine (C) metrics corresponding to wild-type IL12B and 25 sequence optimized IL12B polynucleotides. FIG. 102D shows guanine plus cytosine (G/C) metrics corresponding to wild-type isoform 1 of IL12 and 25 sequence optimized IL12 polynucleotides. FIG. 102E shows a comparison between the G/C compositional bias for codon positions 1, 2, 3 corresponding to the wild-type IL12B and 25 sequence optimized IL12B polynucleotides.

FIG. 103A shows uracil (U) metrics corresponding to wild-type IL23A and 25 sequence optimized IL23A polynucleotides. FIG. 103B shows guanine (G) metrics corresponding to wild-type IL23A and 25 sequence optimized IL23A polynucleotides. FIG. 103C shows cytosine (C) metrics corresponding to wild-type IL23A and 25 sequence optimized IL23A polynucleotides. FIG. 103D shows guanine plus cytosine (G/C) metrics corresponding to wild-type IL23A and 25 sequence optimized IL23A polynucleotides. FIG. 103E shows a comparison between the G/C compositional bias for codon positions 1, 2, 3 corresponding to the wild-type IL23A and 25 sequence optimized IL23A polynucleotides.

FIG. 104A shows uracil (U) metrics corresponding to wild-type OX40L and 25 sequence optimized OX40L polynucleotides. FIG. 104B shows guanine (G) metrics corresponding to wild-type OX40L and 25 sequence optimized OX40L polynucleotides. FIG. 104C shows cytosine (C) metrics corresponding to wild-type OX40L and 25 sequence optimized OX40L polynucleotides. FIG. 104D shows guanine plus cytosine (G/C) metrics corresponding to wild-type OX40L and 25 sequence optimized OX40L polynucleotides. FIG. 104E shows a comparison between the G/C compositional bias for codon positions 1, 2, 3 corresponding to the wild-type OX40L and 25 sequence optimized OX40L polynucleotides.

FIGS. 105A-105C show the protein sequence (FIG. 105A; SEQ ID NO: 471), table with domain features (FIG. 105B), and nucleic acid sequence (FIG. 105C; SEQ ID NO:472) of CD80 (wtCD80). Isoform 2 of wt CD80 has a substitution of amino acids 234-266 of SEQ ID NO: 471 by a Ser residue, and Isoform 3 of wt CD80 is missing amino acids 141-266 of SEQ ID NO: 471.

FIGS. 106A-106B show a CD80-Fc fusion construct. FIG. 106A shows the protein sequence of the CD80-Fc fusion construct (SEQ ID NO: 473). The signal peptide (e.g., CD80 signal peptide) is italicized; the extracellular (EC) domain of CD80 is underlined; and the Fc region is bolded. FIG. 106B shows the corresponding wild-type nucleotide sequence encoding the CD80-Fc fusion protein (SEQ ID NO:474).

FIGS. 107A-107C show the protein sequence (FIG. 107A; SEQ ID NO:523), table with domain features (FIG.

107B), and nucleic acid sequence (FIG. 107C; SEQ ID NO:524) of isoform 1 of wild type TLR4 (wtTLR4). Isoform 2 of wt TLR4 is missing amino acids 1-40 of SEQ ID NO: 523, and Isoform 3 of wt TLR4 is missing amino acids 1-200 of SEQ ID NO: 523.

FIGS. 108A-108B show a constitutively active TLR4 (caTLR4) construct. FIG. 108A shows the protein sequence (SEQ ID NO:525). The signal peptide (e.g., lysosome-associated membrane glycoprotein 1 (LAMP1) signal peptide) is italicized; the extracellular domain is underlined; the transmembrane domain is bolded; and the cytoplasmic domain has dotted underline. FIG. 108B shows the corresponding wild-type nucleotide sequence (SEQ ID NO:526) encoding the signal peptide of LAMP1 and the caTLR4 polypeptide.

FIG. 109A shows, from top to bottom, (1) the wild-type IL12B amino acid sequence (SEQ ID NO: 1035), (2) the wild-type nucleic acid encoding the wtIL12B (SEQ ID NO: 1036), (3) the wild-type IL12A amino acid sequence (SEQ ID NO:1037), (4) the wild type nucleic acid encoding the wtIL12A (SEQ ID NO:1038), (5) the wild-type IL12B signal peptide amino acid sequence (SEQ ID NO:1039), and (6) the wild-type nucleic acid encoding the wtIL12B signal peptide (SEQ ID NO:1040).

FIG. 109B shows a table correlating amino acid numbering in SEQ ID NOs, nucleotide numbering in SEQ ID NOs, and the 5' UTR, IL12B signal peptide, mature IL12A and IL12B peptides, and linker.

FIG. 110A shows the wild-type IL15Ra amino acid sequence (SEQ ID NO: 808), FIG. 110B shows the wild-type nucleic acid encoding the wild-type IL15Ra (SEQ ID NO:809), FIG. 110C shows the wild-type IL15 amino acid sequence (SEQ ID NO: 810), and FIG. 110D shows the wild-type nucleic acid encoding the wild-type IL15 (SEQ ID NO: 811). The signal peptide of the wild-type IL15Ra (FIG. 110A) and IL15 (FIG. 110C) are italicized. The sushi domain of the wild-type IL15Ra and the propeptide of the wild-type IL15 are underlined in FIG. 110A (double underline) and in FIG. 110C (solid line), respectively. FIG. 110E shows the wild-type IL15-tPA amino acid sequence (SEQ ID NO: 812). In FIG. 110E the signal peptide is italicized and the mature IL15 is represented by a dotted underline. FIG. 110F shows the amino acid sequence for the wild-type Fc-IL15R-IL15 fusion construct (SEQ ID NO: 813). The signal peptide is italicized, the Fc region is shaded, the IL15R polypeptide is double underlined, the linker is bolded, and the IL15 polypeptide is single underlined.

FIGS. 111A-111C show the wild type IL18 protein sequence (FIG. 111A; SEQ ID NO: 564), table with domain features (FIG. 111B), and wild type IL18 nucleic acid sequence (FIG. 111C; SEQ ID NO: 565), (FIG. 111C) of isoform 1 of IL18 (wtIL18).

FIG. 112A-112C show the wild type IL18 protein sequence (FIG. 112A; SEQ ID NO:566), table with domain features (FIG. 112B), and wild type IL18 nucleic acid sequences (FIG. 112C; SEQ ID NO: 567) of isoform 2 of wtIL18. Isoform 2 of wtIL18 is missing amino acids 27-30 of SEQ ID NO: 564.

FIG. 113A shows an amino acid sequence of tPA-IL18 (SEQ ID NO: 572). The signal peptide is underlined, and the mature protein sequence is bolded. FIG. 113B shows a nucleotide sequence of tPA-IL18 (SEQ ID NO: 573). FIG. 113C shows an amino acid sequence of IL2-IL18 (SEQ ID NO: 574). FIG. 113D shows a nucleotide sequence of IL2-IL18 (SEQ ID NO: 575).

FIG. 114A shows an amino acid sequence of IgLC-IL18 (SEQ ID NO: 576). FIG. 114B shows an amino acid sequence of IL-1ra-L18 (SEQ ID NO: 577). FIG. 114C shows an amino acid sequence of IL18 double mutant, which contains amino acid substitutions at D71S and D71N (SEQ ID NO: 578).

FIG. 115A shows the wild-type IL12B amino acid sequence (SEQ ID NO: 979), FIG. 115B shows the wild-type nucleic acid encoding the IL12B polypeptide (SEQ ID NO: 980), FIG. 115C shows the wild-type IL23A amino acid sequence (SEQ ID NO: 981), and FIG. 115D shows the wild-type nucleic acid encoding the IL23A polypeptide (SEQ ID NO: 982). The signal peptides for both the IL12B and IL23A polypeptides are underlined.

FIG. 116A provides the amino acid sequence of IL12B-Linker($G_6S$)-IL23A fusion protein (SEQ ID NO: 983). FIG. 116B provides a table identifying the various domain features of a single-chain IL12B-Linker($G_6S$)-IL23A fusion protein. FIG. 116C provides the nucleic acid sequence encoding the single-chain IL12B-Linker($G_6S$)-IL23A fusion protein (SEQ ID NO: 984).

DETAILED DESCRIPTION

A particularly exciting approach to treating cancer involves the prevention or treatment of disease with substances that stimulate the immune response, known as cancer immunotherapy. Cancer immunotherapy, also referred in the art as immuno-oncology, has began to revolutionize cancer treatment, by introducing therapies that target not the tumor, but the host immune system. These therapies possess unique pharmacological response profiles, and thus represent therapies that might cure distinct types of cancer. Cancers of the lungs, kidney, bladder and skin are among those that derive substantial efficacy from treatment with immuno-oncology in terms of survival or tumor response, with melanoma possibly showing the greatest benefits. Cancer immunotherapy often features checkpoint inhibitor treatment with an exciting new class of biologic drugs known as checkpoint inhibitor antibodies.

The present disclosure provides compositions and methods for the treatment of cancer, in particular, cancer immunotherapeutic combinations and cancer immunotherapeutic methods. In particular, the disclosure relates the compositions and methods for the treatment of cancer using a combination approach that features mRNAs encoding at least two polypeptides capable of promoting or enhancing an immune response against the tumor. Without being bound in theory, it is believed that priming of an anti-cancer immune response is possible by administering, e.g., a first polynucleotide (e.g., an mRNA) comprising an open reading frame encoding a first protein (e.g., IL12 or IL23) which is important in the stimulation of, for example, T-cells, or natural killer cells. Such priming compound can be administered, for example, in combination with a second polynucleotide (e.g., an mRNA) comprising an open reading frame encoding a second protein (e.g., OXL) which provides a second stimulation signal (i.e., a co-stimulatory signal), therefore amplifying the immune response elicited by the primer. The combination can further comprise a third component, for example, a third polynucleotide (e.g., an mRNA) comprising an open reading frame encoding a third protein (e.g., an anti-CTLA-4) which blocks or inhibits a checkpoint in the immune system (e.g., CTLA-4 or PD-1). The inhibition of the checkpoint would further amplify the immune response.

In some embodiments, the immuno therapeutic compositions and methods disclosed herein can enhance an immune response, and/or to trigger or enhance anti-cancer memory.

Preferred aspects of the disclosure feature treatment with at least two polynucleotides (e.g., mRNAs) are selected from the group consisting of (i) a polynucleotide (e.g., an mRNA) comprising an open reading frame (ORF) encoding an immune response primer polypeptide (e.g., an IL12 or IL23 polypeptide); (ii) a polynucleotide (e.g., mRNAs) comprising an ORF encoding an immune response co-stimulatory signal polypeptide (e.g., an OX40L polypeptide); (iii) a polynucleotide (e.g., mRNAs) comprising an ORF encoding a checkpoint inhibitor polypeptide or a checkpoint inhibitor polypeptide (e.g., and anti-CTLA-4 antibody); and, (iv) a combination thereof.

Exemplary aspects feature treatment with the combinations or mRNA described above (i.e., mRNAs encoding immune response primer polypeptides, immune response co-stimulatory signal polypeptides, checkpoint inhibitor polypeptides, or combinations thereof) encapsulated in lipid nanoparticles (LNP). In some exemplary aspects, these LNPs are cationic lipid-based LNPs, which can be administered, e.g., intratumorally.

Thus, the present disclosure is directed, e.g., to compositions, pharmaceutical formulations comprising such compositions, and methods of treatment of cancer (e.g., methods of reducing or decreasing the size of a tumor or inhibiting growth of a tumor in a subject in need thereof) comprising administering the compositions or formulations disclosed herein to a subject in need thereof. In particular, the present disclosure provides method of treatment of cancer (e.g., tumors) comprising administering to a subject in need thereof an effective amount of a combination of mRNAs encoding, e.g., an immune response primer polypeptide, an immune response co-stimulatory signal polypeptide, a checkpoint inhibitor polypeptide, or a combination thereof. In some specific embodiments, the mRNAs in the therapies disclosed herein are encapsulated in LNPs comprising an ionizable amino lipid of Formula (I) as disclosed below, e.g., Compounds 18, 25, 26 or 48.

The headings provided herein are not limitations of the various aspects or aspects of the disclosure, which can be defined by reference to the specification as a whole. Accordingly, the terms defined immediately below are more fully defined by reference to the specification in its entirety. Before describing the present disclosure in detail, it is to be understood that this disclosure is not limited to specific compositions or process steps, as such can vary.

I. DEFINITIONS

In order that the present disclosure can be more readily understood, certain terms are first defined. As used in this application, except as otherwise expressly provided herein, each of the following terms shall have the meaning set forth below. Additional definitions are set forth throughout the application.

The present disclosure includes embodiments in which exactly one member of the group is present in, employed in, or otherwise relevant to a given product or process. The present disclosure includes embodiments in which more than one, or all of the group members are present in, employed in, or otherwise relevant to a given product or process.

In this specification and the appended claims, the singular forms “a”, “an” and “the” include plural referents unless the context clearly dictates otherwise. The terms “a” (or “an”), as well as the terms “one or more,” and “at least one” can be used interchangeably herein. In certain aspects, the term “a” or “an” means “single.” In other aspects, the term “a” or “an” includes “two or more” or “multiple.”

Furthermore, “and/or” where used herein is to be taken as specific disclosure of each of the two specified features or components with or without the other. Thus, the term “and/or” as used in a phrase such as “A and/or B” herein is intended to include “A and B,” “A or B,” “A” (alone), and “B” (alone). Likewise, the term “and/or” as used in a phrase such as “A, B, and/or C” is intended to encompass each of the following aspects: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Wherever aspects are described herein with the language “comprising,” otherwise analogous aspects described in terms of “consisting of” and/or “consisting essentially of” are also provided.

Units, prefixes, and symbols are denoted in their Système International de Unites (SI) accepted form. Numeric ranges are inclusive of the numbers defining the range. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the present disclosure. Where a value is explicitly recited, it is to be understood that values which are about the same quantity or amount as the recited value are also within the scope of the present disclosure. Where a combination is disclosed, each subcombination of the elements of that combination is also specifically disclosed and is within the scope of the present disclosure. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Nucleotides are referred to by their commonly accepted single-letter codes. Unless otherwise indicated, nucleic acids are written left to right in 5' to 3' orientation. Nucleotides are referred to herein by their commonly known one-letter symbols recommended by the IUPAC-IUB Biochemical Nomenclature Commission. Accordingly, A represents adenine, C represents cytosine, G represents guanine, T represents thymine, U represents uracil.

Amino acids are referred to herein by either their commonly known three letter symbols or by the one-letter symbols recommended by the IUPAC-IUB Biochemical Nomenclature Commission. Unless otherwise indicated, amino acid sequences are written left to right in amino to carboxy orientation.

About: The term "about" as used in connection with a numerical value throughout the specification and the claims denotes an interval of accuracy, familiar and acceptable to a person skilled in the art. In general, such interval of accuracy is ±10%.

Where ranges are given, endpoints are included. Furthermore, unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

Administered in combination: As used herein, the term "administered in combination" or "combined administration" means that two or more agents (e.g., mRNAs) are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved. In some embodiments, the administration in combination can be concurrent (i.e., all the mRNAs are administered as part of a single formulation, or different mRNAs in different formulation are administered simultaneous), or consecutive (e.g., several mRNAs in several formulations are administered consecutively).

Amino acid substitution: The term "amino acid substitution" refers to replacing an amino acid residue present in a parent sequence (e.g., a consensus sequence) with another amino acid residue. An amino acid can be substituted in a parent sequence, for example, via chemical peptide synthesis or through recombinant methods known in the art. Accordingly, a reference to a "substitution at position X" refers to the substitution of an amino acid present at position X with an alternative amino acid residue. In some aspects, substitution patterns can be described according to the schema AnY, wherein A is the single letter code corresponding to the amino acid naturally or originally present at position n, and Y is the substituting amino acid residue. In other aspects, substitution patterns can be described according to the schema An(YZ), wherein A is the single letter code corresponding to the amino acid residue substituting the amino acid naturally or originally present at position X, and Y and Z are alternative substituting amino acid residue.

In the context of the present disclosure, substitutions (even when they referred to as amino acid substitution) are conducted at the nucleic acid level, i.e., substituting an amino acid residue with an alternative amino acid residue is conducted by substituting the codon encoding the first amino acid with a codon encoding the second amino acid.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately," as applied to one or more values of interest, refers to a value that is similar to a stated reference value. In certain embodiments, the term "approximately" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein with respect to a disease, the term "associated with" means that the symptom, measurement, characteristic, or status in question is linked to the diagnosis, development, presence, or progression of that disease. As association may, but need not, be causatively linked to the disease. For example, symptoms, sequelae, or any effects causing a decrease in the quality of life of a patient of cancer are considered associated with cancer and in some embodiments of the present disclosure can be treated, ameliorated, or prevented by administering the polynucleotides of the present disclosure to a subject in need thereof.

When used with respect to two or more moieties, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety that is capable of or maintains at least two functions. The functions may affect the same outcome or a different outcome. The structure that produces the function can be the same or different. For example, a bifunctional modified RNA of the present disclosure may comprise an sequence encoding an CD80 polypeptide (a first function) which would be therapeutically active, linked to a sequence encoding an Fc (a second function) which would be capable of extending the half-life of the RNA. In this example, delivery of the bifunctional modified RNA to a subject in need thereof would produce not only a peptide or protein molecule that may ameliorate or treat the disease or conditions, but would also maintain a population of the active molecule encoded by the mRNA present in the subject for a prolonged period of time. In other aspects, a bifunctional modified mRNA can be a chimeric molecule comprising, for example, an mRNA encoding an IL15 polypeptide (a first function), which would be therapeutically active, and also encoding a second polypeptide such as IL15Ralpha (a second function) either fused to first polypeptide or co-expressed with the first polypeptide.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present disclosure can be considered biologically active if even a portion of the polynucleotide is biologically active or mimics an activity considered biologically relevant.

Chimera: As used herein, "chimera" is an entity having two or more incongruous or heterogeneous parts or regions. For example, a chimeric molecule can comprise a first part comprising an IL12B polypeptide, an IL23A polypeptide, or both IL12B and IL23A polypeptides, and a second part (e.g., genetically fused to the first part) comprising a second therapeutic protein (e.g., a protein with a distinct enzymatic activity, an antigen binding moiety, or a moiety capable of extending the plasma half life of IL12B and/or IL23A polypeptide, for example, an Fc region of an antibody).

Codon substitution: The terms "codon substitution" or "codon replacement" in the context of codon optimization refer to replacing a codon present in a candidate nucleotide sequence (e.g., an mRNA encoding the heavy chain or light chain of an antibody or a fragment thereof) with another codon. A codon can be substituted in a candidate nucleic acid sequence, for example, via chemical peptide synthesis or through recombinant methods known in the art. Accordingly, references to a "substitution" or "replacement" at a certain location in a nucleic acid sequence (e.g., an mRNA) or within a certain region or subsequence of a nucleic acid sequence (e.g., an mRNA) refer to the substitution of a codon at such location or region with an alternative codon.

A candidate nucleic acid sequence can be codon-optimized by replacing all or part of its codons according to a substitution table map. As used herein, the terms "candidate nucleic acid sequence" and "candidate nucleotide sequence" refer to a nucleotide sequence (e.g., a nucleotide sequence encoding an antibody or a functional fragment thereof) that can be codon-optimized, for example, to improve its translation efficacy. In some aspects, the candidate nucleotide sequence is optimized for improved translation efficacy after in vivo administration.

As used herein, the terms "coding region" and "region encoding" and grammatical variants thereof, refer to an Open Reading Frame (ORF) in a polynucleotide that upon expression yields a polypeptide or protein.

Combination therapy: As used herein, the term "combination therapy" as well as variants such as a "therapy administered in combination" or "combined administration," means that two or more agents are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Compound: As used herein, the term "compound," is meant to include all stereoisomers and isotopes of the structure depicted. As used herein, the term "stereoisomer" means any geometric isomer (e.g., cis- and trans-isomer), enantiomer, or diastereomer of a compound. The present disclosure encompasses any and all stereoisomers of the compounds described herein, including stereomerically pure forms (e.g., geometrically pure, enantiomerically pure, or diastereomerically pure) and enantiomeric and stereoisomeric mixtures, e.g., racemates. Enantiomeric and stereomeric mixtures of compounds and means of resolving them into their component enantiomers or stereoisomers are well-known. "Isotopes" refers to atoms having the same atomic number but different mass numbers resulting from a different number of neutrons in the nuclei. For example, isotopes of hydrogen include tritium and deuterium. Further, a compound, salt, or complex of the present disclosure can be prepared in combination with solvent or water molecules to form solvates and hydrates by routine methods.

Conservative amino acid substitution: A "conservative amino acid substitution" is one in which the amino acid residue is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. In another aspect, a string of amino acids can be conservatively replaced with a structurally similar string that differs in order and/or composition of side chain family members.

Non-conservative amino acid substitution: Non-conservative amino acid substitutions include those in which (i) a residue having an electropositive side chain (e.g., Arg, His or Lys) is substituted for, or by, an electronegative residue (e.g., Glu or Asp), (ii) a hydrophilic residue (e.g., Ser or Thr) is substituted for, or by, a hydrophobic residue (e.g., Ala, Leu, Ile, Phe or Val), (iii) a cysteine or proline is substituted for, or by, any other residue, or (iv) a residue having a bulky hydrophobic or aromatic side chain (e.g., Val, His, Ile or Trp) is substituted for, or by, one having a smaller side chain (e.g., Ala or Ser) or no side chain (e.g., Gly).

Other amino acid substitutions can be readily identified by workers of ordinary skill. For example, for the amino acid alanine, a substitution can be taken from any one of D-alanine, glycine, beta-alanine, L-cysteine and D-cysteine. For lysine, a replacement can be any one of D-lysine, arginine, D-arginine, homo-arginine, methionine, D-methionine, ornithine, or D-ornithine. Generally, substitutions in functionally important regions that can be expected to induce changes in the properties of isolated polypeptides are those in which (i) a polar residue, e.g., serine or threonine, is substituted for (or by) a hydrophobic residue, e.g., leucine, isoleucine, phenylalanine, or alanine; (ii) a cysteine residue is substituted for (or by) any other residue; (iii) a residue having an electropositive side chain, e.g., lysine, arginine or histidine, is substituted for (or by) a residue having an electronegative side chain, e.g., glutamic acid or aspartic acid; or (iv) a residue having a bulky side chain, e.g., phenylalanine, is substituted for (or by) one not having such a side chain, e.g., glycine. The likelihood that one of the foregoing non-conservative substitutions can alter functional properties of the protein is also correlated to the position of the substitution with respect to functionally important regions of the protein: some non-conservative substitutions can accordingly have little or no effect on biological properties.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an polynucleotide or polypeptide or may apply to a portion, region or feature thereof.

Contacting: As used herein, the term "contacting" means establishing a physical connection between two or more entities. For example, contacting a mammalian cell with a nanoparticle composition means that the mammalian cell and a nanoparticle are made to share a physical connection. Methods of contacting cells with external entities both in vivo and ex vivo are well known in the biological arts. For example, contacting a nanoparticle composition and a mammalian cell disposed within a mammal may be performed by varied routes of administration (e.g., intravenous, intramuscular, intradermal, and subcutaneous) and may involve varied amounts of nanoparticle compositions. Moreover, more than one mammalian cell may be contacted by a nanoparticle composition.

Controlled Release: As used herein, the term "controlled release" refers to a pharmaceutical composition or compound release profile that conforms to a particular pattern of release to effect a therapeutic outcome.

Covalent Derivative: The term "covalent derivative" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present disclosure can be single units or multimers or comprise one or more components of a complex or higher order structure.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivering: As used herein, the term "delivering" means providing an entity to a destination. For example, delivering a polynucleotide to a subject may involve administering a nanoparticle composition including the polynucleotide to the subject (e.g., by an intravenous, intramuscular, intradermal, or subcutaneous route). Administration of a nanoparticle composition to a mammal or mammalian cell may involve contacting one or more cells with the nanoparticle composition.

Delivery Agent: As used herein, "delivery agent" refers to any substance that facilitates, at least in part, the in vivo, in vitro, or ex vivo delivery of a polynucleotide to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties that are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels can be located at any position in the polynucleotides (e.g., mRNAs) disclosed herein, and used for example, to determine tissue distribution, metabolisation, biological stability, excretion, etc.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Domain: As used herein, when referring to polypeptides, the term "domain" refers to a motif of a polypeptide having one or more identifiable structural or functional characteristics or properties (e.g., binding capacity, serving as a site for protein-protein interactions). As used herein, the term domain also encompasses the nucleic acid sequence (e.g., an mRNA sequence) encoding the polypeptide domain.

Dosing regimen: As used herein, a "dosing regimen" or a "dosing regimen" is a schedule of administration or physician determined regimen of treatment, prophylaxis, or palliative care.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats a tumor, an effective amount of an agent is, for example, an amount sufficient to reduce or decrease a size of a tumor or to inhibit a tumor growth, as compared to the response obtained without administration of the agent. The term "effective amount" can be used interchangeably with "effective dose," "therapeutically effective amount," or "therapeutically effective dose."

Enantiomer: As used herein, the term “enantiomer” means each individual optically active form of a compound of the disclosure, having an optical purity or enantiomeric excess (as determined by methods standard in the art) of at least 80% (i.e., at least 90% of one enantiomer and at most 10% of the other enantiomer), at least 90%, or at least 98%.

Encapsulate: As used herein, the term “encapsulate” means to enclose, surround or encase.

Encapsulation efficiency: As used herein, “encapsulation efficiency” refers to the amount of a polynucleotide that becomes part of a nanoparticle composition, relative to the initial total amount of polynucleotide used in the preparation of a nanoparticle composition. For example, if 97 mg of polynucleotide are encapsulated in a nanoparticle composition out of a total 100 mg of polynucleotide initially provided to the composition, the encapsulation efficiency may be given as 97%. As used herein, “encapsulation” may refer to complete, substantial, or partial enclosure, confinement, surrounding, or encasement.

Encoded protein cleavage signal: As used herein, “encoded protein cleavage signal” refers to the nucleotide sequence that encodes a protein cleavage signal.

Engineered: As used herein, embodiments of the disclosure are “engineered” when they are designed to have a feature or property, whether structural or chemical, that varies from a starting point, wild type or native molecule.

Enhanced Delivery: As used herein, the term “enhanced delivery” means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to the level of delivery of a polynucleotide by a control nanoparticle to a target tissue of interest (e.g., MC3, KC2, or DLinDMA). The level of delivery of a nanoparticle to a particular tissue may be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. It will be understood that the enhanced delivery of a nanoparticle to a target tissue need not be determined in a subject being treated, it may be determined in a surrogate such as an animal model (e.g., a rat model).

Exosome: As used herein, “exosome” is a vesicle secreted by mammalian cells or a complex involved in RNA degradation.

Expression: As used herein, “expression” of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein. The term “protein expression” (and related terms such as “expressed protein”) specifically refers to the translation of an RNA into a polypeptide or protein.

Ex Vivo: As used herein, the term “ex vivo” refers to events that occur outside of an organism (e.g., animal, plant, or microbe or cell or tissue thereof). Ex vivo events may take place in an environment minimally altered from a natural (e.g., in vivo) environment.

Feature: As used herein, a “feature” refers to a characteristic, a property, or a distinctive element. When referring to polypeptides, “features” are defined as distinct amino acid sequence-based components of a molecule. Features of the polypeptides encoded by the polynucleotides of the present disclosure include surface manifestations, local conformational shape, folds, loops, half-loops, domains, half-domains, sites, termini or any combination thereof.

Formulation: As used herein, a “formulation” includes at least a polynucleotide and one or more of a carrier, an excipient, and a delivery agent.

Fragment: A “fragment,” as used herein, refers to a portion. For example, fragments of proteins can comprise polypeptides obtained by digesting full-length protein isolated from cultured cells. In some embodiments, a fragment is a subsequences of a full-length protein (e.g., one of the subunits of IL23) wherein N-terminal, and/or C-terminal, and/or internal subsequences have been deleted. In some preferred aspects of the present disclosure, the fragments of a protein of the present disclosure are functional fragments.

Functional: As used herein, a “functional” biological molecule is a biological molecule in a form in which it exhibits a property and/or activity by which it is characterized. Thus, a “functional fragment” of a polynucleotide of the present disclosure is, e.g., a polynucleotide capable of expressing a functional polypeptide, such as an interleukin fragment. As used herein, a “functional fragment” of an biological molecule, e.g., an interleukin, refers to a fragment of a wild type molecule, e.g., a wild type interleukin (i.e., a fragment of a naturally occurring form of the interleukin), or a mutant or variant thereof, wherein the fragment retains a least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95% of the biological activity of the corresponding full-length protein.

Helper Lipid: As used herein, the term “helper lipid” refers to a compound or molecule that includes a lipidic moiety (for insertion into a lipid layer, e.g., lipid bilayer) and a polar moiety (for interaction with physiologic solution at the surface of the lipid layer). Typically the helper lipid is a phospholipid. A function of the helper lipid is to “complement” the amino lipid and increase the fusogenicity of the bilayer and/or to help facilitate endosomal escape, e.g., of nucleic acid delivered to cells. Helper lipids are also believed to be a key structural component to the surface of the LNP.

Homology: As used herein, the term “homology” refers to the overall relatedness between polymeric molecules, e.g. between nucleic acid molecules (e.g. DNA molecules and/or RNA molecules) and/or between polypeptide molecules. In some embodiments, polymeric molecules are considered to be “homologous” to one another if their sequences are at least 25%, 30%, 35%, 40%, 45%, 50%, 55%, 60%, 65%, 70%, 75%, 80%, 85%, 90%, 95%, or 99% identical or similar. The term “homologous” necessarily refers to a comparison between at least two sequences (polynucleotide or polypeptide sequences). In accordance with the disclosure, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the disclosure, two protein sequences are considered to be homologous if the proteins are at least about 50%, 60%, 70%, 80%, or 90% identical for at least one stretch of at least about 20 amino acids.

Identity: As used herein, the term "identity" refers to the overall monomer conservation between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. When comparing DNA and RNA, thymine (T) and uracil (U) can be considered equivalent.

Suitable software programs are available from various sources, and for alignment of both protein and nucleotide sequences. One suitable program to determine percent sequence identity is bl2seq, part of the BLAST suite of program available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Sequence alignments can be conducted using methods known in the art such as MAFFT, Clustal (ClustalW, Clustal X or Clustal Omega), MUSCLE, etc. Unless otherwise specified, the percentage of identity values disclosed in the present application are obtained by using the implementation of MAFFT (Multiple Alignment using Fast Fourier Transform) version 7 available at the European Bioinformatics Institute (www.ebi.ac.uk/Tools/msa/mafft/with default parameters.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

In certain aspects, the percentage identity "% ID" of a first amino acid sequence (or nucleic acid sequence) to a second amino acid sequence (or nucleic acid sequence) is calculated as % ID=100×(Y/Z), where Y is the number of amino acid residues (or nucleobases) scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be higher than the percent identity of the second sequence to the first sequence.

One skilled in the art will appreciate that the generation of a sequence alignment for the calculation of a percent sequence identity is not limited to binary sequence-sequence comparisons exclusively driven by primary sequence data. It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculate percent sequence identity can be curated either automatically or manually.

Immune response: The term "immune response" refers to the action of, for example, lymphocytes, antigen presenting cells, phagocytic cells, granulocytes, and soluble macromolecules produced by the above cells or the liver (including antibodies, cytokines, and complement) that results in selective damage to, destruction of, or elimination from the human body of invading pathogens, cells or tissues infected with pathogens, cancerous cells, or, in cases of autoimmunity or pathological inflammation, normal human cells or tissues.

Inflammatory response: "Inflammatory response" refers to immune responses involving specific and non-specific defense systems. A specific defense system reaction is a specific immune system reaction to an antigen. Examples of specific defense system reactions include antibody responses. A non-specific defense system reaction is an inflammatory response mediated by leukocytes generally incapable of immunological memory, e.g., macrophages, eosinophils and neutrophils. In some aspects, an immune response includes the secretion of inflammatory cytokines, resulting in elevated inflammatory cytokine levels.

Inflammatory cytokines: The term "inflammatory cytokine" refers to cytokines that are elevated in an inflammatory response. Examples of inflammatory cytokines include interleukin-6 (IL-6), CXCL1 (chemokine (C—X—C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-12 (IL12), interleukin-13 (IL-13), interferon α (IFN-α), etc.

In Vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In Vivo: As used herein, the term "in vivo" refers to events that occur within an organism (e.g., animal, plant, or microbe or cell or tissue thereof).

Insertional and deletional variants: "Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid. "Deletional variants" when referring to polypeptides are those with one or more amino acids in the native or starting amino acid sequence removed. Ordinarily, deletional variants will have one or more amino acids deleted in a particular region of the molecule.

Intact: As used herein, in the context of a polypeptide, the term "intact" means retaining an amino acid corresponding to the wild type protein, e.g., not mutating or substituting the wild type amino acid. Conversely, in the context of a nucleic acid, the term "intact" means retaining a nucleobase corresponding to the wild type nucleic acid, e.g., not mutating or substituting the wild type nucleobase.

Ionizable amino lipid: The term "ionizable amino lipid" includes those lipids having one, two, three, or more fatty acid or fatty alkyl chains and a pH-titratable amino head group (e.g., an alkylamino or dialkylamino head group). An ionizable amino lipid is typically protonated (i.e., positively charged) at a pH below the pKa of the amino head group and is substantially not charged at a pH above the pKa. Such ionizable amino lipids include, but are not limited to DLin-MC3-DMA (MC3) and (13Z,165Z)—N,N-dimethyl-3-nonydocosa-13-16-dien-1-amine (L608).

Isolated: As used herein, the term "isolated" refers to a substance or entity that has been separated from at least some of the components with which it was associated (whether in nature or in an experimental setting). Isolated substances (e.g., nucleotide sequence or protein sequence) can have varying levels of purity in reference to the substances from which they have been associated. Isolated substances and/or entities can be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

The term "substantially isolated" means that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof.

A polynucleotide, vector, polypeptide, cell, or any composition disclosed herein which is "isolated" is a polynucleotide, vector, polypeptide, cell, or composition which is in a form not found in nature. Isolated polynucleotides, vectors, polypeptides, or compositions include those which have been purified to a degree that they are no longer in a form in which they are found in nature. In some aspects, a polynucleotide, vector, polypeptide, or composition which is isolated is substantially pure.

Isomer: As used herein, the term "isomer" means any tautomer, stereoisomer, enantiomer, or diastereomer of any compound of the disclosure. It is recognized that the compounds of the disclosure can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the disclosure, the chemical structures depicted herein, and therefore the compounds of the disclosure, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the disclosure can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker can be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Methods of Administration: As used herein, "methods of administration" may include intravenous, intramuscular, intradermal, subcutaneous, or other methods of delivering a composition to a subject. A method of administration may be selected to target delivery (e.g., to specifically deliver) to a specific region or system of a body.

Modified: As used herein "modified" refers to a changed state or structure of a molecule of the disclosure. Molecules can be modified in many ways including chemically, structurally, and functionally. In some embodiments, the mRNA molecules of the present disclosure are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Nanoparticle Composition: As used herein, a "nanoparticle composition" is a composition comprising one or more lipids. Nanoparticle compositions are typically sized on the order of micrometers or smaller and may include a lipid bilayer. Nanoparticle compositions encompass lipid nanoparticles (LNPs), liposomes (e.g., lipid vesicles), and lipoplexes. For example, a nanoparticle composition may be a liposome having a lipid bilayer with a diameter of 500 nm or less.

Naturally occurring: As used herein, "naturally occurring" means existing in nature without artificial aid.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic acid sequence: The terms "nucleic acid sequence," "nucleotide sequence," or "polynucleotide sequence" are used interchangeably and refer to a contiguous nucleic acid sequence. The sequence can be either single stranded or double stranded DNA or RNA, e.g., an mRNA.

The term "nucleic acid," in its broadest sense, includes any compound and/or substance that comprises a polymer of nucleotides. These polymers are often referred to as polynucleotides. Exemplary nucleic acids or polynucleotides of the disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

The phrase "nucleotide sequence encoding" refers to the nucleic acid (e.g., an mRNA or DNA molecule) coding sequence which encodes a polypeptide. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optimized sequence: The term optimized sequence refers to the product of a sequence optimization process.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g., alkyl) per se is optional.

Part: As used herein, a "part" or "region" of a polynucleotide is defined as any portion of the polynucleotide that is less than the entire length of the polynucleotide.

Patient: As used herein, "patient" refers to a subject who may seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms that are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspensing or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound that contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are used. Lists of suitable salts are found in *Remington's Pharmaceutical Sciences,* $17^{th}$ ed., Mack Publishing Company, Easton, Pa., 1985, p. 1418*, Pharmaceutical Salts: Properties, Selection, and Use*, P. H. Stahl and C. G. Wermuth (eds.), Wiley-VCH, 2008, and Berge et al., *Journal of Pharmaceutical Science,* 66, 1-19 (1977), each of which is incorporated herein by reference in its entirety.

Pharmaceutically acceptable solvate: The term "pharmaceutically acceptable solvate," as used herein, means a compound of the disclosure wherein molecules of a suitable solvent are incorporated in the crystal lattice. A suitable solvent is physiologically tolerable at the dosage administered. For example, solvates can be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polynucleotide: The term "polynucleotide" as used herein refers to polymers of nucleotides of any length, including ribonucleotides, deoxyribonucleotides, analogs thereof, or mixtures thereof. This term refers to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the term "polynucleotide" includes polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing normucleotidic backbones, for example, polyamide (e.g., peptide nucleic acids "PNAs") and polymorpholino polymers, and other synthetic sequence-specific nucleic acid polymers providing that the polymers contain nucleobases in a configuration which allows for base pairing and base stacking, such as is found in DNA and RNA. In particular aspects, the polynucleotide comprises an mRNA. In other aspect, the mRNA is a synthetic mRNA. In some aspects, the synthetic mRNA comprises at least one unnatural nucleobase. In some aspects, all nucleobases of a certain class have been replaced with unnatural nucleobases (e.g., all uridines in a polynucleotide disclosed herein can be replaced with an unnatural nucleobase, e.g., 5-methoxyuridine). In some aspects, the polynucleotide (e.g., a synthetic RNA or a synthetic DNA) comprises only natural nucleobases, i.e., A, C, T and U in the case of a synthetic DNA, or A, C, T, and U in the case of a synthetic RNA.

The skilled artisan will appreciate that the T bases in the codon maps disclosed herein are present in DNA, whereas the T bases would be replaced by U bases in corresponding RNAs. For example, a codon-nucleotide sequence disclosed herein in DNA form, e.g., a vector or an in-vitro translation (IVT) template, would have its T bases transcribed as U based in its corresponding transcribed mRNA. In this respect, both codon-optimized DNA sequences (comprising T) and their corresponding RNA sequences (comprising U) are considered codon-optimized nucleotide sequence of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn would correspond to a ΨΨ codon (RNA map in which U has been replaced with pseudouridine).

Standard A-T and G-C base pairs form under conditions which allow the formation of hydrogen bonds between the N3-H and C4-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-β-D-ribofuranosyl-purine) can be modified to form isoguanosine (2-oxy-6-amino-9-β-D-ribofuranosyl-purine). Such modification results in a nucleoside base which will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al.). Isocytosine is available from Sigma Chemical Co. (St. Louis, Mo.); isocytidine can be prepared by the method described by Switzer et al. (1993) Biochemistry 32:10489-10496 and references cited therein; 2'-deoxy-5-methyl-isocytidine can be prepared by the method of Tor et al., 1993, J. Am. Chem. Soc. 115:4461-4467 and references cited therein; and isoguanine nucleotides can be prepared using the method described by Switzer et al., 1993, supra, and Mantsch et al., 1993, Biochem. 14:5593-5601, or by the method described in U.S. Pat. No. 5,780,610 to Collins et al. Other nonnatural base pairs can be synthesized by the method described in Piccirilli et al., 1990, Nature 343:33-37, for the synthesis of 2,6-diaminopyrimidine and its complement (1-methylpyrazolo-[4,3]pyrimidine-5,7-(4H,6H)-dione. Other such modified nucleotide units which form unique base pairs are known, such as those described in Leach et al. (1992) J. Am. Chem. Soc. 114:3675-3683 and Switzer et al., supra.

Nucleic acid sequence: The terms "nucleic acid sequence," "nucleotide sequence," or "polynucleotide" are used interchangeably and refer to a contiguous nucleic acid sequence. The sequence can be either single stranded or double stranded DNA or RNA, e.g., an mRNA.

The phrase "nucleotide sequence encoding" and variants thereof refers to the nucleic acid (e.g., an mRNA or DNA molecule) coding sequence that comprises a nucleotide sequence which encodes a polypeptide or functional fragment thereof as set forth herein. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides.

Polypeptide: The terms "polypeptide," "peptide," and "protein" are used interchangeably herein to refer to polymers of amino acids of any length. The polymer can comprise modified amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids such as homocysteine, ornithine, p-acetylphenylalanine, D-amino acids, and creatine), as well as other modifications known in the art.

The term, as used herein, refers to proteins, polypeptides, and peptides of any size, structure, or function. Polypeptides include gene products, naturally occurring polypeptides, synthetic polypeptides, homologs, orthologs, paralogs, fragments and other equivalents, variants, and analogs of the foregoing. A polypeptide can be a single polypeptide or can be a multi-molecular complex such as a dimer, trimer or tetramer. They can also comprise single chain or multichain polypeptides. Most commonly disulfide linkages are found in multichain polypeptides. The term polypeptide can also apply to amino acid polymers in which one or more amino acid residues are an artificial chemical analogue of a corresponding naturally occurring amino acid. In some embodiments, a "peptide" can be less than or equal to 50 amino acids long, e.g., about 5, 10, 15, 20, 25, 30, 35, 40, 45, or 50 amino acids long.

Polypeptide variant: As used herein, the term "polypeptide variant" refers to molecules that differ in their amino acid sequence from a native or reference sequence. The amino acid sequence variants can possess substitutions, deletions, and/or insertions at certain positions within the amino acid sequence, as compared to a native or reference sequence. Ordinarily, variants will possess at least about 50% identity, at least about 60% identity, at least about 70% identity, at least about 80% identity, at least about 90% identity, at least about 95% identity, at least about 99% identity to a native or reference sequence. In some embodiments, they will be at least about 80%, or at least about 90% identical to a native or reference sequence.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc. divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity that is in a form predicate for that substance, molecule or entity to act as a therapeutic upon chemical or physical alteration. Prodrugs may by covalently bonded or sequestered in some way and that release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune prophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3\psi$), and 2'-O-methyl-pseudouridine ($\psi$m).

Purified: As used herein, "purify," "purified," "purification" means to make substantially pure or clear from unwanted components, material defilement, admixture or imperfection.

Reference Nucleic Acid Sequence: The term "reference nucleic acid sequence" or "reference nucleic acid" or "reference nucleotide sequence" or "reference sequence" refers to a starting nucleic acid sequence (e.g., a RNA, e.g., a mRNA sequence) that can be sequence optimized. In some embodiments, the reference nucleic acid sequence is a wild type nucleic acid sequence, a fragement or a variant thereof. In some embodiments, the reference nucleic acid sequence is a previously sequence optimized nucleic acid sequence.

Repeated transfection: As used herein, the term "repeated transfection" refers to transfection of the same cell culture with a polynucleotide a plurality of times. The cell culture can be transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more.

Salts: In some aspects, the pharmaceutical composition for intratumoral delivery disclosed herein and comprises salts of some of their lipid constituents. The term "salt" includes any anionic and cationic complex. Non-limiting examples of anions include inorganic and organic anions, e.g., fluoride, chloride, bromide, iodide, oxalate (e.g., hemioxalate), phosphate, phosphonate, hydrogen phosphate, dihydrogen phosphate, oxide, carbonate, bicarbonate, nitrate, nitrite, nitride, bisulfite, sulfide, sulfite, bisulfate, sulfate, thiosulfate, hydrogen sulfate, borate, formate, acetate, benzoate, citrate, tartrate, lactate, acrylate, polyacrylate, fumarate, maleate, itaconate, glycolate, gluconate, malate, mandelate, tiglate, ascorbate, salicylate, polymethacrylate, perchlorate, chlorate, chlorite, hypochlorite, bromate, hypobromite, iodate, an alkylsulfonate, an arylsulfonate, arsenate, arsenite, chromate, dichromate, cyanide, cyanate, thiocyanate, hydroxide, peroxide, permanganate, and mixtures thereof.

Sample: As used herein, the term "sample" or "biological sample" refers to a subset of its tissues, cells or component parts (e.g., body fluids, including but not limited to blood, mucus, lymphatic fluid, synovial fluid, cerebrospinal fluid, saliva, amniotic fluid, amniotic cord blood, urine, vaginal fluid and semen). A sample further can include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Sequence Optimization: The term "sequence optimization" refers to a process or series of processes by which nucleobases in a reference nucleic acid sequence are replaced with alternative nucleobases, resulting in a nucleic acid sequence with improved properties, e.g., improved protein expression or decreased immunogenicity.

In general, the goal in sequence optimization is to produce a synonymous nucleotide sequence than encodes the same polypeptide sequence encoded by the reference nucleotide sequence. Thus, there are no amino acid substitutions (as a result of codon optimization) in the polypeptide encoded by the optimized nucleotide sequence with respect to the polypeptide encoded by the reference nucleotide sequence.

Signal Sequence: As used herein, the phrases "signal sequence," "signal peptide," and "transit peptide" are used interchangeably and refer to a sequence that can direct the transport or localization of a protein to a certain organelle, cell compartment, or extracellular export. The term encompasses both the signal sequence polypeptide and the nucleic acid sequence encoding the signal sequence. Thus, references to a signal sequence in the context of a nucleic acid refer in fact to the nucleic acid sequence encoding the signal sequence polypeptide.

Signal transduction pathway: A "signal transduction pathway" refers to the biochemical relationship between a variety of signal transduction molecules that play a role in the transmission of a signal from one portion of a cell to another portion of a cell. As used herein, the phrase "cell surface receptor" includes, for example, molecules and complexes of molecules capable of receiving a signal and the transmission of such a signal across the plasma membrane of a cell.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Specific delivery: As used herein, the term "specific delivery," "specifically deliver," or "specifically delivering" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to an off-target tissue (e.g., mammalian spleen). The level of delivery of a nanoparticle to a particular tissue may be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. For example, for renovascular targeting, a polynucleotide is specifically provided to a mammalian kidney as compared to the liver and spleen if 1.5, 2-fold, 3-fold, 5-fold, 10-fold, 15 fold, or 20 fold more polynucleotide per 1 g of tissue is delivered to a kidney compared to that delivered to the liver or spleen following systemic administration of the polynucleotide. It will be understood that the ability of a nanoparticle to specifically deliver to a target tissue need not be determined in a subject being treated, it may be determined in a surrogate such as an animal model (e.g., a rat model).

Stable: As used herein "stable" refers to a compound that is sufficiently robust to survive isolation to a useful degree of purity from a reaction mixture, and in some cases capable of formulation into an efficacious therapeutic agent.

Stabilized: As used herein, the term "stabilize," "stabilized," "stabilized region" means to make or become stable.

Stereoisomer: As used herein, the term "stereoisomer" refers to all possible different isomeric as well as conformational forms that a compound may possess (e.g., a compound of any formula described herein), in particular all possible stereochemically and conformationally isomeric forms, all diastereomers, enantiomers and/or conformers of the basic molecular structure. Some compounds of the present disclosure may exist in different tautomeric forms, all of the latter being included within the scope of the present disclosure.

Subject: By "subject" or "individual" or "animal" or "patient" or "mammal," is meant any subject, particularly a mammalian subject, for whom diagnosis, prognosis, or therapy is desired. Mammalian subjects include, but are not limited to, humans, domestic animals, farm animals, zoo animals, sport animals, pet animals such as dogs, cats, guinea pigs, rabbits, rats, mice, horses, cattle, cows; primates such as apes, monkeys, orangutans, and chimpanzees; canids such as dogs and wolves; felids such as cats, lions, and tigers; equids such as horses, donkeys, and zebras; bears, food animals such as cows, pigs, and sheep; ungulates such as deer and giraffes; rodents such as mice, rats, hamsters and guinea pigs; and so on. In certain embodiments, the mammal is a human subject. In other embodiments, a subject is a human patient. In a particular embodiment, a subject is a human patient in need of a cancer treatment.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneous: As used herein and as it relates to plurality of doses, the term means within 2 seconds.

Suffering from: An individual who is "suffering from" a disease, disorder, and/or condition has been diagnosed with or displays one or more symptoms of the disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) can be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or other molecules of the present disclosure can be chemical or enzymatic.

Targeted cells: As used herein, "targeted cells" refers to any one or more cells of interest. The cells may be found in vitro, in vivo, in situ, or in the tissue or organ of an organism. The organism may be an animal, preferably a mammal, more preferably a human and most preferably a patient.

Target tissue: As used herein "target tissue" refers to any one or more tissue types of interest in which the delivery of a polynucleotide would result in a desired biological and/or pharmacological effect. Examples of target tissues of interest include specific tissues, organs, and systems or groups thereof. In particular applications, a target tissue may be a kidney, a lung, a spleen, vascular endothelium in vessels (e.g., intra-coronary or intra-femoral), or tumor tissue (e.g., via intratumoral injection). An "off-target tissue" refers to any one or more tissue types in which the expression of the encoded protein does not result in a desired biological and/or pharmacological effect. In particular applications, off-target tissues may include the liver and the spleen.

Targeting sequence: As used herein, the phrase "targeting sequence" refers to a sequence that can direct the transport or localization of a protein or polypeptide.

Terminus: As used herein the terms "termini" or "terminus," when referring to polypeptides, refers to an extremity of a peptide or polypeptide. Such extremity is not limited only to the first or final site of the peptide or polypeptide but can include additional amino acids in the terminal regions. The polypeptide based molecules of the disclosure can be characterized as having both an N-terminus (terminated by an amino acid with a free amino group ($NH_2$)) and a C-terminus (terminated by an amino acid with a free carboxyl group (COOH)). Proteins of the disclosure are in some cases made up of multiple polypeptide chains brought together by disulfide bonds or by non-covalent forces (multimers, oligomers). These sorts of proteins will have multiple N- and C-termini. Alternatively, the termini of the polypeptides can be modified such that they begin or end, as the case can be, with a non-polypeptide based moiety such as an organic conjugate.

Therapeutic Agent: The term "therapeutic agent" refers to an agent (e.g., an mRNA) that, when administered to a subject, has a therapeutic, diagnostic, and/or prophylactic effect and/or elicits a desired biological and/or pharmacological effect. For example, in some embodiments, a mRNA encoding an IL12, IL15, IL18, IL23 or IL36 polypeptide or a combination thereof can be a therapeutic agent.

Therapeutically effective amount: As used herein, the term “therapeutically effective amount” means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term “therapeutically effective outcome” means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a “total daily dose” is an amount given or prescribed in 24 hr. period. The total daily dose can be administered as a single unit dose or a split dose.

Transcription factor: As used herein, the term “transcription factor” refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Transcription: As used herein, the term “transcription” refers to methods to introduce exogenous nucleic acids into a cell. Methods of transfection include, but are not limited to, chemical methods, physical treatments and cationic lipids or mixtures.

Transfection: As used herein, “transfection” refers to the introduction of a polynucleotide into a cell wherein a polypeptide encoded by the polynucleotide is expressed (e.g., mRNA) or the polypeptide modulates a cellular function (e.g., siRNA, miRNA). As used herein, “expression” of a nucleic acid sequence refers to translation of a polynucleotide (e.g., an mRNA) into a polypeptide or protein and/or post-translational modification of a polypeptide or protein.

Treating, treatment, therapy: As used herein, the term “treating” or “treatment” or “therapy” refers to partially or completely alleviating, ameliorating, improving, relieving, delaying onset of, inhibiting progression of, reducing severity of, and/or reducing incidence of one or more symptoms or features of a hyper-proliferative disease, e.g., cancer. For example, “treating” cancer can refer to inhibiting survival, growth, and/or spread of a tumor. Treatment can be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, “unmodified” refers to any substance, compound or molecule prior to being changed in any way. Unmodified can, but does not always, refer to the wild type or native form of a biomolecule. Molecules can undergo a series of modifications whereby each modified molecule can serve as the “unmodified” starting molecule for a subsequent modification.

Uracil: Uracil is one of the four nucleobases in the nucleic acid of RNA, and it is represented by the letter U. Uracil can be attached to a ribose ring, or more specifically, a ribofuranose via a β-$N_1$-glycosidic bond to yield the nucleoside uridine. The nucleoside uridine is also commonly abbreviated according to the one letter code of its nucleobase, i.e., U. Thus, in the context of the present disclosure, when a monomer in a polynucleotide sequence is U, such U is designated interchangeably as a “uracil” or a “uridine.”

Uridine Content: The terms “uridine content” or “uracil content” are interchangeable and refer to the amount of uracil or uridine present in a certain nucleic acid sequence. Uridine content or uracil content can be expressed as an absolute value (total number of uridine or uracil in the sequence) or relative (uridine or uracil percentage respect to the total number of nucleobases in the nucleic acid sequence).

Uridine-Modified Sequence: The terms “uridine-modified sequence” refers to a sequence optimized nucleic acid (e.g., a synthetic mRNA sequence) with a different overall or local uridine content (higher or lower uridine content) or with different uridine patterns (e.g., gradient distribution or clustering) with respect to the uridine content and/or uridine patterns of a candidate nucleic acid sequence. In the content of the present disclosure, the terms “uridine-modified sequence” and “uracil-modified sequence” are considered equivalent and interchangeable.

A “high uridine codon” is defined as a codon comprising two or three uridines, a “low uridine codon” is defined as a codon comprising one uridine, and a “no uridine codon” is a codon without any uridines. In some embodiments, a uridine-modified sequence comprises substitutions of high uridine codons with low uridine codons, substitutions of high uridine codons with no uridine codons, substitutions of low uridine codons with high uridine codons, substitutions of low uridine codons with no uridine codons, substitution of no uridine codons with low uridine codons, substitutions of no uridine codons with high uridine codons, and combinations thereof. In some embodiments, a high uridine codon can be replaced with another high uridine codon. In some embodiments, a low uridine codon can be replaced with another low uridine codon. In some embodiments, a no uridine codon can be replaced with another no uridine codon. A uridine-modified sequence can be uridine enriched or uridine rarefied.

Uridine Enriched: As used herein, the terms “uridine enriched” and grammatical variants refer to the increase in uridine content (expressed in absolute value or as a percentage value) in an sequence optimized nucleic acid (e.g., a synthetic mRNA sequence) with respect to the uridine content of the corresponding candidate nucleic acid sequence. Uridine enrichment can be implemented by substituting codons in the candidate nucleic acid sequence with synonymous codons containing less uridine nucleobases. Uridine enrichment can be global (i.e., relative to the entire length of a candidate nucleic acid sequence) or local (i.e., relative to a subsequence or region of a candidate nucleic acid sequence).

Uridine Rarefied: As used herein, the terms “uridine rarefied” and grammatical variants refer to a decrease in uridine content (expressed in absolute value or as a percentage value) in an sequence optimized nucleic acid (e.g., a synthetic mRNA sequence) with respect to the uridine content of the corresponding candidate nucleic acid sequence. Uridine rarefication can be implemented by substituting codons in the candidate nucleic acid sequence with synonymous codons containing less uridine nucleobases. Uridine rarefication can be global (i.e., relative to the entire length of a candidate nucleic acid sequence) or local (i.e., relative to a subsequence or region of a candidate nucleic acid sequence).

Variant: The term variant as used in present disclosure refers to both natural variants (e.g, polymorphisms, isoforms, etc) and artificial variants in which at least one amino acid residue in a native or starting sequence (e.g., a wild type sequence) has been removed and a different amino acid inserted in its place at the same position. These variants can be described as "substitutional variants." The substitutions can be single, where only one amino acid in the molecule has been substituted, or they can be multiple, where two or more amino acids have been substituted in the same molecule. If amino acids are inserted or deleted, the resulting variant would be an "insertional variant" or a "deletional variant" respectively.

Antibody: The terms "antibody" or "immunoglobulin," are used interchangeably herein, and include whole antibodies and any antigen binding portion or single chains thereof. A typical antibody comprises at least two heavy (H) chains and two light (L) chains interconnected by disulfide bonds. Each heavy chain is comprised of a heavy chain variable region (abbreviated herein as VH or VH) and a heavy chain constant region. The heavy chain constant region is comprised of three domains, CH1, CH2, and CH3. Each light chain is comprised of a light chain variable region (abbreviated herein as VL or VL) and a light chain constant region. The light chain constant region is comprised of one domain, CL. The VH and VL regions can be further subdivided into regions of hypervariability, termed Complementarity Determining Regions (CDR), interspersed with regions that are more conserved, termed framework regions (FW). Each VH and VL is composed of three CDRs and four FWs, arranged from amino-terminus to carboxy-terminus in the following order: FW1, CDR1, FW2, CDR2, FW3, CDR3, and FW4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system.

The term "antibody" encompasses any immunoglobulin molecules that recognize and specifically bind to a target, e.g., CTLA-4, through at least one antigen recognition site within the variable region of the immunoglobulin molecule. The term "antibody" encompasses intact polyclonal antibodies, intact monoclonal antibodies, antibody fragments (such as Fab, Fab', F(ab')2, and Fv fragments), single chain Fv (scFv) mutants, multispecific antibodies such as bispecific antibodies generated from at least two intact antibodies, chimeric antibodies, humanized antibodies, human antibodies, fusion proteins comprising an antigen determination portion of an antibody, and any other modified immunoglobulin molecule comprising an antigen recognition site so long as the antibodies exhibit the desired biological activity.

An antibody can be of any the five major classes of immunoglobulins: IgA, IgD, IgE, IgG, and IgM, or subclasses (isotypes) thereof (e.g. IgG1, IgG2, IgG3, IgG4, IgA1 and IgA2), based on the identity of their heavy-chain constant domains referred to as alpha, delta, epsilon, gamma, and mu, respectively. The different classes of immunoglobulins have different and well known subunit structures and three-dimensional configurations.

The term antibody also encompasses molecules comprising an immunoglobulin domain from an antibody (e.g., a VH, CL, CL, CH1, CH2 or CH3 domain) fused to other molecules, i.e., fusion proteins. In some aspects, such fusion protein comprises an antigen-binding moiety (e.g., an scFv). The antibody moiety of a fusion protein comprising g an antigen-binding moiety can be used to direct a therapeutic agent (e.g., a cytotoxin) to a desired cellular or tissue location determined by the specificity of the antigen-binding moiety.

Therapeutic antibody: The term "therapeutic antibody" is used in a broad sense, and encompasses any antibody or a functional fragment thereof that functions to deplete target cells in a patient. Such target cells include, e.g., tumor cells. The therapeutic antibodies can, for instance, mediate a cytotoxic effect or cell lysis, particularly by antibody-dependent cell-mediated cytotoxicity (ADCC). Therapeutic antibodies according to the disclosure can be directed to epitopes of surface which are overexpressed by cancer cells.

Blocking antibody: In some aspects, the therapeutic antibody is a blocking antibody. The terms "blocking antibody" or "antagonist antibody" refer to an antibody which inhibits or reduces the biological activity of the antigen it binds. In a certain aspect blocking antibodies or antagonist antibodies substantially or completely inhibit the biological activity of the antigen. In some aspects, the biological activity is reduced by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or even 100%.

Antigen binding portion thereof: The term "antigen binding portion" as used herein, when used in reference to an antibody disclosed herein, is intended to refer to a portion of the antibody which is capable of specifically binding an antigen that is specifically bound by the antibody. The term antigen binding portion also refers to a construct derived from an antibody that functions as a blocking or a targeting antibody, e.g., an scFv. Whether a binding portion is still capable to specifically binding to its antigen can be determined using binding assays known in the art (e.g., BIACORE).

Variable region: A "variable region" of an antibody refers to the variable region of the antibody light chain or the variable region of the antibody heavy chain, either alone or in combination. The variable regions of the heavy and light chain each consist of four FW regions connected by three CDR regions. The CDRs in each chain are held together in close proximity by the FW regions and, with the CDRs from the other chain, contribute to the formation of the antigen-binding site of antibodies. There are several techniques for determining the location of CDRs. The Kabat numbering system is generally used when referring to a residue in the variable domain (approximately residues 1-107 of the light chain and residues 1-113 of the heavy chain) (e.g., Kabat et al., Sequences of Immunological Interest, 5th Ed. Public Health Service, National Institutes of Health, Bethesda, Md. (1991)).

The boundaries of the antibody structural elements presented in this disclosure, namely, CDR1, CDR2, and CDR3 of a VH or VL domain; VH and VL domain; and constant domains CL, CH1, CH2, and CH3 can be identified according to methods know in the art. For example, the boundaries between structural elements in an antibody can be identified from sequence data alone by using the Paratome tool available at URL tools.immuneepitope.org/paratome/. See, Kunik et al. (2012) PLoS Comput. Biol. 8:2; Kunik et al. (2012). Nucleic Acids Res. 40(Web Server issue):W521-4.

Epitope: The term "epitope" as used herein refers to an antigenic protein determinant capable of binding to an antibody or antigen-binding portion thereof disclosed herein. Epitopes usually consist of chemically active surface groupings of molecules such as amino acids or sugar side chains and usually have specific three dimensional structural characteristics, as well as specific charge characteristics. The part of an antibody or binding molecule that recognizes the epitope is called a paratope. The epitopes of protein antigens are divided into two categories, conformational epitopes and linear epitopes, based on their structure and interaction with the paratope. A conformational epitope is composed of discontinuous sections of the antigen's amino acid sequence. These epitopes interact with the paratope based on the 3-D surface features and shape or tertiary structure of the antigen. By contrast, linear epitopes interact with the paratope based on their primary structure. A linear epitope is formed by a continuous sequence of amino acids from the antigen.

II. MRNA COMBINATION THERAPY FOR THE TREATMENT OF CANCER

The present disclosure provides a new approach to treat cancer involving the prevention or treatment of disease with polynucleotides (e.g., mRNAs) comprising open reading frames encoding polypeptides that stimulate the immune response to cancer, i.e., cancer immunotherapy.

In particular, the present disclosure provides compositions for the treatment of cancer (e.g., tumors) comprising, e.g., at least two polynucleotides (e.g., mRNAs), wherein the at least two polynucleotides are selected from the group consisting of (i) a polynucleotide (e.g., an mRNA) comprising an ORF encoding an immune response primer polypeptide;

(ii) a polynucleotide (e.g., an mRNA) comprising an ORF encoding an immune response co-stimulatory signal polypeptide;

(iii) a polynucleotide (e.g., an mRNA) comprising an ORF encoding a checkpoint inhibitor polypeptide or a checkpoint inhibitor polypeptide; and, (iv) a combination thereof.

In some embodiments, the polynucleotides in the composition are in a single formulation.

The present disclosure also provide methods for the treatment of cancer using the compositions disclosed herein. Accordingly, the present disclosure provides a method of reducing the size of a tumor or inhibiting growth of a tumor in a subject in need thereof comprising administering to the subject at least two polynucleotides (e.g., mRNAs) and optionally a checkpoint inhibitor polypeptide, wherein the at least two polynucleotides are selected from the group consisting of (i) a polynucleotide (e.g., an mRNA) comprising an ORF encoding an immune response primer polypeptide;

(ii) a polynucleotide (e.g., an mRNA) comprising an ORF encoding an immune response co-stimulatory signal polypeptide;

(iii) a polynucleotide (e.g., an mRNA) comprising an ORF encoding a checkpoint inhibitor polypeptide or a checkpoint inhibitor polypeptide; and, (iv) a combination thereof.

The disclosure also provides a method of reducing the size of a tumor or inhibiting growth of a tumor in a subject in need thereof comprising administering to the subject at least one polynucleotide and a checkpoint inhibitor polypeptide, wherein the at least one polynucleotide is selected from the group consisting of (i) a polynucleotide (e.g., an mRNA) comprising an ORF encoding an immune response primer polypeptide;

(ii) a polynucleotide (e.g., an mRNA) comprising an ORF encoding an immune response co-stimulatory signal polypeptide; and, (iii) a combination thereof.

As used throughout the present disclosure, the term "combination therapy" refers to a combination of polynucleotides (e.g., mRNAs) wherein each polynucleotide comprises an ORF encoding an immune response primer polypeptide, an immune response co-stimulatory signal polypeptide, or a checkpoint inhibitor polypeptide, which can be administered simultaneously, concurrently, or consecutively to a subject in need thereof as part of a single or multiple formulations. For example, a combination therapy can comprise (i) a first polynucleotide (e.g., an mRNA) comprising a first ORF encoding a first polypeptide (e.g., an immune response primer polypeptide such as IL23), and (ii) a second polynucleotide (e.g., mRNA) comprising a second ORF encoding a second polypeptide (e.g., an immune response co-stimulatory signal polypeptide such as OX40L). Or, for example, the combination therapy can comprise (i) a first polynucleotide (e.g., an mRNA) comprising a first ORF encoding a first polypeptide, (ii) a second polynucleotide (e.g., an mRNA) comprising a second ORF encoding a second polypeptide, and (iii) a third polynucleotide (e.g., an mRNA) comprising a third ORF encoding a third polypeptide. It is to be understood that the term "combination therapy" is not limited to the physical combination of polynucleotides, but also encompasses the separate administration of both these polynucleotides simultaneously, concurrently, or consecutively to a subject in need thereof as part of a single or multiple formulations.

As used herein, the term "doublet" refers to a combination therapy comprising two components (polynucleotides, polypeptides, or combinations thereof), i.e., (i) a first polynucleotide comprising a first ORF encoding a first polypeptide, and a second polynucleotide comprising a second ORF encoding a second polypeptide; or, (ii) a first polynucleotide comprising a first ORF encoding a first polypeptide, and a second polypeptide.

As used herein, the term "triplet" refers to a combination therapy comprising three components (polynucleotides, polypeptides, or combinations thereof), i.e., (i) a first polynucleotide comprising a first ORF encoding a first polypeptide, a second polynucleotide comprising a second ORF encoding a second polypeptide, and, a third polynucleotide comprising a third ORF encoding a third polypeptide; or, (ii) a first polynucleotide comprising a first ORF encoding a first polypeptide, a second polynucleotide comprising a second ORF encoding a second polypeptide, and, a third polypeptide; or, (iii) a first polynucleotide comprising a first ORF encoding a first polypeptide, a second polypeptide, and, a third polypeptide.

Thus, as illustrated in the examples above, the term combination therapy encompasses any combination of immune response primer (polynucleotide or polypeptide), immune response co-stimulatory signal (polynucleotide or polypeptide), and checkpoint inhibitor (polynucleotide or polypeptide), with the proviso that at least one of the components in the combination therapy is a polynucleotide, and particularly, an mRNA. For example, in some particular embodiments, immune response primers, immune response co-stimulatory signals, and checkpoint inhibitors such as, e.g., IL12, IL18, IL23, IL36gamma, TLR4, CD80, OX40L, anti-CTLA-4, anti-PD-1, or anti-PD-L1, can be administered either as polypeptides or as polynucleotides encoding such polypeptides.

As used herein, the term "immune response primer" refers to a molecule that enhances antigen presentation and/or recognition. In some embodiments, the immune response primer is IL12 or IL23. In specific embodiments of the methods and compositions disclosed herein, the immuno response primer is interleukin 12 (IL12), interleukin (IL23), Toll-like receptor 4 (TLR4), interleukin 36 gamma (IL36gamma), interleukin 18 (IL18), or a combination thereof. The combination therapies of the present disclosure, i.e., those combining immune response primers, immune response co-stimulatory signals, checkpoint inhibitors, and combinations thereof, can also incorporate other immune response primers known in the art (either as polypeptides or as polynucleotides encoding such polypeptides).

As used herein, the term "immune response co-stimulatory signal" refers to immuno-stimulatory molecule that promotes T/NK cell recruitment, proliferation, activation, survival, or a combination thereof. In some embodiments, the immune response co-stimulatory signal enhances T-cell expansion, function, and memory formation (e.g., OX40L). In specific embodiments of the methods and compositions disclosed herein, the immune response co-stimulatory signal is tumor necrosis factor receptor superfamily member 4 ligand (OX40L), cluster of differentiation 80 (CD80), interleukin 15 (IL15), or a combination thereof. The combination therapies of the present disclosure, i.e., those combining immune response primers, immune response co-stimulatory signals, checkpoint inhibitors, and combinations thereof, can also incorporate other immune response co-stimulatory signals known in the art either as polypeptides or as polynucleotides encoding such polypeptides.

As used herein, the term "checkpoint inhibitor" refers to a molecule that prevents immune cells from being "turned off" by cancer cells. As used herein, the term checkpoint inhibitor refers to polypeptides (e.g., antibodies) or polynucleotides encoding such polypeptides (e.g., mRNAs) that neutralize or inhibit inhibitory checkpoint molecules such as cytotoxic T-lymphocyte-associated protein 4 (CTLA-4), programmed death 1 receptor (PD-1), or PD-1 ligand 1 (PD-L1), and combinations thereof. Thus, in some embodiments, the checkpoint inhibitor polypeptide is an antibody or a polynucleotide encoding the antibody. In some embodiments, the antibody is an anti-CTLA-4 antibody or antigen-binding fragment thereof that specifically binds CTLA-4, an anti-PD-1 antibody or antigen-binding fragment thereof that specifically binds PD-1, an anti-PD-L1 antibody or antigen-binding fragment thereof that specifically binds PD-L1, and a combination thereof. In some embodiments, the anti-PD-L1 antibody is atezolizumab, avelumab, or durvalumab. In some embodiments, the anti-CTLA-4 antibody is tremelimumab or ipilimumab. In some embodiments, the anti-PD-1 antibody is nivolumab or pembrolizumab. The combination therapies of the present disclosure, i.e., those combining immune response primers, immune response co-stimulatory signals, checkpoint inhibitors, and combinations thereof, can also incorporate other checkpoint inhibitors known in the art either as polypeptides or as polynucleotides encoding such polypeptides.

These examples are not limiting, and merely illustrate that the combination therapies disclosed herein can fine tune an immune response to cancer by intervening at multiple intervention points in the immune system, e.g., (a) Priming an immune response by administering an immune response primer; and/or, (b) boosting the immune response triggered by the administration of the immune response primer(s) or enhanced by the administration of the immune response primer(s), or boosting an existing immune response, by administering immune response co-stimulatory signals; and/or, (c) removing inhibition of the immune response by inhibitory checkpoint molecules or preventing inhibition of the immuno response by inhibitory checkpoint molecules by administering one or more checkpoint inhibitors (at one or more intervention points, e.g., by co-administration of an anti-CTLA-4 antibody and/or an anti-PD-1 antibody).

In particular embodiments of the methods disclosed herein, the at lest two polynucleotides administered in a combination therapy are (i) a first polynucleotide (e.g., an mRNA) comprising an ORF encoding an first immune response primer polypeptide and a second polynucleotide (e.g., an mRNA) comprising an ORF encoding a second immune response primer polypeptide;

(ii) a first a polynucleotide (e.g., an mRNA) comprising an ORF encoding an immune response primer polypeptide and a second polynucleotide (e.g., an mRNA) comprising an ORF encoding an immune response co-stimulatory signal polypeptide; or (iii) (i) or (ii) further comprising a polynucleotide (e.g., an mRNA) comprising an ORF encoding a checkpoint inhibitor polypeptide, or a checkpoint inhibitor polypeptide.

The present disclosure provides also method of reducing the size of a tumor or inhibiting growth of a tumor in a subject in need thereof comprising administering to the subject at least two polynucleotides (e.g, mRNAs) encoding a first polypeptide and a second polypeptide, wherein (1) the first polypeptide is selected from the group consisting of an IL12 polypeptide, an IL23 polypeptide, an IL36gamma polypeptide, an OX40L polypeptide, a CD80 polypeptide (e.g., CD80-Fc), a TLR4 polypeptide (e.g., caTLR4), an IL18 polypeptide, an IL15 polypeptide, an anti-CTLA-4 antibody, and, a combination thereof, and (2) the second polypeptide is an immune response primer polypeptide; an immune response co-stimulatory signal polypeptide; or a checkpoint inhibitor polypeptide.

In some embodiments, the disclosure includes a method of reducing the size of a tumor or inhibiting growth of a tumor in a subject in need thereof comprising administering to the subject (i) at least one polynucleotide (e.g, mRNAs) encoding a first polypeptide and (ii) a checkpoint inhibitor polypeptide, wherein the first polypeptide is selected from the group consisting of (i) an IL12 polypeptide, (ii) an IL23 polypeptide, (iii) an IL36gamma polypeptide, (iv) an OX40L polypeptide, (v) a CD80 polypeptide (e.g., CD80-Fc), (vi) a TLR4 polypeptide (e.g., caTLR4), (vii) an IL18 polypeptide, (viii) an IL15 polypeptide, (ix) an anti-CTLA-4 antibody, and (x) a combination thereof. In some embodiments, the checkpoint inhibitor is an anti-PD-1 antibody, an anti-PD-L1 antibody, an anti-CTLA-4 antibody, or any combination thereof.

The present disclosure provides a method of reducing the size of a tumor or inhibiting growth of a tumor in a subject in need thereof comprising administering at least two polynucleotides, wherein the first polynucleotide comprises an ORF encoding an IL12 polypeptide (an "IL12 polynucleotide"), and the second polynucleotide comprises an ORF encoding an immune response primer polypeptide, an immune response co-stimulatory signal polypeptide, or a checkpoint inhibitor polypeptide or a polynucleotide encoding the same. In some embodiments, the second polynucleotide comprises an ORF encoding an OX40L polypeptide. In other embodiments, the present disclosure provides a method of reducing the size of a tumor or inhibiting growth of a tumor in a subject in need thereof comprising administering an IL12 polynucleotide and a check point inhibitor polypeptide comprising an anti-PD-1 antibody, an anti-PD-L1 antibody, an anti-CTLA-4 antibody, or any combination thereof. In other embodiments, the present method comprises administering an IL12 polynucleotide, e.g., mRNA, in combination with an anti-PD-1 antibody. In some embodiments, the present method comprises administering an IL12 polynucleotide, e.g., mRNA, and an anti-PD-L1 antibody. In other embodiments, the present method comprises administering an IL12 polynucleotide, e.g., mRNA, and an anti-CTLA-4 antibody. In certain embodiments, the present method comprises administering an IL12 polynucleotide, e.g., mRNA, and a polynucleotide comprising an ORF encoding an OX40L polypeptide ("an OX40L polynucleotide). In other embodiments, the present method comprises administering an IL2 polynucleotide, an OX40L polynucleotide, and a checkpoint inhibitor polypeptide, e.g., an anti-CTLA-4 antibody, an anti-PD-1 antibody, an anti-PD-L1 antibody, or any combination thereof.

The present disclosure also provides a method of reducing the size of a tumor or inhibiting growth of a tumor in a subject in need thereof comprising administering at least two polynucleotides, wherein the first polynucleotide comprises an ORF encoding an IL15 polypeptide (an "IL15 polynucleotide) and the second polynucleotide comprises an ORF encoding an immune response primer polypeptide, an immune response co-stimulatory signal polypeptide, or a checkpoint inhibitor polypeptide. In other embodiments, the disclosure includes a method of reducing the size of a tumor or inhibiting growth of a tumor in a subject in need thereof comprising administering at least one polynucleotide and a checkpoint inhibitor, wherein the first polynucleotide comprises an IL15 polynucleotide and the checkpoint inhibitor comprises an anti-CTLA-4 antibody, an anti-PD-1 antibody, an anti-PD-L1 antibody, or any combination thereof.

The present disclosure also provides a method of reducing the size of a tumor or inhibiting growth of a tumor in a subject in need thereof comprising administering at least two polynucleotides, wherein the first polynucleotide comprises an ORF encoding an IL18 polypeptide ("an IL8 polynucleotide"), and the second polynucleotide comprises an ORF encoding an immune response primer polypeptide, an immune response co-stimulatory signal polypeptide, or a checkpoint inhibitor polypeptide. In some embodiments, the second polynucleotide comprises an ORF encoding a polypeptide selected from the group consisting of an IL2 polypeptide, an IL23 polypeptide, a TLR4 polypeptide (e.g., caTLR4), an OX40L polypeptide, an anti-CTLA-4 antibody, and any combination thereof. In other embodiments, the disclosure provides a method of reducing the size of a tumor or inhibiting growth of a tumor in a subject in need thereof comprising administering an IL18 polynucleotide and a checkpoint inhibitor polypeptide comprising an anti-PD-1 antibody, an anti-PD-L1 antibody, an anti-CTLA-4 antibody, or any combination thereof. In some embodiments, the present method comprises administering an IL18 polynucleotide and an OX40L polynucleotide. In other embodiments, the present method comprises administering an IL18 polynucleotide and a polynucleotide comprising an ORF encoding an IL23 polypeptide ("an IL23 polynucleotide"). In some embodiments, the present method comprises administering an IL18 polynucleotide and a polynucleotide comprising an ORF encoding a TLR4 polypeptide, e.g., caTLR4, ("a TLR4 polynucleotide"). In other embodiments, the present method comprises administering an IL18 polynucleotide and an IL12 polynucleotide. In some embodiments, the present method comprises administering an IL18 polynucleotide, an IL12 polynucleotide, and an IL23 polynucleotide in combination. In still other embodiments, the present method comprises administering an IL18 polynucleotide, an IL2 polynucleotide, an IL23 polynucleotide, a TLR4 polynucleotide, an OX40L polynucleotide, an anti-CTLA-4 antibody or a polynucleotide encoding the same, an anti-PD1 antibody, and/or an anti-PD-L1 antibody in any combination.

Also provided is a method of reducing the size of a tumor or inhibiting growth of a tumor in a subject in need thereof comprising administering at least two polynucleotides, wherein the first polynucleotide comprises an ORF encoding an IL23 polypeptide ("an IL23 polynucleotide") and the second polynucleotide comprises an ORF encoding an immune response primer polypeptide, an immune response co-stimulatory signal polypeptide, or a checkpoint inhibitor polypeptide. In some embodiments, the second polynucleotide comprises an ORF encoding a polypeptide selected from the group consisting of an IL12 polypeptide, an IL18 polypeptide, an OX40L polypeptide, and any combination thereof. In other embodiments, the disclosure provides a method of reducing the size of a tumor or inhibiting growth of a tumor in a subject in need thereof comprising administering an IL23 polynucleotide and a checkpoint inhibitor polypeptide comprising an anti-PD-1 antibody, an anti-PD-L1 antibody, an anti-CTLA-4 antibody, or any combination thereof. In some embodiments, the present method comprises administering an IL23 polynucleotide and an OX40L polynucleotide. In some embodiments, the present method comprises administering an IL23 polynucleotide and an IL12 polynucleotide. In other embodiments, the present method comprises administering an IL23 polynucleotide and an anti-CTLA-4 antibody. In other embodiments, the present method comprises administering an IL23 polynucleotide, an OX40L polynucleotide, an IL12 polypeptide, an IL18 polypeptide, and an anti-CTLA-4 antibody in combination. In other embodiments, the present method comprises administering an IL23 polynucleotide, an IL12 polypeptide, an IL18 polypeptide, and an anti-CTLA-4 antibody in any combination.

Also provided is a method of reducing the size of a tumor or inhibiting growth of a tumor in a subject in need thereof comprising administering at least two polynucleotides, wherein the first polynucleotide comprises an ORF encoding an IL36gamma polypeptide ("an IL36gamma polynucleotide") and the second polynucleotide comprises an ORF encoding an immune response primer polypeptide, an immune response co-stimulatory signal polypeptide, or a checkpoint inhibitor polypeptide.

The present disclosure also provides a method of reducing the size of a tumor or inhibiting growth of a tumor in a subject in need thereof comprising administering at least two polynucleotides, wherein the first polynucleotide comprises an ORF encoding a TLR4 polypeptide (e.g., caTLR4) ("a TLR4 polynucleotide") and the second polynucleotide comprises an ORF encoding an immune response primer polypeptide, an immune response co-stimulatory signal polypeptide, or a checkpoint inhibitor polypeptide.

Also provided is a method of reducing the size of a tumor or inhibiting growth of a tumor in a subject in need thereof comprising administering at least two polynucleotides, wherein the first polynucleotide comprises an ORF encoding an CD80 polypeptide ("a CD80 polynucleotide") and the second polynucleotide comprises an ORF encoding an immune response primer polypeptide, an immune response co-stimulatory signal polypeptide, or a checkpoint inhibitor polypeptide. In some embodiments, the second polynucleotide comprises an ORF encoding an anti-CTLA-4 antibody.

Also provided is a method of reducing the size of a tumor or inhibiting growth of a tumor in a subject in need thereof comprising administering at least two polynucleotides, wherein the first polynucleotide comprises an ORF encoding an OX40L polypeptide ("an OX40L polynucleotide") and the second polynucleotide comprises an ORF encoding an immune response primer polypeptide, an immune response co-stimulatory signal polypeptide, or a checkpoint inhibitor polypeptide. In some embodiments, the present method comprises administering an OX40L polynucleotide and an IL18 polynucleotide. In some embodiments, the present method comprises administering an OX40L polynucleotide and a TLR4 (e.g., caTLR4) polynucleotide. In some embodiments, the present method comprises administering an OX40L polynucleotide, an IL12 polynucleotide, and an IL23 polynucleotide in combination. In some embodiments, the present method comprises administering an OX40L polynucleotide and a TLR4 (e.g., caTLR4) polynucleotide. In some embodiments, the present method comprises administering an OX40L polynucleotide, a TLR4 (e.g., caTLR4) polynucleotide, and an IL18 polynucleotide in combination. In some embodiments, the present method comprises administering an OX40L polynucleotide and a TLR4 (e.g., caTLR4) polynucleotide. In some embodiments, the present method comprises administering an OX40L polynucleotide and an anti-CTLA-4 antibody or a polynucleotide encoding the same. In some embodiments, the present method comprises administering an OX40L polynucleotide and an anti-PD-1 antibody or an anti-PD-L1 antibody. In other embodiments, the present method comprises administering an OX40L polynucleotide, an IL12 polynucleotide, an IL23 polynucleotide, and an anti-CTLA-4 antibody or a polynucleotide encoding the same. In certain embodiments, the present method comprises administering an OX40L polynucleotide, an IL2 polynucleotide, an IL23 polynucleotide, and an anti-PD-1 antibody or an anti-PD-L1 antibody. In other embodiments, the present method comprises administering an OX40L polynucleotide, a TLR4 (e.g., caTLR4) polynucleotide, an IL18 polynucleotide, and an anti-PD-1 antibody or an anti-PD-L1 antibody. In other embodiments, the present method comprises administering an OX40L polynucleotide, a TLR4 (e.g., caTLR4) polynucleotide, an IL18 polynucleotide, and an anti-CTLA-4 antibody or a polynucleotide encoding the same.

Also provided is a method of reducing the size of a tumor or inhibiting growth of a tumor in a subject in need thereof comprising administering at least two polynucleotides, wherein the first polynucleotide comprises an ORF encoding an anti-CTLA-4 antibody ("an anti-CTLA-4 polynucleotide") and the second polynucleotide comprises an ORF encoding an immune response primer polypeptide, an immune response co-stimulatory signal polypeptide, or a checkpoint inhibitor polypeptide. In some embodiments, the present method comprises administering an anti-CTLA-4 polynucleotide and an IL18 polynucleotide. In some embodiments, the present method comprises administering an anti-CTLA-4 polynucleotide and an IL12 polynucleotide. In some embodiments, the present method comprises administering an anti-CTLA-4 polynucleotide and an IL23 polynucleotide. In some embodiments, the present method comprises administering an anti-CTLA-4 polynucleotide and a TLR4 polynucleotide. In other embodiments, the present method comprises administering an anti-CTLA-4 polynucleotide, an IL18 polynucleotide, an IL23 polynucleotide, an OX40L polynucleotide, a TLR4 polynucleotide, or any combination thereof.

In some specific embodiments, the IL12 polynucleotide comprises at least one polynucleotide comprising an ORF encoding an IL12 polypeptide, wherein the IL12 polypeptide comprises an interleukin 12 p40 subunit (IL12B) polypeptide and an interleukin 12 p35 subunit (IL12A) polypeptide. The IL12B polypeptide can be operably linked to the IL12A polypeptide by a linker. In some embodiments, the polynucleotide encoding the IL12 polypeptide can further comprise a nucleic acid encoding a signal peptide, e.g., an IL12B signal peptide. Accordingly, in some embodiments, the sequence of the IL12 polypeptide has the structure

[SP]-[IL12B]-[L]-[IL12A]

wherein [SP] is a signal peptide, [IL12B] is a polypeptide corresponding to mature IL12B, [L] is a peptide linker, and [IL12A] is a polypeptide corresponding to mature IL12A. In other embodiments, the sequence of the IL12 polypeptide has the structure [SP]-[IL12A]-[L]-[IL12B].

In some specific embodiments, the IL18 polynucleotide comprises an ORF encoding an IL18 polypeptide, wherein the IL18 polypeptide has the structure [SP]-[IL18], wherein [SP] is a signal peptide, an [IL8] is a polypeptide corresponding to mature IL18. In some embodiments, the signal peptide is a native IL18 signal peptide. In other embodiments, the signal peptide is a heterologous signal peptide, e.g., a tissue plasminogen activator (tPA) signal peptide or an interleukin 12 (IL12) signal peptide.

In some specific embodiments, the CD80 polynucleotide comprises an ORF encoding a CD80 extracellular domain. In some embodiments, the CD80 polynucleotide comprises nucleic acid sequence encoding an Fc moiety, which is operably linked to the nucleic acid encoding the CD80 extracellular domain. Accordingly, in some embodiments, the ORF in a CD80 polynucleotide encodes a CD80Fc fusion protein. In some embodiments, the CD80 polypeptide, e.g., a CD80Fc fusion protein, has the structure

[SP]-[CD80]-[Fc]

where [SP] is a signal peptide, [CD80] is the extracellular domain of CD80 or a functional portion thereof, and [Fc] is an Fc moiety. In some embodiments, the signal peptide is an endogenous CD80 signal peptide.

In some embodiments, the TLR4 polynucleotide comprises an ORF encoding a constitutively active TLR4 (caTLR4) polypeptide comprising the intracellular domain and transmembrane region of TLR4. In some embodiment, TLR4 polypeptide encoded by the ORF in the TLR polynucleotide has the structure

[SP]-[TLR4]

wherein [SP] is a signal peptide, and [TLR4] is TLR4 polypeptide, e.g., a caTLR4 polypeptide. In some embodiments, the signal peptide is a heterologous signal peptide, wherein the heterologous signal peptide is lysosome-associated membrane glycoprotein 1 (LAMP1) signal peptide.

In some embodiments, the IL15 polynucleotide comprises an ORF encoding a fusion protein comprising an IL15 polypeptide fused to an IL15R polypeptide by a linker. In some embodiments, the IL15R polypeptide consists or consists essentially of the extracellular domain of IL15Ralpha. In some embodiments, the IL15-IL15R fusion polypeptide further comprises an Fc domain. Accordingly, in some embodiments the IL15 polypeptide encoded by the ORF in the IL15 polynucleotide has the structure

[SP]-[Fc]-[IL15R]-[L]-[IL15]

wherein [SP] is a signal peptide, [IL15] is the sequence of mature IL15, [L] is a polypeptide linker, [IL15R] is the extracellular of the IL15Ralpha, and [Fc] is an Fc moiety. In some embodiments, the signal peptide is a heterologous signal peptide, e.g., a tPA signal peptide.

In some embodiments, the IL23 polynucleotide comprises an ORF encoding an IL23 polypeptide, wherein the IL23 polypeptide comprises an IL12p40 polypeptide and an IL23p19 polypeptide. In some embodiments, the IL12p40 polypeptide is fused to the IL23p19 polypeptide via a linker. In some embodiments, the IL23 polypeptide further comprises a signal peptide. Accordingly, in some embodiments the IL23 polypeptide encoded by the ORF in the IL23 polynucleotide has the structure

[SP]-[IL12p40]-[L]-[IL23p19]

wherein [SP] is a signal peptide, [IL12p40] is the IL12p40 subunit of IL23, [L] is a polypeptide linker, [IL23p19] is the IL23p19 subunit of IL23. In some embodiments, the signal peptide is an IL12p40 signal peptide. In other embodiments, e.g., when the order of the IL23 subunits is transposed in the IL23 construct, the signal peptide is an IL23p19 signal peptide.

In some embodiments, the IL36gamma polynucleotide comprises an ORF encoding an IL36gamma polypeptide. In some embodiments, the IL36gamma polypeptide further comprises a nucleic acid encoding a signal peptide. Accordingly, in some embodiments the IL36gamma polypeptide encoded by the ORF in the IL36gamma polynucleotide has the structure

[SP]-[IL36gamma]

wherein [SP] is signal peptide and [IL36gamma] is IL36gamma, e.g., mature IL36gamma. In some embodiments, the signal peptide is a heterologous signal peptide, e.g., an hIgKV4 signal peptide.

In some embodiments, the anti-CTLA-4 polynucleotide encodes an antibody an antibody or an antigen binding portion thereof which specifically binds to the same CTLA-4 epitope as:

(i) an antibody or antigen-binding portion thereof comprising a heavy chain variable region (VH) of SEQ ID NO: 9, 28, or 39, and a light chain variable region (VL) of SEQ ID NO: 11, 29 or 41; or, (ii) an antibody or antigen-binding portion comprising a VH of SEQ ID NO: 183 and a VL of SEQ ID NO: 185.

In some embodiments, the anti-CTLA-4 polynucleotide encodes an antibody an antibody or an antigen binding portion thereof which specifically binds to CTLA-4 and competitively inhibits CTLA-4 binding by:

(i) an antibody or antigen-binding portion thereof comprising a VH of SEQ ID NO: 9, 28, or 39 and a VL of SEQ ID NO: 11, 29 or 41; or, (ii) an antibody or antigen-binding portion thereof comprising a VH of SEQ ID NO: 183 and a VL of SEQ ID NO: 185.

In some embodiments, the anti-CTLA-4 polynucleotide comprises one or more mRNAs (e.g., two, three or more mRNAs) encoding:

(i) an antibody or an antigen binding portion thereof which specifically binds to CTLA-4 comprising a VH of SEQ ID NO: 9, 28, or 39 and a VL of SEQ ID NO: 11, 29 or 41; or, (ii) an antibody or antigen-binding portion thereof which specifically binds to CTLA-4 comprising a VH of SEQ ID NO: 183 and a VL of SEQ ID NO: 185.

In some embodiments, the anti-CTLA-4 polynucleotide comprises a VH and a VL, wherein the VL is selected from the group consisting of:

(i) a VL complementarity determining region 1 (VL-CDR1) amino acid sequence identical to, or identical except for four, three, two or one amino acid substitutions to SEQ ID NO: 17, 33, or 47, or SEQ ID NO: 189;

(ii) a VL complementarity determining region 1 (VL-CDR2) amino acid sequence identical to, or identical except for four, three, two or one amino acid substitutions to SEQ ID NO: 18, 34 or 48, or SEQ ID NO: 190; and (iii) a VL complementarity determining region 1 (VL-CDR3) amino acid sequence identical to, or identical except for four, three, two or one amino acid substitutions to SEQ ID NO: 19, 35 or 49, or SEQ ID NO: 191; and wherein the VH is selected from the group consisting of:

(iv) a VH complementarity determining region 1 (VH-CDR1) amino acid sequence identical to, or identical except for four, three, two or one amino acid substitutions to SEQ ID NO: 14, 30 or 44, or SEQ ID NO: 186;

(v) a VH complementarity determining region 1 (VH-CDR2) amino acid sequence identical to, or identical except for four, three, two or one amino acid substitutions to SEQ ID NO:15, 31 or 45, or SEQ ID NO: 187; and (vi) a VH complementarity determining region 1 (VH-CDR3) amino acid sequence identical to, or identical except for four, three, two or one amino acid substitutions to SEQ ID NO:16, 32 or 46 or SEQ ID NO:188.

In some embodiments, one or more of the polynucleotides in a combination therapy disclosed herein has been sequence-optimized. In some embodiments, one or more of the polynucleotides in a combination therapy disclosed herein comprise at least one chemically modified nucleoside.

In certain embodiments, a polynucleotide (e.g., an RNA, such as an mRNA) comprising a sequence-optimized nucleotide sequence (e.g., an ORF) encoding an immune response primer polypeptide, an immune response co-stimulatory signal polypeptide, or a checkpoint inhibitor polypeptide, can be used in combination with one or more anti-cancer agents. In some embodiments, the combination therapies disclosed herein can comprise one or more standard therapies. In certain embodiments, the one or more anti-cancer agents are an mRNA encoding a tumor antigen. In other embodiments, the one or more anti-cancer agents are not a tumor antigen or an mRNA encoding a tumor antigen. In other embodiments, the one or more anti-cancer agents are a protein, e.g., an antibody.

In some embodiments, the one or more anti-cancer agents are approved by the United States Food and Drug Administration. In other embodiments, the one or more anti-cancer agents are pre-approved by the United States Food and Drug Administration.

In another embodiment, the subject has been treated with an anti-PD-1 antagonist prior to the administration of a combination therapy disclosed herein. In another embodiment, the subject has been treated with a monoclonal antibody that binds to PD-1 prior to the administration of a combination therapy disclosed herein. In another embodiment, the subject has been treated with an anti-PD-1 monoclonal antibody therapy prior to the administration of a combination therapy disclosed herein. In some embodiments, the anti-PD-1 monoclonal antibody therapy comprises Nivolumab, Pembrolizumab, Pidilizumab, or any combination thereof.

In another embodiment, the subject has been treated with a monoclonal antibody that binds to PD-L1 prior to the administration of a combination therapy disclosed herein. In another embodiment, the subject has been treated with an anti-PD-L1 monoclonal antibody therapy prior to the administration of a combination therapy disclosed herein. In other embodiments, the anti-PD-L1 monoclonal antibody therapy comprises Durvalumab, Avelumab, MEDI473, BMS-936559, Atezolizumab, or any combination thereof.

In some embodiments, the subject has been treated with a CTLA-4 antagonist prior to the administration of a combination therapy disclosed herein. In another embodiment, the subject has been previously treated with a monoclonal antibody that binds to CTLA-4 prior to the administration of a combination therapy disclosed herein. In another embodiment, the subject has been treated with an anti-CTLA-4 monoclonal antibody prior to the administration of a combination therapy disclosed herein. In other embodiments, the anti-CTLA-4 antibody therapy comprises Ipilimumab or Tremelimumab.

Thus, the administration of mRNA as referred to in the present disclosure is not in the form of a dendritic cell comprising an mRNA encoding an immune response primer polypeptide, an immune response co-stimulatory signal polypeptide, or a checkpoint inhibitor polypeptide disclosed herein (e.g., IL12, IL5, IL18, IL23, IL36gamma, TLR4, CD80, OX40L, anti-CTLA-4, or a combination thereof). Rather, the administration in the present disclosure is a direct administration of at least one mRNAs encoding an immune response primer polypeptide, an immune response co-stimulatory signal polypeptide, a checkpoint inhibitor polypeptide, or a combination thereof disclosed herein (e.g., IL12, IL15, IL18, IL23, IL36gamma, TLR4, CD80, OX40L, anti-CTLA-4, or a combination thereof), or compositions comprising the at least one mRNAs encoding an immune response primer polypeptide, an immune response co-stimulatory signal polypeptide, a checkpoint inhibitor polypeptide, or a combination thereof disclosed herein (e.g., IL12, IL15, IL18, IL23, IL36gamma, TLR4, CD80, OX40L, anti-CTLA-4, or a combination thereof) to the subject (e.g., to a tumor in a subject).

In some embodiments, the polynucleotides (e.g., RNA, e.g., mRNA) comprising an ORF encoding a CD80 polypeptide or an Fc polypeptide are administered together with a polynucleotide (e.g., RNA, e.g., mRNA) comprising an ORF encoding an antibody or an antigen binding portion thereof which specifically binds to CTLA-4. In one embodiment, the antibody or antigen binding portion thereof is tremelimumab. In another embodiment, the antibody or antigen binding portion thereof is ipilimumab. In some embodiments, the compositions disclosed herein comprise (i) a polynucleotide comprising an ORF encoding a CD80 polypeptide or an Fc polypeptide and (ii) a polynucleotide (e.g., RNA, e.g., mRNA) comprising an ORF encoding an antibody or an antigen binding portion thereof which specifically binds to CTLA-4 in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered together with a polynucleotide (e.g., RNA, e.g., mRNA) comprising an ORF encoding an OX40L polypeptide in a single formulation or separate formulations.

In other embodiments, a polynucleotide (e.g., RNA, e.g., mRNA) comprising an ORF encoding a TLR4 polypeptide, e.g., a caTLR4, (e.g., the wild-type sequence, functional fragment, or variant thereof) is administered in combination with a polynucleotide (e.g., RNA, e.g., mRNA) comprising an ORF encoding an IL18 polypeptide in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an antibody or an antigen binding portion thereof which specifically binds to CTLA-4 in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide comprising an ORF encoding an OX40L polypeptide; a polynucleotide (e.g., RNA, e.g., mRNA) comprising an ORF encoding an IL18 polypeptide; a polynucleotide (e.g., RNA, e.g., mRNA) comprising an ORF encoding an antibody or an antigen binding portion thereof which specifically binds to CTLA-4, or any combination thereof in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof). is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL18 polypeptide; a polynucleotide (e.g., RNA, e.g., mRNA) comprising an ORF encoding an antibody or an antigen-binding portion thereof that specifically binds to a PD-1 or PD-L1 receptor, or any combination thereof, in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an OX40L polypeptide; a polynucleotide comprising an ORF encoding an IL18 polypeptide; and a polynucleotide (e.g., RNA, e.g., mRNA) comprising an ORF encoding an antibody or an antigen binding portion thereof which specifically binds to CTLA-4 in a single formulation or separate formulations.

In other embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL18 polypeptide; and a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an OX40L polypeptide in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof) is administered in combination with a polynucleotide (e.g., RNA, e.g., mRNA), comprising an ORF encoding an IL18 polypeptide in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof) is administered in combination with a polynucleotide (e.g., RNA, e.g., mRNA), comprising am ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof) is administered in combination with a polynucleotide (e.g., RNA, e.g., mRNA) comprising an ORF encoding an OX40L polypeptide, a polynucleotide (e.g., RNA, e.g., mRNA) comprising an ORF encoding an IL18 polypeptide, a polynucleotide (e.g., RNA, e.g., mRNA) comprising an ORF encoding an antibody or an antigen binding portion thereof which specifically binds to CTLA-4, or any combination thereof in a single formulation or separate formulations.

In some embodiments, a polynucleotide (e.g., RNA, e.g., mRNA) comprising an ORF encoding TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an OX40L polypeptide, a polynucleotide (e.g., RNA, e.g., mRNA) comprising an ORF encoding an IL18 polypeptide, a polynucleotide (e.g., RNA, e.g., mRNA) comprising an ORF encoding an antibody or an antigen-binding portion thereof that specifically binds to a PD-1 or PD-L1 receptor, or any combination thereof in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL18 polypeptide; and a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding a TLR4 polypeptide, e.g., a caTLR4 (e.g., the wild-type sequence, functional fragment, or variant thereof), is administered in combination with a polynucleotide comprising an ORF encoding an OX40L polypeptide; a polynucleotide (e.g., RNA, e.g., mRNA) comprising an ORF encoding a polynucleotide (e.g., RNA, e.g., mRNA) encoding an IL18 polypeptide; and a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL12 polypeptide, a polynucleotide (e.g., RNA, e.g., mRNA) comprising an ORF encoding an IL23 polypeptide, a polynucleotide (e.g., RNA, e.g., mRNA) comprising an ORF encoding a caTLR4 polypeptide, a polynucleotide (e.g., RNA, e.g., mRNA) comprising an ORF encoding an IL18 polypeptide, a polynucleotide (e.g., RNA, e.g., mRNA) comprising an ORF encoding an antibody or an antigen binding portion thereof which specifically binds to CTLA-4, a polynucleotide (e.g., RNA, e.g., mRNA) comprising an encoding an antibody or antigen-binding portion thereof which specifically binds to a PD-1 receptor, a polynucleotide (e.g., RNA, e.g., mRNA) comprising an ORF encoding an antibody or antigen-binding portion thereof which specifically binds to a PD-L1 receptor, or any combination thereof in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL12 polypeptide, in a single formulation or separate formulations.

In one embodiment, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL23 polypeptide in a single formulation or separate formulations.

In another embodiment, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL12 polypeptide and a polynucleotide (e.g., RNA, e.g., mRNA) comprising an ORF encoding an IL23 polypeptide, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding a caTLR4 polypeptide, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL18 polypeptide, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL18 polypeptide and a polynucleotide encoding a caTLR4 polypeptide, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an antibody or an antigen binding portion thereof which specifically binds to CTLA-4, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an antibody or an antigen-binding portion thereof that specifically binds to a PD-1 or PD-L1 receptor, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL2 polypeptide, a polynucleotide (e.g., RNA, e.g., mRNA) comprising an ORF encoding an IL23 polypeptide, a polynucleotide (e.g., RNA, e.g., mRNA) comprising an ORF encoding an antibody or an antigen-binding portion thereof that specifically binds to a PD-1 or PD-L1 receptor, or any combination thereof, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL12 polypeptide, a polynucleotide (e.g., RNA, e.g., mRNA) comprising an ORF encoding an IL23 polypeptide, a polynucleotide (e.g., RNA, e.g., mRNA) comprising an ORF encoding an antibody or an antigen-binding portion thereof that specifically binds to a CTLA-4, or any combination thereof, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding a caTLR4 polypeptide, a polynucleotide (e.g., RNA, e.g., mRNA) comprising an ORF encoding an IL18 polypeptide, a polynucleotide (e.g., RNA, e.g., mRNA) comprising an ORF encoding an antibody or an antigen-binding portion thereof that specifically binds to a PD-1 or PD-L1 receptor, or any combination thereof, in a single formulation or separate formulations.

In other embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding a caTLR4 polypeptide, a polynucleotide (e.g., RNA, e.g., mRNA) comprising an ORF encoding an IL18 polypeptide, a polynucleotide (e.g., RNA, e.g., mRNA) comprising an ORF encoding an antibody or an antigen-binding portion thereof that specifically binds to CTLA-4, or any combination thereof, in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof) is administered in combination with a polynucleotide (e.g., RNA, e.g., mRNA) comprising an ORF encoding an IL12 polypeptide, a polynucleotide (e.g., RNA, e.g., mRNA) comprising an ORF encoding an IL23 polypeptide, a polynucleotide (e.g., RNA, e.g., mRNA) comprising an ORF encoding a caTLR4 polypeptide, a polynucleotide encoding an IL18 polypeptide, a polynucleotide (e.g., RNA, e.g., mRNA) comprising an ORF encoding an antibody or an antigen binding portion thereof which specifically binds to CTLA-4, a polynucleotide (e.g., RNA, e.g., mRNA) comprising an ORF encoding an antibody or antigen-binding portion thereof which specifically binds to a PD-1 receptor, a polynucleotide (e.g., RNA, e.g., mRNA) comprising an ORF encoding an antibody or antigen-binding portion thereof which specifically binds to a PD-L1 receptor, or any combination thereof, in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof), is administered in combination with a polynucleotide (e.g., RNA, e.g., mRNA) comprising an ORF encoding an IL12 polypeptide in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof), is administered in combination with a polynucleotide (e.g., RNA, e.g., mRNA) comprising an ORF encoding an IL23 polypeptide in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with a polynucleotide (e.g., RNA, e.g., mRNA) comprising an ORF encoding an IL12 polypeptide, a polynucleotide (e.g., RNA, e.g., mRNA) comprising an ORF encoding an IL23 polypeptide, or any combination thereof, in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof), is administered in combination with a polynucleotide (e.g., RNA, e.g., mRNA) comprising an ORF encoding a caTLR4 polypeptide in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with a polynucleotide (e.g., RNA, e.g., mRNA) comprising an ORF encoding an IL18 polypeptide, in a single formulation or separate formulations.

In some embodiments, a polynucleotide (e.g., RNA, e.g., mRNA) comprising an ORF encoding an OX40L polypeptide (e.g., the wild-type sequence, functional fragment, or variant thereof), is administered in combination with a polynucleotide (e.g., RNA, e.g., mRNA) comprising an ORF encoding a caTLR4 polypeptide, a polynucleotide (e.g., RNA, e.g., mRNA) comprising an ORF encoding an IL18 polypeptide, or any combination thereof, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with a polynucleotide (e.g., RNA, e.g., mRNA) comprising an ORF encoding an antibody or an antigen binding portion thereof which specifically binds to CTLA-4, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with a polynucleotide (e.g., RNA, e.g., mRNA) comprising an ORF encoding an antibody or an antigen-binding portion thereof that specifically binds to a PD-1 or PD-L1 receptor, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with (i) a polynucleotide (e.g., RNA, e.g., mRNA)' comprising an ORF encoding an IL12 polypeptide, (ii) a polynucleotide (e.g., RNA, e.g., mRNA) comprising an ORF encoding an IL23 polypeptide, (iii) a polynucleotide (e.g., RNA, e.g., mRNA) comprising an ORF encoding an antibody or an antigen binding portion thereof which specifically binds to CTLA-4, or (iv) any combination thereof, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with (i) a polynucleotide (e.g., RNA, e.g., mRNA) comprising an ORF encoding an IL12 polypeptide, (ii) a polynucleotide (e.g., RNA, e.g., mRNA) comprising an ORF encoding an IL23 polypeptide, (iii) a polynucleotide (e.g., RNA, e.g., mRNA) comprising an ORF encoding an antibody or an antigen binding portion thereof which specifically binds to a PD-1 or PD-L1 receptor, or (iv) any combination thereof, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with (i) a polynucleotide (e.g., RNA, e.g., mRNA) comprising an ORF encoding a caTLR4 polypeptide, (ii) a polynucleotide (e.g., RNA, e.g., mRNA) comprising an ORF encoding an IL18 polypeptide, (iii) a polynucleotide (e.g., RNA, e.g., mRNA) comprising an ORF encoding an antibody or an antigen binding portion thereof which specifically binds to CTLA-4, or (iv) any combination thereof, in a single formulation or separate formulations.

In some embodiments, a polynucleotide (e.g., RNA, e.g., mRNA) comprising an ORF encoding a polynucleotide encoding an OX40L polypeptide (e.g., the wild-type sequence, functional fragment, or variant thereof), is administered in combination with (i) a polynucleotide (e.g., RNA, e.g., mRNA) comprising an ORF encoding a caTLR4 polypeptide, (ii) a polynucleotide (e.g., RNA, e.g., mRNA) comprising an ORF encoding an IL18 polypeptide, (iii) a polynucleotide (e.g., RNA, e.g., mRNA) comprising an ORF encoding an antibody or an antigen binding portion thereof which specifically binds to a PD-1 or PD-L1 receptor, or (iv) any combination thereof, in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding an IL12 polypeptide or an IL23 polypeptide, in a single formulation or separate formulations.

In other embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an IL23 in a single formulation or separate formulations.

In some embodiments, a polynucleotide (e.g., RNA, e.g., mRNA) comprising an ORF encoding an IL18 polypeptide, can be administered in combination with a polynucleotide (e.g., RNA, e.g., mRNA) comprising an ORF' encoding an IL23 polypeptide, a polynucleotide (e.g., RNA, e.g., mRNA) comprising an ORF encoding an IL12 protein in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding a caTLR4 polypeptide (e.g., the wild-type sequence, functional fragment, or variant thereof), in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding an OX40L polypeptide, in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding an antibody or an antigen binding portion thereof which specifically binds to CTLA-4, in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In other embodiments, a polynucleotide (e.g., RNA, e.g., mRNA) comprising an ORF encoding an IL18 polypeptide is administered in combination with a polynucleotide (e.g., RNA, e.g., mRNA) comprising an ORF encoding an IL2 polypeptide or an IL23 polypeptide; a polynucleotide (e.g., RNA, e.g., mRNA) comprising an ORF encoding a caTLR4 polypeptide (e.g., the wild-type sequence, functional fragment, or variant thereof); a polynucleotide (e.g., RNA, e.g., mRNA) comprising an ORF encoding an OX40L polypeptide; a polynucleotide (e.g., RNA, e.g., mRNA) comprising an ORF encoding an antibody or an antigen binding portion thereof which specifically binds to CTLA-4; and a polynucleotide (e.g., RNA, e.g., mRNA) comprising an ORF encoding an antibody or an antigen-binding portion thereof that specifically binds to a PD-1 or PD-L1 receptor, or any combination thereof in a single formulation or separate formulations.

In some embodiments, a polynucleotide (e.g., RNA, e.g., mRNA) comprising an ORF encoding an IL18 polypeptide, is administered in combination with (i) a polynucleotide (e.g., RNA, e.g., mRNA) comprising an ORF encoding an IL12 polypeptide in a single formulation; (ii) a polynucleotide (e.g., RNA, e.g., mRNA) comprising an ORF encoding an IL18 polypeptide, and a polynucleotide (e.g., RNA, e.g., mRNA) comprising an ORF encoding an IL23 protein in a single formulation; or (iii) a polynucleotide (e.g., RNA, e.g., mRNA) comprising an ORF encoding an IL18 polypeptide, and both a polynucleotide (e.g., RNA, e.g., mRNA) comprising an ORF encoding an IL12 polypeptide and a polynucleotide (e.g., RNA, e.g., mRNA) comprising an ORF encoding an IL23 polypeptide in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding a caTLR4 polypeptide (e.g., the wild-type sequence, functional fragment, or variant thereof) in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an OX40L polypeptide in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an antibody or an antigen-binding portion thereof that specifically binds to a PD-1 or PD-L1 receptor in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an IL2 polypeptide or an IL23 polypeptide; a polynucleotide (e.g., RNA, e.g., mRNA) comprising an ORF encoding a caTLR4 polypeptide (e.g., the wild-type sequence, functional fragment, or variant thereof); a polynucleotide (e.g., RNA, e.g., mRNA) comprising an ORF encoding an OX40L polypeptide; a polynucleotide (e.g., RNA, e.g., mRNA) comprising an ORF encoding an antibody or an antigen binding portion thereof which specifically binds to CTLA-4; a polynucleotide encoding an antibody or an antigen-binding portion thereof that specifically binds to a PD-1 or PD-L1 receptor, or any combination thereof in a single formulation or separate formulations.

In other embodiments, a polynucleotides (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an IL12 polypeptide or with a polynucleotide (e.g., RNA, e.g., mRNA) comprising an ORF encoding an IL18 polypeptide, in a single formulation or separate formulations.

In other embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an IL12B and/or IL23A protein (e.g., IL23), and another anti-cancer agent, in a single formulation or separate formulations.

In some embodiments, a polynucleotide (e.g., RNA, e.g., mRNA) comprising an ORF encoding an IL18 polypeptide, is administered in combination with a polynucleotide (e.g., RNA, e.g., mRNA) comprising an ORF encoding an IL23 protein, a polynucleotide (e.g., RNA, e.g., mRNA) comprising an ORF encoding an IL12 protein, and an anti-cancer agent, in a single formulation or separate formulations.

In other embodiments, a polynucleotides (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an OX40L polypeptide, in a single formulation or separate formulations.

In other embodiments, the polynucleotide (e.g., RNA, e.g., mRNA) encoding an IL12B and/or IL23A polypeptide (e.g., IL23) is administered in combination with a polynucleotide encoding an antibody or an antigen binding portion thereof which specifically binds to CTLA-4 in a single formulation or separate formulations.

In other embodiments, a polynucleotide (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL12 protein or an IL18 protein; a polynucleotide (e.g., RNA, e.g., mRNA) comprising an ORF encoding an antibody or an antigen binding portion thereof which specifically binds to CTLA-4, or any combination thereof in a single formulation or separate formulations.

In other embodiments, a polynucleotide (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an OX40L protein; a polynucleotide (e.g., RNA, e.g., mRNA) comprising an ORF encoding an IL12 protein or an IL18 protein; and a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an OX40L polypeptide in a single formulation or separate formulations.

In some embodiments, a polynucleotide (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an IL18 polypeptide in a single formulation or separate formulations.

In some embodiments, a polynucleotide (e.g., RNA, e.g., mRNA) comprising an ORF encoding an IL12B and/or IL23A polypeptide (e.g., IL23) is administered in combination with a polynucleotide (e.g., RNA, e.g., mRNA) comprising an ORF encoding an IL12 in a single formulation or separate formulations.

In some embodiments, a polynucleotide (e.g., RNA, e.g., mRNA) comprising an ORF encoding an IL12B and/or IL23A polypeptide (e.g., IL23) is administered in combination with both a polynucleotide (e.g., RNA, e.g., mRNA) comprising an ORF encoding an IL18 polypeptide and an polynucleotide (e.g., RNA, e.g., mRNA) comprising an ORF encoding an IL12 polypeptide in a single formulation or separate formulations.

In some embodiments, a polynucleotide (e.g., RNA, e.g., mRNA) comprising an ORF encoding an IL12B and/or IL23A polypeptide (e.g., IL23), is administered in combination with a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding IL12B and/or IL23A polypeptide (e.g., IL23) is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL12 polypeptide, a polynucleotide (e.g., RNA, e.g., mRNA) comprising an ORF encoding an IL18 polypeptide, a polynucleotide (e.g., RNA, e.g., mRNA) comprising an ORF encoding a TLR4 (e.g., caTLR4) polypeptide, a polynucleotide (e.g., RNA, e.g., mRNA) comprising an ORF encoding an antibody or an antigen binding portion thereof which specifically binds to CTLA-4; or any combination thereof in a single formulation or separate formulations.

In some embodiments, a polynucleotide (e.g., RNA, e.g., mRNA) comprising an ORF encoding an IL12B and/or IL23A polypeptide; is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL12 polypeptide or a polynucleotide (e.g., RNA, e.g., mRNA) comprising an ORF encoding an IL18 protein; a polynucleotide (e.g., RNA, e.g., mRNA) comprising an ORF encoding an antibody or an antigen binding portion thereof which specifically binds to CTLA-4, or any combination thereof in a single formulation or separate formulations.

In some embodiments, a polynucleotide (e.g., RNA, e.g., mRNA) comprising an ORF encoding an IL12B and/or IL23A polypeptide (e.g., IL23); is administered in combination with a polynucleotide (e.g., RNA, e.g., mRNA) comprising an ORF encoding an OX40L polypeptide; a polynucleotide (e.g., RNA, e.g., mRNA) comprising an ORF encoding an IL12 polypeptide or a polynucleotide (e.g., RNA, e.g., mRNA) comprising an ORF encoding an IL18 polypeptide; and a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding an IL12 polypeptide, is administered in combination with an antibody or an antigen binding portion thereof that specifically binds to PD-1, e.g., an anti-PD-1 monoclonal antibody, e.g., an anti-PD-1 monoclonal antibody comprises Nivolumab, Pembrolizumab, Pidilizumab, or any combination thereof, in a single formulation or separate formulations.

In some embodiments, a polynucleotide (e.g., RNA, e.g., mRNA) comprising an ORF encoding an IL12 polypeptide, is administered in combination with a CTLA-4 antagonist, e.g., an antibody or antigen-binding portion thereof that specifically binds to CTLA-4, e.g., an anti-CTLA-4 monoclonal antibody, e.g., an anti-CTLA-4 monoclonal antibody comprises Ipilimumab or Tremelimumab, or any combination thereof in a single formulation or separate formulations.

In some embodiments, a polynucleotide (e.g., RNA, e.g., mRNA) comprising an ORF encoding a CD80 polypeptide, e.g., CD80Fc, is administered in combination with a polynucleotide (e.g., RNA, e.g., mRNA) comprising an ORF encoding an antibody or an antigen binding portion thereof which specifically binds to CTLA-4 in a single formulation or separate formulations.

In one embodiment, a first polynucleotide (e.g., RNA, e.g., mRNA) comprising an ORF encoding IL12 is administered in combination with a second polynucleotide (e.g., RNA, e.g., mRNA) comprising an ORF encoding an OX40L polypeptide, in a single formulation or separate formulations.

In one embodiment, a first polynucleotide (e.g., RNA, e.g., mRNA) comprising an ORF encoding an IL12 polypeptide and a second polynucleotide (e.g., RNA, e.g., mRNA) comprising an ORF encoding an OX40L polypeptide are administered in combination with an antibody or an antigen-binding portion thereof that specifically binds to a PD-1 or PD-L1 receptor or a polynucleotide encoding the same, in a single formulation or separate formulations.

In another embodiment, a first polynucleotide (e.g., RNA, e.g., mRNA) comprising an ORF encoding an IL12 polypeptide and a second polynucleotide (e.g., RNA, e.g., mRNA) comprising an ORF encoding an OX40L polypeptide are administered in combination with an antibody or an antigen-binding portion thereof that specifically binds to a CTLA-4 or a polynucleotide encoding the same, in a single formulation or separate formulations.

In yet another embodiment, a first polynucleotide (e.g., RNA, e.g., mRNA) comprising an ORF encoding an IL12 polypeptide and a second polynucleotide (e.g., RNA, e.g., mRNA) comprising an ORF encoding an OX40L polypeptide are administered in combination with an antibody or an antigen-binding portion thereof that specifically binds to a PD-1 or PD-L1 receptor and an antibody or an antigen-binding portion thereof that specifically binds to a CTLA-4 (or polynucleotides of the same), in a single formulation or separate formulations.

In some embodiments, a polynucleotide (e.g., RNA, e.g., mRNA) comprising an ORF encoding IL12 is administered in combination with a polynucleotide (e.g., RNA, e.g., mRNA) comprising an ORF encoding an antibody or an antigen binding portion thereof which specifically binds to CTLA-4 in a single formulation or separate formulations.

In some embodiments, a polynucleotide (e.g., RNA, e.g., mRNA) comprising an ORF encoding IL12 is administered in combination with a polynucleotide (e.g., RNA, e.g., mRNA) comprising an ORF encoding an OX40L protein in a single formulation or separate formulations.

In some embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding an OX40L protein, in a single formulation or separate formulations.

In other embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding an IL18 polypeptide, in a single formulation or separate formulations.

In other embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding an IL12B polypeptide, IL12A polypeptide, or both IL12B and IL12A polypeptides, in a single formulation or separate formulations.

In other embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding an IL12B and/or IL23A polypeptide, in a single formulation or separate formulations.

In other embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding a caTLR4 polypeptide (e.g., the wild-type sequence, functional fragment, or variant thereof), in a single formulation or separate formulations.

In other embodiments, a polynucleotide (e.g., RNA, e.g., mRNA) comprising an ORF encoding an antibody or an antigen binding portion thereof which specifically binds to CTLA-4 is administered in combination with a polynucleotide (e.g., RNA, e.g., mRNA) comprising an ORF encoding an OX40L protein; a polynucleotide (e.g., RNA, e.g., mRNA) comprising an ORF encoding an IL18 polypeptide; a polynucleotide (e.g., RNA, e.g., mRNA) comprising an ORF encoding an IL12B polypeptide, IL12A polypeptide, or both IL12B and IL12A polypeptides; a polynucleotide (e.g., RNA, e.g., mRNA) comprising an ORF encoding an IL12B and/or IL23A polypeptide; a polynucleotide (e.g., RNA, e.g., mRNA) comprising an ORF encoding a caTLR4 polypeptide (e.g., the wild-type sequence, functional fragment, or variant thereof), or any combination thereof, in a single formulation or separate formulations.

In some embodiments, a polynucleotide (e.g., RNA, e.g., mRNA) comprising an ORF encoding an antibody or an antigen binding portion thereof which specifically binds to CTLA-4, is administered in combination with a polynucleotide (e.g., RNA, e.g., mRNA) comprising an ORF encoding an OX40L protein in a single formulation or separate formulations.

In some embodiments, a polynucleotide (e.g., RNA, e.g., mRNA) comprising an ORF encoding an antibody or an antigen binding portion thereof which specifically binds to CTLA-4, is administered in combination with a polynucleotide (e.g., RNA, e.g., mRNA) comprising an ORF encoding an IL18 polypeptide in a single formulation or separate formulations.

In some embodiments, a polynucleotide (e.g., RNA, e.g., mRNA) comprising an ORF encoding an antibody or an antigen binding portion thereof which specifically binds to CTLA-4, is administered in combination with a polynucleotide (e.g., RNA, e.g., mRNA) comprising an ORF encoding an IL12B polypeptide, IL12A polypeptide, or both IL12B and IL12A polypeptides in a single formulation or separate formulations.

In some embodiments, a polynucleotide (e.g., RNA, e.g., mRNA) comprising an ORF encoding an antibody or an antigen binding portion thereof which specifically binds to CTLA-4, is administered in combination with a polynucleotide (e.g., RNA, e.g., mRNA) comprising an ORF encoding an IL12B and/or IL23A polypeptide in a single formulation or separate formulations.

In some embodiments, a polynucleotide (e.g., RNA, e.g., mRNA) comprising an ORF encoding an antibody or an antigen binding portion thereof which specifically binds to CTLA-4, is administered in combination with encoding a polynucleotide (e.g., RNA, e.g., mRNA) comprising an ORF encoding a caTLR4 polypeptide (e.g., the wild-type sequence, functional fragment, or variant thereof) in a single formulation or separate formulations.

In some embodiments, a polynucleotide (e.g., RNA, e.g., mRNA) comprising an ORF encoding an antibody or an antigen binding portion thereof which specifically binds to CTLA-4; is administered in combination with a polynucleotide (e.g., RNA, e.g., mRNA) comprising an ORF encoding an OX40L protein; a polynucleotide (e.g., RNA, e.g., mRNA) comprising an ORF encoding an IL18 polypeptide; a polynucleotide (e.g., RNA, e.g., mRNA) comprising an ORF encoding an IL12B polypeptide, IL12A polypeptide, or both IL12B and IL12A polypeptides; a polynucleotide (e.g., RNA, e.g., mRNA) comprising an ORF encoding an IL12B and/or IL23A polypeptide (e.g., IL23); a polynucleotide (e.g., RNA, e.g., mRNA) comprising an ORF encoding a caTLR4 polypeptide (e.g., the wild-type sequence, functional fragment, or variant thereof), or any combination thereof in a single formulation or separate formulations.

In another embodiment, a first polynucleotide (e.g., RNA, e.g., mRNA) comprising an ORF encoding IL12 and a second polynucleotide (e.g., RNA, e.g., mRNA) comprising an ORF encoding an OX40L polypeptide are administered in combination with an antibody or an antigen-binding portion thereof which specifically binds to CTLA-4, an antibody or antigen-binding portion thereof which specifically binds to a PD-1 receptor, or an antibody or antigen-binding portion thereof which specifically binds to a PD-L1 receptor, in a single formulation or separate formulations.

In one embodiment, the anti-PD-1 antibody (or an antigen-binding portion thereof) useful for the disclosure is pembrolizumab. Pembrolizumab (also known as "KEYTRUDA®", lambrolizumab, and MK-3475) is a humanized monoclonal IgG4 antibody directed against human cell surface receptor PD-1 (programmed death-1 or programmed cell death-1). Pembrolizumab is described, for example, in U.S. Pat. No. 8,900,587. Pembrolizumab has been approved by the FDA for the treatment of relapsed or refractory melanoma and advanced NSCLC.

In another embodiment, the anti-PD-1 antibody useful for the disclosure is nivolumab. Nivolumab (also known as "OPDIVO®"; formerly designated 5C4, BMS-936558, MDX-1106, or ONO-4538) is a fully human IgG4 (S228P) PD-1 immune checkpoint inhibitor antibody that selectively prevents interaction with PD-1 ligands (PD-L1 and PD-L2), thereby blocking the down-regulation of antitumor T-cell functions (U.S. Pat. No. 8,008,449; Wang et al., 2014 *Cancer Immunol Res.* 2(9):846-56). Nivolumab has shown activity in a variety of advanced solid tumors including renal cell carcinoma (renal adenocarcinoma, or hypernephroma), melanoma, and non-small cell lung cancer (NSCLC) (Topalian et al., 2012a; Topalian et al., 2014; Drake et al., 2013; WO 2013/173223.

In other embodiments, the anti-PD-1 antibody is MEDI0680 (formerly AMP-514), which is a monoclonal antibody against the PD-1 receptor. MEDI0680 is described, for example, in U.S. Pat. No. 8,609,089B2.

In certain embodiments, the anti-PD-1 antibody is BGB-A317, which is a humanized monoclonal antibody. BGB-A317 is described in U.S. Publ. No. 2015/0079109.

In certain embodiments, a PD-1 antagonist is AMP-224, which is a B7-DC Fc fusion protein. AMP-224 is discussed in U.S. Publ. No. 2013/0017199.

An exemplary clinical anti-CTLA-4 antibody is the human mAb 10D1 (now known as ipilimumab and marketed as YERVOY®) as disclosed in U.S. Pat. No. 6,984,720. Another anti-CTLA-4 antibody useful for the present methods is tremelimumab (also known as CP-675,206). Tremelimumab is human IgG2 monoclonal anti-CTLA-4 antibody. Tremelimumab is described in WO/2012/122444, U.S. Publ. No. 2012/263677, or WO Publ. No. 2007/113648 A2.

As disclosed above, the combination therapies disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) can be used to prevent and/or treat cancers, i.e., it can have prophylactic as well as therapeutic uses. Accordingly, the disclosure provides methods of reducing the size of a tumor or inhibiting the growth of a tumor in a subject in need thereof comprising administering to said subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide).

The present disclosure also includes a method of inducing a memory T cells response in a subject in need thereof comprising administering, e.g., administering intratumorally, a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one embodiment, the increase in immunokine production in the subject is directed to an anti-tumor immune response in the subject. In another embodiment, the increase in immunokine production is at least about two-fold, at least about three-fold, at least about four-fold, at least about five-fold, or at least about six-fold higher than a control (e.g., PBS treated). In certain embodiments, the intratumoral administration of the combination therapy can increase the efficacy of the anti-tumor effect (e.g., memory T cell response) compared to other routes of administration.

The present disclosure also includes a method of inducing T cell proliferation in a subject in need thereof comprising administering, e.g., administering intratumorally, a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In certain embodiments, the intratumoral administration of the combination therapy can increase the efficacy of the anti-tumor effect (e.g., T cell proliferation) compared to other routes of administration. In one embodiment, the T cell proliferation in the subject is directed to an anti-tumor immune response in the subject. In another embodiment, the T cell proliferation in the subject reduces or decreases the size of a tumor or inhibits the growth of a tumor in the subject. T cell proliferation can be measured using applications in the art such as cell counting, viability staining, optical density assays, or detection of cell-surface markers associated with T cell activation (e.g., CD69, CD40L, CD137, CD25, CD71, CD26, CD27, CD28, CD30, CD154, and CD134) with techniques such as flow cytometry.

The present disclosure also provides a method of activating T cells in a subject in need thereof comprising administering e.g., administering intratumorally, to the subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one aspect, the activation of T cells in the subject is directed to an anti-tumor immune response in the subject. In another aspect, the activated T cells in the subject reduce or decrease the size of a tumor or inhibit the growth of a tumor in the subject. Activation of T cells can be measured using applications in the art such as measuring T cell proliferation; measuring cytokine production with enzyme-linked immunosorbant assays (ELISA) or enzyme-linked immunospot assays (ELISPOT); or detection of cell-surface markers associated with T cell activation (e.g., CD69, CD40L, CD137, CD25, CD71, CD26, CD27, CD28, CD30, CD154, and CD134) with techniques such as flow cytometry. In certain embodiments, the intratumoral administration of the combination therapy can increase the efficacy of the anti-tumor effect (e.g., T cell activation) compared to other routes of administration.

In certain embodiments, the activated T cells by the present methods or compositions are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the activated T cells by the present methods or compositions are $Th_1$ cells. In other embodiments, the T cells activated by the present methods or compositions are $Th_2$ cells. In other embodiments, the T cells activated by the present disclosure are cytotoxic T cells.

In other embodiments, the present disclosure provides a method of inducing T cell infiltration in a tumor of a subject in need thereof comprising administering to the subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one embodiment, the T cell infiltration in a tumor of the subject is directed to an anti-tumor immune response in the subject. In another embodiment, the T cell infiltration in a tumor of the subject reduces or decreases the size of a tumor or inhibits the growth of a tumor in the subject. T cell infiltration in a tumor can be measured using applications in the art such as tissue sectioning and staining for cell markers, measuring local cytokine production at the tumor site, or detection of T cell-surface markers with techniques such as flow cytometry.

In some embodiments, the infiltrating T cells by the present methods or compositions are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the infiltrating T cells by the present methods or compositions are $Th_1$ cells. In other embodiments, the infiltrating T cells by the present methods or compositions are $Th_2$ cells. In other embodiments, the infiltrating T cells by the present disclosure are cytotoxic T cells.

In other embodiments, the present disclosures provides a method of inducing a memory T cell response in a subject in need thereof comprising administering to the subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one embodiment, the memory T cell response in the subject is directed to an anti-tumor immune response in the subject. In another embodiment, the memory T cell response in the subject reduces or decreases the size of a tumor or inhibits the growth of a tumor in the subject. A memory T cell response can be measured using applications in the art such as measuring T cell markers associated with memory T cells, measuring local cytokine production related to memory immune response, or detecting memory T cell-surface markers with techniques such as flow cytometry.

In some embodiments, the memory T cells induced by the present methods or compositions are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the memory T cells by the present methods or compositions are $Th_1$ cells. In other embodiments, the memory T cells by the present methods or compositions are $Th_2$ cells. In other embodiments, the memory T cells by the present disclosure are cytotoxic T cells.

The present disclosure further provides a method of increasing the number of Natural Killer (NK) cells in a subject in need thereof comprising administering to the subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one embodiment, the increase in the number of NK cells in the subject is directed to an anti-tumor immune response in the subject. In another aspect, the increase in the number of NK cells in the subject reduces or decreases the size of a tumor or inhibits the growth of a tumor in the subject. Increases in the number of NK cells in a subject can be measured using applications in the art such as detection of NK cell-surface markers (e.g., CD335/NKp46; CD336/NKp44; CD337/NPp30) or intracellular NK cell markers (e.g., perforin; granzymes; granulysin).

In certain embodiments, administration of a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) increases the total number of NK cells in the subject compared to the number of NK cells in a subject who is not administered with a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide).

In other embodiments, administration of a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) increases the total number of NK cells in the subject compared to a subject who is administered a dendritic cell transduced with one or more of the polynucleotide components (e.g., mRNAs) of the combination therapy.

In other embodiments, administration of a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) increases the number of NK cells in the subject within the tumor microenvironment compared to that of a subject who is not administered with the combination therapy.

In other embodiments, administration of a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) increases the number of NK cells in a subject within the tumor microenvironment compared to that of a subject who is administered a dendritic cell transduced with one or more of the polynucleotide components (e.g., mRNAs) of the combination therapy.

In other embodiments, the concentration of NK cells within the tumor microenvironment is increased while the total number of NK cells in the subject remains the same.

In certain embodiments, the number of NK cells is increased at least about two-fold, at least about three-fold, at least about four-fold, at least about five-fold, at least about six-fold, at least about seven-fold, at least about eight-fold, at least about nine-fold, or at least about ten-fold compared to a control (e.g., saline or a control mRNA). In a particular embodiment, the number of NK cells is increased after the administration of a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) at least about two-fold compared to a control (e.g., saline or a control mRNA).

The present disclosure further provides a method of increasing immunocytokine (e.g., interleukin-2) production in a subject in need thereof comprising administering to the subject a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide). In one embodiment, the increase in immunokine production in the subject is directed to an anti-tumor immune response in the subject. In another embodiment, the increase in immunokine production is at least about two-fold, at least about three-fold, at least about four-fold, at least about five-fold, or at least about six-fold higher than a control (e.g., PBS treated).

The present disclosure further provides a method of increasing IL-2 in a subject in need thereof comprising administering a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) to increase IL-2 in the subject in need thereof.

In one embodiment, the increase in IL-2 in the subject is directed to an anti-tumor immune response in the subject. In another embodiment, the increase in IL-2 expression by the administration of the combination therapy is at least about two-fold, at least about three-fold, at least about four-fold, at least about five-fold, or at least about six-fold higher than a control (e.g., PBS treated). The IL-2 expression can be measured using any available techniques, such as ELISA or ELISPOT assays.

The present disclosure also provides a method of increasing IL-4 in a subject in need thereof comprising administering a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) to increase IL-4 in the subject in need thereof.

In some embodiments, the increase in IL-4 in the subject is directed to an anti-tumor immune response in the subject. In one embodiment, the increase in IL-4 expression by a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) is at least about two-fold, at least about three-fold, at least about four-fold, at least about five-fold, or at least about six-fold higher than a control (e.g., PBS treated). The IL-4 expression can be measured using any available techniques, such as ELISA or ELISPOT assays.

The present disclosure also provides a method of increasing IL-21 in a subject in need thereof comprising administering a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide) to increase IL-21 in the subject in need thereof. In one aspect, the increase in IL-21 in the subject is directed to an anti-tumor immune response in the subject.

In certain embodiments, the disclosure includes a method of inducing an adaptive immune response, an innate immune response, or both adaptive and innate immune response against tumor comprising administering a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide).

In certain embodiments, the present disclosure is also directed to a method of increasing IFNγ expression in a subject having tumor comprising administering a combination therapy disclosed herein (e.g., at least two polynucleotides, wherein each polynucleotide comprises an ORF encoding an immune response primer polypeptide, an immune response co-stimulatory signal polypeptide, or an a checkpoint inhibitor polypeptide).

In some embodiments of the methods disclosed herein, the size of a tumor can be reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% or about 100%, with respect to the original size of the tumor prior to treatment with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide).

In some embodiments of the methods disclosed herein, the growth of a tumor can be inhibited by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% or about 100%, with respect to the original growth rate of the tumor prior to treatment with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide).

In some embodiments of the methods disclosed herein, the survival rate can be increased by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or at least about 100%, with respect to the survival rate of a population of subjects which have not been treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide).

In some embodiments of the methods disclosed herein, the survival rate in a subject treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can be at least 2-fold, at least 3-fold, at least 4-fold, at least 5-fold, at least 6-fold, at least 7-fold, at least 8-fold, at least 9-fold or at least 10-fold higher than the survival rate of a population of subjects which have not been treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide).

In some embodiments of the methods disclosed herein, the survival rate in a population of subjects in need of treatment which have been treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can be at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

In some embodiments, response rate (e.g., partial response or complete response) in a population of subjects in need of treatment which have been treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can be at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

In some embodiments, the complete response or complete remission rate in a population of subjects in need of treatment which have been treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can be at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

In some specific embodiments, the complete remission rate for subjects treated with a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) is about 100% when a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) is administered in one, two, three, or more doses, wherein the doses are about 0.5 mg mRNA/kg.

In some embodiments, the inhibition of tumor growth following the administration of a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can result in complete remission (i.e., complete response), improvement in response or partial response (e.g., increase in time survival, size of tumors, etc.), lowering of tumor burden, or a combination thereof.

In one embodiment, the administration of a combination therapy disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) results in complete remission.

In some embodiments, one or more of the polynucleotides in a combination therapy (e.g., at least two polynucleotides, wherein each polynucleotide comprises an ORF encoding an immune response primer polypeptide, an immune response co-stimulatory signal polypeptide, or a checkpoint inhibitor polypeptide) comprise at least one chemically modified nucleoside. In some embodiments, all the polynucleotides (e.g., mRNAs) in a combination therapy disclosed herein comprise at least one chemically modified nucleoside.

In some embodiments, the at least one chemically modified nucleoside is selected from the group consisting of pseudouridine, N1-methylpseudouridine, 5-methylcytosine, 5-methoxyuridine, and a combination thereof. In some embodiments, the nucleosides in one or more of the polynucleotides (e.g., mRNAs) in a combination therapy disclosed herein are chemically modified by at least 10%, at least 15%. at least 20%, at least 25%, at least at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, or 100%. In some embodiments, the chemically modified nucleosides in one or more of the polynucleotides (e.g., mRNAs) in a combination therapy disclosed herein are selected from the group consisting of uridine, adenine, cytosine, guanine, and any combination thereof.

In some embodiments, the uridine nucleosides in one or more of the polynucleotides (e.g., mRNAs) in a combination therapy disclosed herein are chemically modified by at least 10%, at least 15%. at least 20%, at least 25%, at least at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, or 100%.

In some embodiments, the adenosine nucleosides in one or more of the polynucleotides (e.g., mRNAs) in a combination therapy disclosed herein are chemically modified by at least 10%, at least 15%. at least 20%, at least 25%, at least at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, or 100%.

In some embodiments, the cytidine nucleosides in one or more of the polynucleotides (e.g., mRNAs) in a combination therapy disclosed herein are chemically modified by at least 10%, at least 15%. at least 20%, at least 25%, at least at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, or 100%.

In some embodiments, the guanosine nucleosides in one or more of the polynucleotides (e.g., mRNAs) in a combination therapy disclosed herein are chemically modified by at least 10%, at least 15%. at least 20%, at least 25%, at least at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, or 100%.

In some embodiments, one or more of the polynucleotides (e.g., mRNAs) in a combination therapy disclosed herein comprises at least one miRNA binding site. In some embodiments, the miRNA binding site is a miR-122 binding site, e.g., a miR-122-3p and/or a miR-122-5p binding site. In some embodiments, the miRNA binding site comprises a nucleotide sequence at least 80%, at least 85%, at least 90%, at least 95%, or 100% identical to aacgccauuaucacacuaaaua (SEQ ID NO: 1212), wherein the miRNA binding site binds to miR-122. In some embodiments, the miRNA binding site comprises a nucleotide sequence at least 80%, at least 85%, at least 90%, at least 95%, or 100% identical to uggagugugacaaugguguuug (SEQ ID NO: 1214), wherein the miRNA binding site binds to miR-122. In some embodiments, the polynucleotides (e.g., mRNAs) in a combination therapy disclosed herein comprise different miRNA binding sites or the same miRNA binding site.

In some embodiments, one or more of the polynucleotides (e.g., mRNAs) in a combination therapy disclosed herein comprise a 5' untranslated region (UTR). In some embodiments, the 5' UTR comprises a nucleic acid sequence at least 90%, 95%, 96%, 97%, 98%, 99%, or 100% identical to a sequence listed in TABLE 20.

In some embodiments, one or more of the polynucleotides (e.g., mRNAs) in a combination therapy disclosed herein comprise a 3' untranslated region (UTR). In some embodiments, the 3' UTR comprises a nucleic acid sequence at least 90%, 95%, 96%, 97%, 98%, 99%, or 100% identical to a sequence listed in TABLE 21 or TABLE 22. In some embodiments, the miRNA binding site is inserted within the 3' UTR.

In some embodiments, one or more of the polynucleotides (e.g., mRNAs) in a combination therapy disclosed herein comprise a spacer sequence fused to the miRNA binding site. In some embodiments, the spacer sequence comprises at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides.

In some embodiments, one or more of the polynucleotides (e.g., mRNAs) in a combination therapy disclosed herein comprise a 5' terminal cap structure. In some embodiments, the 5' terminal cap is a Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof.

In some embodiments, one or more of the polynucleotides (e.g., mRNAs) in a combination therapy disclosed herein comprise a 3' polyA tail.

In some embodiments, one or more of the polynucleotides (e.g., mRNAs) in a combination therapy disclosed herein comprise at least two, at least three, at least four, at least five, at least six, at least seven, at least eight, at least nine, or at least ten miRNA binding sites.

In some embodiments, one or more of the polynucleotides (e.g., mRNAs) in a combination therapy disclosed herein are codon optimized. In some embodiments, one or more of the polynucleotides (e.g., mRNAs) in a combination therapy disclosed herein are in vitro transcribed (IVT). In some embodiments, one or more of the polynucleotides (e.g., mRNAs) in a combination therapy disclosed herein are chimeric. In some embodiments, one or more of the polynucleotides (e.g., mRNAs) in a combination therapy disclosed herein are circular.

In some embodiments, one or more of the polynucleotides (e.g., mRNAs) in a combination therapy disclosed herein is formulated with a delivery agent. In some embodiments, the delivery agent comprises a lipidoid, a liposome, a lipoplex, a lipid nanoparticle, a polymeric compound, a peptide, a protein, a cell, a nanoparticle mimic, a nanotube, or a conjugate. In some embodiments, the delivery agent is a lipid nanoparticle. In some embodiments, the lipid nanoparticle comprises a lipid selected from the group consisting of DLin-DMA, DLin-K-DMA, 98N12-5, C12-200, DLin-MC3-DMA, DLin-KC2-DMA, DODMA, PLGA, PEG, PEG-DMG, PEGylated lipids, amino alcohol lipids, KL22, and combinations thereof.

In some embodiments, the delivery agent comprises a compound having formula (I)

(I)

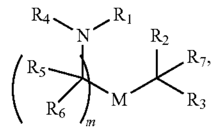

or a salt or stereoisomer thereof, wherein $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a carbocycle, heterocycle, —OR, $—O(CH_2)_nN(R)_2$, —C(O)OR, —OC(O)R, $—CX_3$, $—CX_2H$, $—CXH_2$, —CN, $—N(R)_2$, $—C(O)N(R)_2$, —N(R)C(O)R, $—N(R)S(O)_2R$, $—N(R)C(O)N(R)_2$, $—N(R)C(S)N(R)_2$, and $—C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13; and provided when $R_4$ is $—(CH_2)_nQ$, $—(CH_2)_nCHQR$, —CHQR, or $—CQ(R)_2$, then (i) Q is not $—N(R)_2$ when n is 1, 2, 3, 4 or 5, or (ii) Q is not 5, 6, or 7-membered heterocycloalkyl when n is 1 or 2.

In some embodiments, the compound in the delivery agent is of Formula (IA):

(IA)

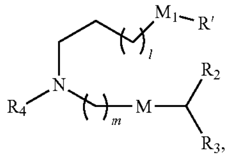

or a salt or stereoisomer thereof, wherein l is selected from 1, 2, 3, 4, and 5;

m is selected from 5, 6, 7, 8, and 9;

$M_1$ is a bond or M';

$R_4$ is unsubstituted $C_{1-3}$ alkyl, or —$(CH_2)_nQ$, in which n is 1, 2, 3, 4, or 5 and Q is OH, —NHC(S)N$(R)_2$, or —NHC(O)N$(R)_2$;

M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments of formula (I) or formula (IA), m is 5, 7, or 9.

In some embodiments, the compound in the delivery agent is of Formula (II):

(II)

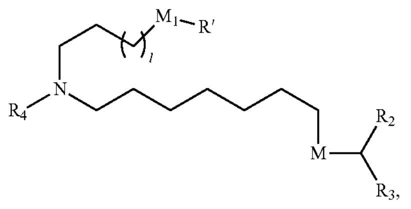

or a salt or stereoisomer thereof, wherein l is selected from 1, 2, 3, 4, and 5;

$M_1$ is a bond or M';

$R_4$ is unsubstituted $C_{1-3}$ alkyl, or —$(CH_2)_nQ$, in which n is 2, 3, or 4 and Q is OH, —NHC(S)N$(R)_2$, or —NHC(O)N$(R)_2$;

M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, the compound in the delivery agent is selected from Compound 1 to Compound 147, and salts and stereoisomers thereof.

In some embodiments, the compound in the delivery agent is of the Formula (IIa), (IIa)

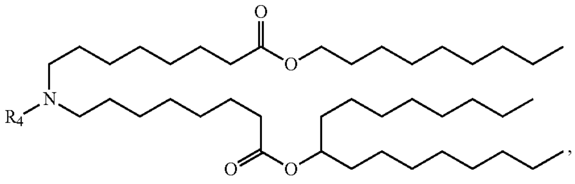

or a salt or stereoisomer thereof.

In some embodiments, the compound in the delivery agent is of the Formula (IIb), (IIb)

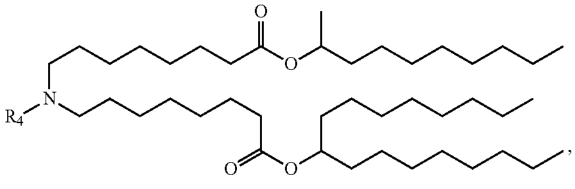

or a salt or stereoisomer thereof.

In some embodiments, the compound in the delivery agent is of the Formula (IIc) or (IIe), (IIc)

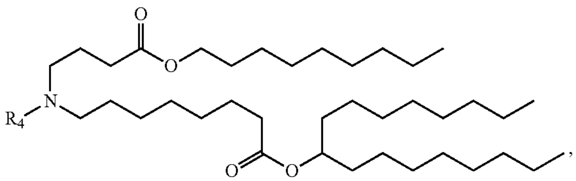

(IIe)

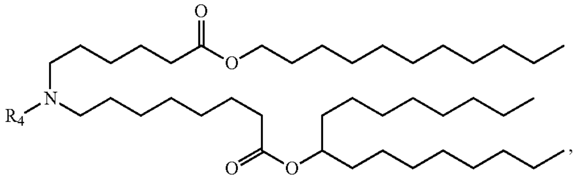

or a salt or stereoisomer thereof.

In some embodiments of formula (IIa), formula (IIb) or formula (IIe), $R_4$ is selected from —$(CH_2)_nQ$ and —$(CH_2)_n$CHQR, wherein Q, R and n are as defined above.

In some embodiments, the compound in the delivery agent is of the Formula (IId), (IId)

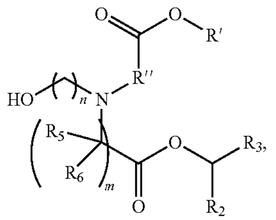

or a salt or stereoisomer thereof, wherein $R_2$ and $R_3$ are independently selected from the group consisting of $C_{5-14}$ alkyl and $C_{5-14}$ alkenyl, n is selected from 2, 3, and 4, R', is independently selected from the group consisting of $C_{1-18}$ alkyl, $C_{2-18}$ alkenyl, —R*YR", and H, R", is independently selected from the group consisting of $C_{3-14}$ alky and $C_{3-14}$ alkenyl. $R_5$ is independently selected from the group consisting of $C_{1-3}$ alkyl, $C_{2-3}$ alkenyl, and H, $R_6$ is independently selected from the group consisting of $C_{1-3}$ alkyl. $C_{2-3}$ alkenyl, and H and m is 5, 7 or 9.

In some embodiments of formula (IId), $R_2$ is $C_8$ alkyl. In some embodiments of formula (IId), $R_3$ is $C_5$ alkyl, $C_6$ alkyl, $C_7$ alkyl, $C_8$ alkyl, or $C_9$ alkyl. In some embodiments of formula (IId), m is 5, 7, or 9. In some embodiments of formula (IId), each $R_5$ is H. In some embodiments of formula (IId), each $R_6$ is H.

In some embodiments, the delivery agent further comprises a phospholipid. In some embodiments, the phospholipid is selected from the group consisting of 1,2-dilinoleoyl-sn-glycero-3-phosphocholine (DLPC),
1,2-dimyristoyl-sn-glycero-phosphocholine (DMPC),
1,2-dioleoyl-sn-glycero-3-phosphocholine (DOPC),
1,2-dipalmitoyl-sn-glycero-3-phosphocholine (DPPC),
1,2-distearoyl-sn-glycero-3-phosphocholine (DSPC),
1,2-diundecanoyl-sn-glycero-phosphocholine (DUPC), 1-palmitoyl-2-oleoyl-sn-glycero-3-phosphocholine (POPC),
1,2-di-O-octadecenyl-sn-glycero-3-phosphocholine (18:0 Diether PC),
1-oleoyl-2-cholesterylhemisuccinoyl-sn-glycero-3-phosphocholine (OChemsPC),
1-hexadecyl-sn-glycero-3-phosphocholine (C16 Lyso PC),
1,2-dilinolenoyl-sn-glycero-3-phosphocholine,
1,2-diarachidonoyl-sn-glycero-3-phosphocholine,
1,2-didocosahexaenoyl-sn-glycero-3-phosphocholine,
1,2-dioleoyl-sn-glycero-3-phosphoethanolamine (DOPE),
1,2-diphytanoyl-sn-glycero-3-phosphoethanolamine (ME 16:0 PE),
1,2-distearoyl-sn-glycero-3-phosphoethanolamine,
1,2-dilinoleoyl-sn-glycero-3-phosphoethanolamine,
1,2-dilinolenoyl-sn-glycero-3-phosphoethanolamine,
1,2-diarachidonoyl-sn-glycero-3-phosphoethanolamine,
1,2-didocosahexaenoyl-sn-glycero-3-phosphoethanolamine,
1,2-dioleoyl-sn-glycero-3-phospho-rac-(1-glycerol) sodium salt (DOPG), sphingomyelin,
and mixtures thereof.

In some embodiments, the phospholipid is selected from the group consisting of
1-myristoyl-2-palmitoyl-sn-glycero-3-phosphocholine (14:0-16:0 PC, MPPC),
1-myristoyl-2-stearoyl-sn-glycero-3-phosphocholine (14:0-18:0 PC, MSPC),
1-palmitoyl-2-acetyl-sn-glycero-3-phosphocholine (16:0-02:0 PC),
1-palmitoyl-2-myristoyl-sn-glycero-3-phosphocholine (16:0-14:0 PC, PMPC),
1-palmitoyl-2-stearoyl-sn-glycero-3-phosphocholine (16:0-18:0 PC, PSPC),
1-palmitoyl-2-oleoyl-sn-glycero-3-phosphocholine (16:0-18:1 PC, POPC),
1-palmitoyl-2-linoleoyl-sn-glycero-3-phosphocholine (16:0-18:2 PC, PLPC),
1-palmitoyl-2-arachidonoyl-sn-glycero-3-phosphocholine (16:0-20:4 PC),
1-palmitoyl-2-docosahexaenoyl-sn-glycero-3-phosphocholine (14:0-22:6 PC),
1-stearoyl-2-myristoyl-sn-glycero-3-phosphocholine (18:0-14:0 PC, SMPC),
1-stearoyl-2-palmitoyl-sn-glycero-3-phosphocholine (18:0-16:0 PC, SPPC),
1-stearoyl-2-oleoyl-sn-glycero-3-phosphocholine (18:0-18:1 PC, SOPC),
1-stearoyl-2-linoleoyl-sn-glycero-3-phosphocholine (18:0-18:2 PC),
1-stearoyl-2-arachidonoyl-sn-glycero-3-phosphocholine (18:0-20:4 PC),
1-stearoyl-2-docosahexaenoyl-sn-glycero-3-phosphocholine (18:0-22:6 PC),
1-oleoyl-2-myristoyl-sn-glycero-3-phosphocholine (18:1-14:0 PC, OMPC),
1-oleoyl-2-palmitoyl-sn-glycero-3-phosphocholine (18:1-16:0 PC, OPPC),
1-oleoyl-2-stearoyl-sn-glycero-3-phosphocholine (18:1-18:0 PC, OSPC),
1-palmitoyl-2-oleoyl-sn-glycero-3-phosphoethanolamine (16:0-18:1 PE, POPE),
1-palmitoyl-2-linoleoyl-sn-glycero-3-phosphoethanolamine (16:0-18:2 PE),
1-palmitoyl-2-arachidonoyl-sn-glycero-3-phosphoethanolamine (16:0-20:4 PE),
1-palmitoyl-2-docosahexaenoyl-sn-glycero-3-phosphoethanolamine (16:0-22:6 PE),
1-stearoyl-2-oleoyl-sn-glycero-3-phosphoethanolamine (18:0-18:1 PE),
1-stearoyl-2-linoleoyl-sn-glycero-3-phosphoethanolamine (18:0-18:2 PE),
1-stearoyl-2-arachidonoyl-sn-glycero-3-phosphoethanolamine (18:0-20:4 PE),
1-stearoyl-2-docosahexaenoyl-sn-glycero-3-phosphoethanolamine (18:0-22:6 PE),
1-oleoyl-2-cholesterylhemisuccinoyl-sn-glycero-3-phosphocholine (OChemsPC), and
any combination thereof.

In some embodiments, the delivery agent further comprises a structural lipid. In some embodiments, the structural lipid is selected from the group consisting of cholesterol, fecosterol, sitosterol, ergosterol, campesterol, stigmasterol, brassicasterol, tomatidine, ursolic acid, alpha-tocopherol, and mixtures thereof.

In some embodiments, the delivery agent further comprises a PEG lipid. In some embodiments, the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the delivery agent further comprises an ionizable lipid selected from the group consisting of
3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethyl aminomethyl-[1,3]-dioxolane (DLin-K-DMA),
heptatriaconta-6,9,28,31-tetraen-19-yl 4-(dimethylamino) butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2S)).

In some embodiments, the delivery agent further comprises a quaternary amine compound. In some embodiments, the quaternary amine compound is selected from the group consisting of
1,2-dioleoyl-3-trimethylammonium-propane (DOTAP),
N-[1-(2,3-dioleoyloxy)propyl]-N,N,N-trimethylammonium chloride (DOTMA),
1-[2-(oleoyloxy)ethyl]-2-oleyl-3-(2-hydroxyethyl)imidazolinium chloride (DOTIM),
2,3-dioleyloxy-N-[2(sperminecarboxamido)ethyl]-N,N-dimethyl-1-propanaminium trifluoroacetate (DOSPA),
N,N-distearyl-N,N-dimethylammonium bromide (DDAB),
N-(1,2-dimyristyloxyprop-3-yl)-N,N-dimethyl-N-hydroxyethyl ammonium bromide (DMRIE),
N-(1,2-dioleoyloxyprop-3-yl)-N,N-dimethyl-N-hydroxyethyl ammonium bromide (DORIE), N,N-dioleyl-N,N-dimethyl ammonium chloride (DODAC),
1,2-dilauroyl-sn-glycero-3-ethylphosphocholine (DLePC),
1,2-distearoyl-3-trimethylammonium-propane (DSTAP),
1,2-dipalmitoyl-3-trimethylammonium-propane (DPTAP),
1,2-dilinoleoyl-3-trimethylammonium-propane (DLTAP),
1,2-dimyristoyl-3-trimethylammonium-propane (DMTAP),
1,2-distearoyl-sn-glycero-3-ethylphosphocholine (DSePC),
1,2-dipalmitoyl-sn-glycero-3-ethylphosphocholine (DPePC),
1,2-dimyristoyl-sn-glycero-3-ethylphosphocholine (DMePC),
1,2-dioleoyl-sn-glycero-3-ethylphosphocholine (DOePC),
1,2-di-(9Z-tetradecenoyl)-sn-glycero-3-ethylphosphocholine (14:1 EPC),
1-palmitoyl-2-oleoyl-sn-glycero-3-ethylphosphocholine (16:0-18:1 EPC),
and any combination thereof.

The present disclosure provides a composition comprising (i) one or more of the polynucleotides (e.g., mRNAs) disclosed herein and a pharmaceutically acceptable carrier, or (ii) one or more of the polynucleotides (e.g., mRNAs) disclosed herein formulated in one of the delivery agents disclosed above. In some embodiments, the compositions disclosed herein are compositions for use in reducing or decreasing a size of a tumor or inhibiting a tumor growth in a subject in need thereof.

The present disclosures provides a pharmaceutical composition comprising at least two mRNAs, wherein the mRNAs are selected from:

(i) one or more mRNAs having an open reading frame encoding an immune response primer polypeptide;
(ii) one or more mRNAs having an open reading frame encoding an immune response costimulatory signal polypeptide; and
(iii) one or more mRNAs having an open reading frame encoding a checkpoint inhibitor polypeptide, and a pharmaceutically acceptable carrier.

In some embodiments, the pharmaceutical composition comprises (i) an mRNA having an open reading frame encoding an immune response primer polypeptide and (ii) an mRNA having an open reading frame encoding an immune response costimulatory signal polypeptide. In some embodiments, the pharmaceutical composition comprises two mRNAs each having an open reading frame encoding an immune response primer polypeptide. In some embodiments, the pharmaceutical composition comprises (i) an mRNA having an open reading frame encoding an immune response costimulatory signal polypeptide and (ii) an mRNA having an open reading frame encoding a checkpoint inhibitor polypeptide. In some embodiments, the pharmaceutical composition comprises (i) an mRNA having an open reading frame encoding an immune response costimulatory signal polypeptide, (ii) an mRNA having an open reading frame encoding an immune response costimulatory signal polypeptide, and (iii) an mRNA having an open reading frame encoding a checkpoint inhibitor polypeptide.

In some embodiments of the pharmaceuticals compositions disclosed herein, the immune response primer polypeptide comprises interleukin 12 (IL12), interleukin (IL23), Toll-like receptor 4 (TLR4), interleukin 36 gamma (IL36gamma), interleukin 18 (IL18), or a combination thereof. In some embodiments of the pharmaceuticals compositions disclosed herein, the immune response co-stimulatory signal polypeptide comprises tumor necrosis factor receptor superfamily member 4 ligand (OX40L), cluster of differentiation 80 (CD80), interleukin 15 (IL15), or a combination thereof. In some embodiments of the pharmaceuticals compositions disclosed herein, the checkpoint inhibitor polypeptide inhibits programmed cell death protein 1 (PD-1), programmed death-ligand 1 (PD-L1), or cytotoxic T-lymphocyte-associated protein 4 (CTLA-4).

In some specific embodiments, the pharmaceutical composition comprises:

(a) an mRNA that comprises
  (i) a 5' untranslated region (5'-UTR) comprising a 5' cap;
  (ii) an open reading frame (ORF) encoding at least one polypeptide disclosed herein (e.g., IL12, IL15, IL18, IL23, IL36gamma, TLR4, CD80, OX40L, anti-CTLA-4, anti-PD-1, or anti-PD-L1), wherein the ORF comprises at least one chemically modified nucleobase, sugar, backbone, or any combination thereof;
  (iii) at least one stop codon;
  (iv) a microRNA (miRNA) binding site;
  (v) a 3' untranslated region (3'-UTR);
  (vi) a polyA tail; and,
(b) a lipid nanoparticle carrier.

In some embodiments, the pharmaceutical composition comprises 2, 3, 4, 5, 6 or more mRNAs, wherein each mRNA comprises at least one ORF encoding at least one polypeptide disclosed herein (e.g., IL12, IL5, IL8, IL23, IL36gamma, TLR4, CD80, OX40L, anti-CTLA-4, anti-PD-1, or anti-PD-L1). In some embodiments, the mRNA in the pharmaceutical composition comprises at least one chemically modified nucleobase, sugar, backbone, or any combination thereof. In some embodiments, each mRNA in the pharmaceutical composition is formulated in the same lipid nanoparticle carrier. In some embodiments, each mRNA in the pharmaceutical composition is formulated in a different lipid nanoparticle carrier.

In some embodiments, the compositions disclosed herein (e.g., polynucleotides used in combination therapies disclosed herein, or pharmaceutical compositions comprising those polynucleotides) are formulated for in vivo delivery. In some embodiments, such in vivo delivery can be, e.g., intramuscular, subcutaneous, intratumoral, or intradermal delivery. In some embodiments, the compositions disclosed herein are administered subcutaneously, intravenously, intramuscularly, intra-articularly, intra-synovially, intrasternally, intrathecally, intrahepatically, intralesionally, intracranially, intraventricularly, orally, by inhalation spray, topically, rectally, nasally, buccally, vaginally or via an implanted reservoir.

In some embodiments, the compositions disclosed herein (e.g., polynucleotides used in combination therapies disclosed herein, or pharmaceutical compositions comprising those polynucleotides) can be administered to a subject in need thereof to treat a cancer. In some embodiments, the cancer is selected from the group consisting of adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, hepatocellular carcinoma (HCC), non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor, secondary cancers caused by cancer treatment, and any combination thereof.

In some embodiments, the compositions disclosed herein (e.g., polynucleotides used in combination therapies disclosed herein, or pharmaceutical compositions comprising those polynucleotides) can be delivered by a device comprising a pump, patch, drug reservoir, short needle device, single needle device, multiple needle device, micro-needle device, jet injection device, ballistic powder/particle delivery device, catheter, lumen, cryoprobe, cannula, microcanular, or devices utilizing heat, RF energy, electric current, or any combination thereof.

In some embodiments, the effective amount of the compositions disclosed herein (e.g., polynucleotides used in combination therapies disclosed herein, or pharmaceutical compositions comprising those polynucleotides) is between about 0.10 mg/kg to about 1,000 mg/kg. In some embodiments, the compositions disclosed herein (e.g., polynucleotides used in combination therapies disclosed herein, or pharmaceutical compositions comprising those polynucleotides) are administered to a human subject.

In some embodiments, wherein the administration the compositions disclosed herein (e.g., polynucleotides used in combination therapies disclosed herein, or pharmaceutical compositions comprising those polynucleotides) reduces the size of a tumor or inhibits growth of a tumor at least 1.5 fold, at least 2 fold, at least 2.5 fold, at least 3 fold, at least 3.5 fold, at least 4 fold, at least 4.5 fold, or at least 5 fold better than a monotherapy consisting of administration of only one of the polynucleotides (e.g., mRNAs) of the composition.

In some embodiments, the efficacy of the combination therapies disclosed herein can be determined by measuring the reduction in the size of a tumor (e.g., tumor volume in $mm^3$) derived from MC38(C), or the inhibition of the growth of a tumor derived from MC38(C) in a mouse when a dose of 5 μg of each polynucleotide (e.g., mRNA) in the combination is administered to the mouse.

In some embodiments, the efficacy of the combination therapies disclosed herein can be determined by measuring the reduction in the size of a tumor (e.g., tumor volume in $mm^3$) derived from MC38(M), or the inhibits of the growth of a tumor derived from MC38(M) in a mouse when a dose of 5 μg of each polynucleotide (e.g., mRNA) is administered to the mouse.

In some embodiments, additional measures of efficacy can be used, such as survival or body weight. Reduction in the size of the tumor, inhibition of the growth of the tumor, increased survival, increase in body weight, are indicative of efficacy in the treatment of the tumor.

The present disclosure also provides a kit comprising any of the compositions disclosed herein and instructions to use according to the method (e.g., methods of treatment) disclosed herein.

III. EXEMPLARY COMBINATION THERAPY COMPONENTS

In some aspects of the present disclosure, the combination therapies disclosed herein (e.g., at least two polynucleotides, wherein each polynucleotide comprises an ORF encoding an immune response primer polypeptide, an immune response co-stimulatory signal polypeptide, or a checkpoint inhibitor polypeptide) can comprise one or more of the components described below. The components detailed in the following section are not limiting, and (i) polynucleotides encoding other immune response primer polypeptides known in the art (e.g., IL36), (ii) polynucleotides encoding other immune response co-stimulatory signal polypeptides known in the art, (iii) polynucleotides encoding other checkpoint inhibitor polypeptides known in the art, or (iv) combinations thereof, can be used to prepare the combination therapies disclosed herein and to practice the methods, e.g., methods of treatment provided in the present disclosure.

A. Cytotoxic T-Lymphocyte-Associated Protein 4 (CTLA-4)

In some embodiments, the combination therapies disclosed herein comprise one or more anti-CTLA-4 polynucleotides (e.g., mRNAs), i.e., polynucleotides comprising one or more ORFs encoding an antibody or an antigen-binding portion thereof that specifically binds to CTLA-4.

CTLA-4 is a member of the CD28-B7 immunoglobulin superfamily of immune regulatory molecules. CTLA-4 is expressed on the surface of T cells, where it is able to suppress T cell activation downstream of T-cell receptor (TCR) signaling. (Schwartz, Cell 71:1065-1068 (1992); Krummel and Allison, J Exp. Med. 182:459-465 (1995)). CTLA-4 is also believed to outcompete the T cell costimulatory CD28 for the B7 ligands, CD80 and CD86, on the surface of antigen-presenting cells (APCs) by binding them with higher affinity and avidity (Linsley et al., J Exp Med. 174:561-569 (1991)). The physiologic role of CTLA-4 is not only to suppress effector T cells (Teffs), but also to increase the function of immunosuppressive, regulatory T cells (Tregs) (Wing et al., Science 322:271-5 (2008)).

The canonical sequence of human CTLA-4 (SEQ ID NO:1), isoform 1, is 223 amino acids long. It contains a signal peptide at positions 1-35. The mature form comprises residues 36 to 223 (SEQ ID NO:3), of which residues 36-161 are the extracellular domain (SEQ ID NO: 2), residues 162-182 are a transmembrane helix, and residues 183-223 are the intracellular domain. Four additional isoforms have been described in the literature.

Isoform 2 (SEQ ID NO:4), also known as ss-CTLA-4, is 56 amino acids long and lacks the region from residue 38 to residue 204. Isoform 3 (SEQ ID NO:5) is 58 amino acids long and also lacks the region from residue 38 to residue 204. In addition, isoform 3 has an alternative sequence between residues 205 and 223. Isoform 4 (SEQ ID NO:6) is 79 amino acids long, lacks the region from residue 59 to residue 204, has an alternative sequence from residue 205 to residue 223, and contains a C58S point mutation. Isoform 5 (SEQ ID NO:7) is 174 amino acids long, lacks the sequence from residue 175 to residue 223, and contains an alternative sequence from residue 153 to residue 174.

Polynucleotides Encoding Anti CTLA-4 Antibodies:

The present disclosure provides anti-CTLA-4 polynucleotides. As used herein the term "anti-CTLA-4 polynucleotide" refers to one or more polynucleotides (e.g., one or more mRNAs) encoding an antibody or antigen binding portion thereof which specifically binds to CTLA-4 which can be used in the combination therapies disclosed herein.

In some embodiments, the anti-CTLA-4 polynucleotide comprises one or more mRNAs (e.g., two, three, four, or more mRNAs) encoding a protein sequence listed in TABLE 1 or a portion thereof that specifically binds to CTLA-4.

In some embodiments, the anti-CTLA-4 polynucleotide comprises one or more mRNAs corresponding to the full sequence or a subsequence of a DNA sequence listed in TABLE 1, wherein said subsequence encodes a polypeptide that specifically binds to CTLA-4.

TABLE 1

Anti-CTLA-4 Antibody Polypeptide and Polynucleotide Sequences

| SEQ ID NO | Description |
|---|---|
| 8 | VH DNA (CTLA-4-Ab_001) |
| 9 | VH protein (CTLA-4-Ab_001) |
| 10 | VL DNA (CTLA-4-Ab_001) |
| 11 | VL protein (CTLA-4-Ab_001) |
| 12 | VH protein (CTLA-4-Ab_001A) |
| 13 | VL protein (CTLA-4-Ab_001A) |
| 14 | VH-CDR1 protein (CTLA-4-Ab_001) |
| 15 | VH-CDR2 protein (CTLA-4-Ab_001) |
| 16 | VH-CDR3 protein (CTLA-4-Ab_001) |
| 17 | VL-CDR1 protein (CTLA-4-Ab_001) |
| 18 | VL-CDR2 protein (CTLA-4-Ab_001) |
| 19 | VL-CDR3 protein (CTLA-4-Ab_001) |
| 20 | HC DNA (CTLA-4-Ab_001, VH encoding portion differs from Sequence 8 by three nucleotides) |
| 21 | HC protein (CTLA-4-Ab_001, VH portion differs from Sequence 9 by two amino acids) |
| 22 | LC DNA (CTLA-4-Ab_001) |
| 23 | LC protein (CTLA-4-Ab_001) |
| 24 | HC DNA (CTLA-4-Ab_002) |
| 25 | HC protein (CTLA-4-Ab_002) |
| 26 | LC DNA (CTLA-4-Ab_002) |
| 27 | LC protein (CTLA-4-Ab_002) |
| 28 | VH protein (CTLA-4-Ab_002) |
| 29 | VL protein (CTLA-4-Ab_002) |
| 30 | VH-CDR1 protein (CTLA-4-Ab_002) |
| 31 | VH-CDR2 protein (CTLA-4-Ab_002) |
| 32 | VH-CDR3 protein (CTLA-4-Ab_002) |
| 33 | VL-CDR1 protein (CTLA-4-Ab_002) |
| 34 | VL-CDR2 protein (CTLA-4-Ab_002) |
| 35 | VL-CDR3 protein (CTLA-4-Ab_002) |
| 36 | HC DNA N294Q aglycosylated (CTLA-4-Ab_002) |
| 37 | HC protein N294Q aglycosylated (CTLA-4-Ab_002) |
| 38 | VH DNA (CTLA-4-Ab_003) |
| 39 | VH protein (CTLA-4-Ab_003) |
| 40 | VL DNA (CTLA-4-Ab_003) |
| 41 | VL protein (CTLA-4-Ab_003) |
| 42 | VH protein (CTLA-4-Ab_003A) |
| 43 | VL protein (CTLA-4-Ab_003A) |
| 44 | VH-CDR1 protein (CTLA-4-Ab_003) |
| 45 | VH-CDR2 protein (CTLA-4-Ab_003) |
| 46 | VH-CDR3 protein (CTLA-4-Ab_003) |
| 47 | VL-CDR1 protein (CTLA-4-Ab_003) |
| 48 | VL-CDR2 protein (CTLA-4-Ab_003) |
| 49 | VL-CDR3 protein (CTLA-4-Ab_003) |
| 50 | HC DNA (CTLA-4-Ab_004) |
| 51 | HC protein (CTLA-4-Ab_004) |
| 52 | LC DNA (CTLA-4-Ab_004) |
| 53 | LC protein (CTLA-4-Ab_004) |
| 54 | VH protein (CTLA-4-Ab_004) |
| 55 | VL protein (CTLA-4-Ab_004) |
| 56 | VH-CDR1 protein (CTLA-4-Ab_004) |
| 57 | VH-CDR2 protein (CTLA-4-Ab_004) |
| 58 | VH-CDR3 protein (CTLA-4-Ab_004) |
| 59 | VL-CDR1 protein (CTLA-4-Ab_004) |
| 60 | VL-CDR2 protein (CTLA-4-Ab_004) |
| 61 | VL-CDR3 protein (CTLA-4-Ab_004) |
| 62 | VH DNA (CTLA-4-Ab_005) |
| 63 | VH protein (CTLA-4-Ab_005) |
| 64 | VL DNA (CTLA-4-Ab_005) |
| 65 | VL protein (CTLA-4-Ab_005) |
| 66 | VH protein (CTLA-4-Ab_005A) |
| 67 | VL protein (CTLA-4-Ab_005A) |
| 68 | VH-CDR1 protein (CTLA-4-Ab_005) |
| 69 | VH-CDR2 protein (CTLA-4-Ab_005) |
| 70 | VH-CDR3 protein (CTLA-4-Ab_005) |
| 71 | VL-CDR1 protein (CTLA-4-Ab_005) |
| 72 | VL-CDR2 protein (CTLA-4-Ab_005) |
| 73 | VL-CDR3 protein (CTLA-4-Ab_005) |
| 74 | HC DNA (CTLA-4-Ab_006) |
| 75 | HC protein (CTLA-4-Ab_006) |

TABLE 1-continued

Anti-CTLA-4 Antibody Polypeptide and Polynucleotide Sequences

| SEQ ID NO | Description |
|---|---|
| 76 | LC DNA (CTLA-4-Ab_006) |
| 77 | LC protein (CTLA-4-Ab_006) |
| 78 | VH protein (CTLA-4-Ab_006) |
| 79 | VL protein (CTLA-4-Ab_006) |
| 80 | VH-CDR1 protein (CTLA-4-Ab_006) |
| 81 | VH-CDR2 protein (CTLA-4-Ab_006) |
| 82 | VH-CDR3 protein (CTLA-4-Ab_006) |
| 83 | VL-CDR1 protein (CTLA-4-Ab_006) |
| 84 | VL-CDR2 protein (CTLA-4-Ab_006) |
| 85 | VL-CDR3 protein (CTLA-4-Ab_006) |
| 86 | VH DNA (CTLA-4-Ab_007) |
| 87 | VH protein (CTLA-4-Ab_007) |
| 88 | VL DNA (CTLA-4-Ab_007) |
| 89 | VL protein (CTLA-4-Ab_007) |
| 90 | VH protein (CTLA-4-Ab_007A) |
| 91 | VL protein (CTLA-4-Ab_007A) |
| 92 | VH-CDR1 protein (CTLA-4-Ab_007) |
| 93 | VH-CDR2 protein (CTLA-4-Ab_007) |
| 94 | VH-CDR3 protein (CTLA-4-Ab_007) |
| 95 | VL-CDR1 protein (CTLA-4-Ab_007) |
| 96 | VL-CDR2 protein (CTLA-4-Ab_007) |
| 97 | VL-CDR3 protein (CTLA-4-Ab_007) |
| 98 | VH DNA (CTLA-4-Ab_008) |
| 99 | VH protein (CTLA-4-Ab_008) |
| 100 | VL DNA (CTLA-4-Ab_008) |
| 101 | VL protein (CTLA-4-Ab_008) |
| 102 | VH protein (CTLA-4-Ab_008A) |
| 103 | VL protein (CTLA-4-Ab_008A) |
| 104 | VH-CDR1 protein (CTLA-4-Ab_008) |
| 105 | VH-CDR2 protein (CTLA-4-Ab_008) |
| 106 | VH-CDR3 protein (CTLA-4-Ab_008) |
| 107 | VL-CDR1 protein (CTLA-4-Ab_008) |
| 108 | VL-CDR2 protein (CTLA-4-Ab_008) |
| 109 | VL-CDR3 protein (CTLA-4-Ab_008) |
| 110 | VH DNA (CTLA-4-Ab_009) |
| 111 | VH protein (CTLA-4-Ab_009) |
| 112 | VL DNA (CTLA-4-Ab_009) |
| 113 | VL protein (CTLA-4-Ab_009) |
| 114 | VH protein (CTLA-4-Ab_009) |
| 115 | VL protein (CTLA-4-Ab_009) |
| 116 | VH-CDR1 protein (CTLA-4-Ab_009) |
| 117 | VH-CDR2 protein (CTLA-4-Ab_009) |
| 118 | VH-CDR3 protein (CTLA-4-Ab_009) |
| 119 | VL-CDR1 protein (CTLA-4-Ab_009) |
| 120 | VL-CDR2 protein (CTLA-4-Ab_009) |
| 121 | VL-CDR3 protein (CTLA-4-Ab_009) |
| 122 | VH DNA (CTLA-4-Ab_010) |
| 123 | VH protein (CTLA-4-Ab_010) |
| 124 | VL DNA (CTLA-4-Ab_010) |
| 125 | VL protein (CTLA-4-Ab_010) |
| 126 | VH protein (CTLA-4-Ab_010) |
| 127 | VL protein (CTLA-4-Ab_010) |
| 128 | VH-CDR1 protein (CTLA-4-Ab_010) |
| 129 | VH-CDR2 protein (CTLA-4-Ab_010) |
| 130 | VH-CDR3 protein (CTLA-4-Ab_010) |
| 131 | VL-CDR1 protein (CTLA-4-Ab_010) |
| 132 | VL-CDR2 protein (CTLA-4-Ab_010) |
| 133 | VL-CDR3 protein (CTLA-4-Ab_010) |
| 134 | VH DNA (CTLA-4-Ab_011) |
| 135 | VH protein (CTLA-4-Ab_011) |
| 136 | VL DNA (CTLA-4-Ab_011) |
| 137 | VL protein (CTLA-4-Ab_011) |
| 138 | VH protein (CTLA-4-Ab_011) |
| 139 | VL protein (CTLA-4-Ab_011) |
| 140 | VH-CDR1 protein (CTLA-4-Ab_011) |
| 141 | VH-CDR2 protein (CTLA-4-Ab_011) |
| 142 | VH-CDR3 protein (CTLA-4-Ab_011) |
| 143 | VL-CDR1 protein (CTLA-4-Ab_011) |
| 144 | VL-CDR2 protein (CTLA-4-Ab_011) |
| 145 | VL-CDR3 protein (CTLA-4-Ab_011) |
| 146 | VH DNA (CTLA-4-Ab_012) |
| 147 | VH protein (CTLA-4-Ab_012) |
| 148 | VL DNA (CTLA-4-Ab_012) |
| 149 | VL protein (CTLA-4-Ab_012) |
| 150 | VH protein (CTLA-4-Ab_012) |

TABLE 1-continued

| Anti-CTLA-4 Antibody Polypeptide and Polynucleotide Sequences | |
|---|---|
| SEQ ID NO | Description |
| 151 | VL protein (CTLA-4-Ab_0124) |
| 152 | VH-CDR1 protein (CTLA-4-Ab_012) |
| 153 | VH-CDR2 protein (CTLA-4-Ab_012) |
| 154 | VH-CDR3 protein (CTLA-4-Ab_012) |
| 155 | VL-CDR1 protein (CTLA-4-Ab_012) |
| 156 | VL-CDR2 protein (CTLA-4-Ab_012) |
| 157 | VL-CDR3 protein (CTLA-4-Ab_012) |
| 158 | VH DNA (CTLA-4-Ab_013) |
| 159 | VH protein (CTLA-4-Ab_013) |
| 160 | VL DNA (CTLA-4-Ab_013) |
| 161 | VL protein (CTLA-4-Ab_013) |
| 162 | VH protein (CTLA-4-Ab_013) |
| 163 | VL protein (CTLA-4-Ab_013) |
| 164 | VH-CDR1 protein (CTLA-4-Ab_013) |
| 165 | VH-CDR2 protein (CTLA-4-Ab_013) |
| 166 | VH-CDR3 protein (CTLA-4-Ab_013) |
| 167 | VL-CDR1 protein (CTLA-4-Ab_013) |
| 168 | VL-CDR2 protein (CTLA-4-Ab_013) |
| 169 | VL-CDR3 protein (CTLA-4-Ab_013) |
| 170 | 9D9 VH mIgG2Aa; Construct Sequence, RNA (5' UTR, ORF, 3' UTR) |
| 171 | 9D9 VH mIgG2Aa; ORF Sequence, protein |
| 172 | 9D9 VH mIgG2Aa; ORF Sequence, RNA |
| 173 | 9D9 VH mIgG2Aa; mRNA Sequence (assumes T100 tail) |
| 174 | 9D9 VH mIgG2B; Construct Sequence, RNA (5' UTR, ORF, 3' UTR) |
| 175 | 9D9 VH mIgG2B; ORF Sequence, protein |
| 176 | 9D9 VH mIgG2B; ORF Sequence, RNA |
| 177 | 9D9 VH mIgG2B; mRNA Sequence (assumes T100 tail) |
| 178 | 9D9 VL mIgK; Construct Sequence, RNA (5' UTR, ORF, 3' UTR) |
| 179 | 9D9 VL mIgKappa; ORF Sequence, protein |
| 180 | 9D9 VL mIgKappa; ORF Sequence, RNA |
| 181 | 9D9 VL mIgKappa; mRNA Sequence (assumes T100 tail) |
| 182 | VH DNA (CTLA-4-Ab_014) |
| 183 | VH protein (CTLA-4-Ab_014) |
| 184 | VL DNA (CTLA-4-Ab_014) |
| 185 | VL protein (CTLA-4-Ab_014) |
| 186 | VH-CDR1 protein (CTLA-4-Ab_014) |
| 187 | VH-CDR2 protein (CTLA-4-Ab_014) |
| 188 | VH-CDR3 protein (CTLA-4-Ab_014) |
| 189 | VL-CDR1 protein (CTLA-4-Ab_014) |
| 190 | VL-CDR2 protein (CTLA-4-Ab_014) |
| 191 | VL-CDR3 protein (CTLA-4-Ab_014) |
| 237 | VL DNA (CTLA-4-Ab_015) |
| 238 | VL protein (CTLA-4-Ab_015) |
| 239 | VH DNA (CTLA-4-Ab_015) |
| 240 | VH protein (CTLA-4-Ab_015) |
| 241 | VL DNA (CTLA-4-Ab_015A) |
| 242 | VL protein (CTLA-4-Ab_015A) |
| 243 | VH DNA (CTLA-4-Ab_015A) |
| 244 | VH protein (CTLA-4-Ab_015A) |
| 245 | VL-CDR1 (CTLA-4-Ab_015) |
| 246 | VL-CDR2 (CTLA-4-Ab_015) |
| 247 | VL-CDR3 (CTLA-4-Ab_015) |
| 248 | VH-CDR1 (CTLA-4-Ab_015) |
| 249 | VH-CDR2 (CTLA-4-Ab_015) |
| 250 | VH-CDR3 (CTLA-4-Ab_015) |

In addition to the anti-CTLA-4 polynucleotide sequences provided in TABLE 1, the methods disclosed herein can be practiced using any of the sequences of anti-CTLA-4 antibodies and antigen binding portions thereof disclosed in U.S. Pat. Nos. 8,017,114 and 6,984,720, International Publication Nos. WO2000037504 and WO2007113648, U.S. Patent Appl. Publ. No. US20140105914 (humanized anti CTLA-4), U.S. Pat. No. 8,697,845 (targeting soluble CTLA-4), U.S. Pat. Nos. 7,034,121, 8,883,984 and 7,824,679, 6,682,736, or International Publication No. WO 2014209804 (bispecific anti CTLA-4/PD-1), all of which are herein incorporated by reference in their entireties.

In some embodiments, a anti-CTLA-4 polynucleotide disclosed herein comprises one or more mRNAs (e.g., two, three, four, or more mRNAs) encoding an antibody or an antigen binding portion thereof which specifically binds to CTLA-4, e.g., a mammalian CTLA-4 polypeptide. In some embodiments, the mammalian CTLA-4 polypeptide is a human CTLA-4 polypeptide. In some embodiments, the CTLA-4 polypeptide comprises the amino acid sequence set forth in SEQ ID NO: 1. In another embodiment, the CTLA-4 polypeptide comprises an amino acid sequence set forth in SEQ ID NOS: 2-7.

In some embodiments, an mRNA encoding an antibody or an antigen binding portion thereof which specifically binds to CTLA-4 of the present disclosure comprises an amino acid sequence at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to an amino acid sequence listed in TABLE 1 or an amino acid sequence encoded by a nucleotide sequence listed in TABLE 1, wherein the protein encoded by said amino acid sequence is capable of specifically binding to CTLA-4.

In other embodiments, an antibody or an antigen binding portion thereof which specifically binds to CTLA-4 useful for the disclosure comprises an amino acid sequence listed in TABLE 1 with one or more conservative substitutions, wherein the conservative substitutions do not affect the binding of the antibody or an antigen binding portion thereof to CTLA-4, i.e., the antibody or an antigen binding portion thereof binds to CTLA-4 after the substitutions. In some embodiments, the amino acid sequences comprises at least one nonconservative substitution.

In other embodiments, a nucleotide sequence (i.e., an mRNA) encoding an antibody or an antigen binding portion thereof which specifically binds to CTLA-4 useful for the disclosure comprises a sequence at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to a nucleic acid sequence listed in TABLE 1 or a subsequence thereof.

In some embodiments, the mRNA comprises a codon optimized sequence encoding an antibody or an antigen binding portion thereof which specifically binds to CTLA-4 useful for the disclosure, e.g., a codon optimized nucleic acid sequence corresponding to a nucleic acid sequence or subsequence thereof from TABLE 1, or corresponding to a nucleic acid sequence encoding a anti-CTLA-4 polypeptide sequence from TABLE 1 or a combination thereof (e.g., a codon optimized sequence comprising several anti-CTLA-4 polynucleotide subsequences encoding a combination of CDRs disclosed in TABLE 1).

The present disclosure also provides an anti-CTLA-4 polynucleotide comprising one or more mRNAs (e.g., two, three or more mRNAs) which encode an antibody or an antigen binding portion thereof which specifically binds to CTLA-4 and which specifically binds to the same CTLA-4 epitope as: (i) an antibody or antigen-binding portion thereof comprising a heavy chain variable region (VH) of SEQ ID NO: 9, 28, or 39, and a light chain variable region (VL) of SEQ ID NO: 11, 29 or 41, or (ii) an antibody or antigen-binding portion comprising a VH of SEQ ID NO: 183 and a VL of SEQ ID NO: 185.

The present disclosure also provides anti-CTLA-4 polynucleotides comprising one or more mRNAs (e.g., two, three or more mRNAs) which encode an antibody or an antigen binding portion thereof which specifically binds to CTLA-4 and competitively inhibits CTLA-4 binding by: (i) an antibody or antigen-binding portion thereof comprising a VH of SEQ ID NO: 9, 28, or 39 and a VL of SEQ ID NO: 11, 29 or 41; or, (ii) an antibody or antigen-binding portion thereof comprising a VH of SEQ ID NO: 183 and a VL of SEQ ID NO: 185.

Also provided is an anti-CTLA-4 polynucleotide comprising one or more mRNAs (e.g., two, three or more mRNAs) which encode: (i) an antibody or an antigen binding portion thereof which specifically binds to CTLA-4 comprising a VH of SEQ ID NO: 9, 28, or 39 and a VL of SEQ ID NO: 11, 29 or 41; or, (ii) an antibody or antigen-binding portion thereof comprising a VH of SEQ ID NO: 183 and a VL of SEQ ID NO: 185.

The present disclosure also provides an anti-CTLA-4 polynucleotide comprising one or more mRNAs (e.g., two, three or more mRNAs) which encode an antibody or an antigen binding portion thereof which specifically binds to CTLA-4, wherein the antibody or an antigen binding portion thereof comprises: (i) a VL complementarity determining region 1 (VL-CDR1) amino acid sequence identical to, or identical except for four, three, two or one amino acid substitutions to SEQ ID NO: 17, 33, or 47 or SEQ ID NO: 189; (ii) a VL complementarity determining region 1 (VL-CDR2) amino acid sequence identical to, or identical except for four, three, two or one amino acid substitutions to SEQ ID NO: 18, 34 or 48 or SEQ ID NO: 190; (iii) a VL complementarity determining region 1 (VL-CDR3) amino acid sequence identical to, or identical except for four, three, two or one amino acid substitutions to SEQ ID NO: 19, 35 or 49 or SEQ ID NO: 191; (iv) a VH complementarity determining region 1 (VH-CDR1) amino acid sequence identical to, or identical except for four, three, two or one amino acid substitutions to SEQ ID NO: 14, 30 or 44 or SEQ ID NO: 186; (v) a VH complementarity determining region 1 (VH-CDR2) amino acid sequence identical to, or identical except for four, three, two or one amino acid substitutions to SEQ ID NO: 15, 31, or 45 or SEQ ID NO: 187; (vi) a VH complementarity determining region 1 (VH-CDR3) amino acid sequence identical to, or identical except for four, three, two or one amino acid substitutions to SEQ ID NO:16, 32, or 46 or SEQ ID NO:188; (vii) a combination thereof. In some aspects, the substitutions are conservative substitutions. In other aspects, the substitutions are non-conservative substitutions.

The present disclosure also provides an anti-CTLA-4 polynucleotide comprising one or more mRNAs (e.g., two, three or more mRNAs) which encode an antibody or an antigen binding portion thereof which specifically binds to CTLA-4, and which comprises (i) a VL, wherein the VL comprises VL-CDR1, VL-CDR2, and VL-CDR3 amino acid sequences identical to, or identical except for four, three, two, or one amino acid substitutions in one or more of the VL-CDRS to: SEQ ID NOs: 17, 18, and 19; SEQ ID NOs: 33, 34, and 35; SEQ ID NOs: 47, 48, and 49; or, SEQ ID NOs: 189, 190, and 191, respectively; (ii) a VH, wherein the VH comprises VH-CDR1, VH-CDR2, and VH-CDR3 amino acid sequences identical to, or identical except for four, three, two, or one amino acid substitutions in one or more of the VH-CDRS to: SEQ ID NOs:14, 15, and 16; SEQ ID NOs: 30, 31, and 32; SEQ ID NOs: 44, 45, and 46; or, SEQ ID NOs: 186, 187, and 188, respectively; or, (iii) a combination thereof. In some aspects, the substitutions are conservative substitutions. In other aspects, the substitutions are non-conservative substitutions.

The present disclosure also provides an anti-CTLA-4 polynucleotide comprising one or more mRNAs (e.g., two, three, four, or more mRNAs) which encode an antibody or an antigen binding portion thereof which specifically binds to CTLA-4, and which comprises a VL and a VH comprising VL-CDR1, VL-CRD2, VL-CDR3, VH-CDR1, VH-CDR2, and VH-CDR3 amino acid sequences identical or identical except for four, three, two, or one amino acid substitutions in one or more CDRs to: SEQ ID NOs: 17, 18, 19, 14, 15, and 16; or SEQ ID NOs: 33, 34, 35, 30, 31, and 32; or SEQ ID NOs: 47, 48, 39, 44, 45, and 46; or, SEQ ID NOs: 189, 190, 191, 186, 187, and 188, respectively. In some aspects, the substitutions are conservative substitutions. In other embodiments, the substitutions are non-conservative substitutions.

Also provided is an anti-CTLA-4 polynucleotide comprising one or more mRNAs (e.g., two, three, four, or more mRNAs) which encode an antibody or an antigen binding portion thereof which specifically binds to CTLA-4, and which comprises a VL and a VH, wherein the VL comprises an amino acid sequence having at least 80%, at least 85%, at least 90%, at least 95%, at least 96%, at least 97%, at least 98%, at least 99%, or 100% sequence identity to SEQ ID NO: 11, SEQ ID NO: 29, SEQ ID NO:41, or SEQ ID NO: 185.

The present disclosure also provides an anti-CTLA-4 polynucleotide comprising one or more mRNAs (e.g., two, three, four, or more mRNAs) which encode an antibody or an antigen binding portion thereof which specifically binds to CTLA-4, and which comprises a VL and a VH, wherein the VH comprises an amino acid sequence having at least 80%, at least 85%, at least 90%, at least 95%, at least 96%, at least 97%, at least 98%, at least 99%, or 100% sequence identity to SEQ ID NO: 14, SEQ ID NO: 30, SEQ ID NO:44, or SEQ ID NO: 186, wherein at least one nucleoside in the polynucleotide is a chemically modified nucleoside.

Also provided is an anti-CTLA-4 polynucleotide comprising one or more mRNAs (e.g., two, three, four, or more mRNAs) which encode an antibody or an antigen binding portion thereof which specifically binds to CTLA-4, and which comprises a VL and a VH, wherein (i) the VL comprises an amino acid sequence having at least 80%, at least 85%, at least 90%, at least 95%, at least 96%, at least 97%, at least 98%, at least 99%, or 100% sequence identity to SEQ ID NO: 11, SEQ ID NO: 29, or SEQ ID NO:41, and the VH comprises an amino acid sequence having at least 80%, at least 85%, at least 90%, at least 95%, at least 96%, at least 97%, at least 98%, at least 99%, or 100% sequence identity to SEQ ID NO: 9, SEQ ID NO: 28, or SEQ ID NO:39; or, (ii) the VL comprises an amino acid sequence having at least 80%, at least 85%, at least 90%, at least 95%, at least 96%, at least 97%, at least 98%, at least 99% sequence identity to SEQ ID NO: 185, and the VH comprises an amino acid sequence having at least 80%, at least 85%, at least 90%, at least 95%, at least 96%, at least 97%, at least 98%, at least 99% sequence identity to SEQ ID NO: 183.

The present disclosure also provides an anti-CTLA-4 polynucleotide comprising one or more mRNAs (e.g., two, three, four or more mRNAs) which encode an antibody or an antigen binding portion thereof which specifically binds to CTLA-4, and which comprises a VL and a VH, wherein (i) the VL consists or consists essentially of the amino acid sequence of SEQ ID NO: 11, SEQ ID NO: 29, or SEQ ID NO:41, and the VH consists or consists essentially of the amino acid sequence of SEQ ID NO: 9, SEQ ID NO: 28, or SEQ ID NO:39; or, (ii) the VL consists or consists essentially of the amino acid sequence of SEQ ID NO: 185, wherein the VH consists or consists essentially of the amino acid sequence of SEQ ID NO: 183.

In some embodiments, at least one mRNA encoding an antibody or an antigen binding portion thereof which specifically binds to CTLA-4 further encodes a heavy chain constant region or fragment thereof. In some embodiments, the heavy chain constant region or fragment thereof is an IgG constant region. In some embodiments, the heavy chain IgG constant region is selected from an IgG1 constant region, an IgG2 constant region, an IgG3 constant region and an IgG4 constant region. In some embodiments, the IgG constant region comprises a CH1 domain, a CH2 domain, a CH3 domain, or a combination thereof.

In some embodiments, at least one mRNA encoding an antibody or an antigen binding portion thereof which specifically binds to CTLA-4 further encodes a light chain constant region or fragment thereof. In some embodiments, the light chain constant region is selected from the group consisting of a kappa constant region and a lambda constant region.

The present disclosure also provides an anti-CTLA-4 polynucleotide comprising one or more mRNAs (e.g., two, three, four or more) which encode an antibody or an antigen binding portion thereof which specifically binds to CTLA-4, and which comprises a heavy chain (HC) a light chain (LC), wherein the HC comprises, consists, or consists essentially of the amino acid sequence of SEQ ID NO: 20 or SEQ ID NO:24, and the LC comprises, consists, or consists essentially of the amino acid sequence of SEQ ID NO: 22 or SEQ ID NO: 26.

In some embodiments, the antibody or antigen binding portion thereof which specifically binds to CTLA-4 is a complete antibody, an antibody variant, an antibody fragment, or a combination thereof. In other embodiments, the antibody or antigen binding portion thereof which specifically binds to CTLA-4 comprises, consists, or consists essentially of the antibody fragment, and wherein the antibody fragment is an scFv, Fv, Fab, F(ab')2, Fab', dsFv, or sc(Fv)2. In some embodiments, the antibody or antigen binding portion thereof which specifically binds to CTLA-4 is an intrabody, a bicistronic antibody, a pseudobicistronic antibody, a single domain antibody, or a bispecific antibody. In some aspects, the CTLA-4 is human CTLA-4.

In some embodiments, binding of the antibody or antigen binding portion thereof to CTLA-4: (i) reduces the size of the tumor; (ii) inhibits the growth of the tumor; (iii) reduces tumor cell proliferation in the subject; (iv) increases survival rate; or, (v) a combination thereof. In some embodiments, the tumor is selected from the group consisting of melanoma tumor, lung cancer tumor, bladder cancer tumor, colon cancer tumor, and prostate cancer tumor. In some embodiments, the tumor is a melanoma tumor and wherein the melanoma tumor is a metastatic melanoma tumor. In some embodiments, the tumor is lung cancer tumor and wherein the lung cancer tumor is a non-small cell lung carcinoma (NSCLC) tumor or a small cell lung cancer (SCLC) tumor. In some embodiments, the tumor is a prostate cancer tumor and wherein the prostate cancer tumor is a metastatic hormone-refractory prostate cancer tumor. In some embodiments, the subject is human.

In some embodiments, the antibody or antigen binding portion thereof which specifically binds to CTLA-4 is encoded by a polynucleotide sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 20, SEQ ID NO:24, SEQ ID NO:22, or SEQ ID NO:26, a subsequence thereof, or a combination thereof. In some embodiments, the polynucleotide sequence at least 60%, at least 65%, at least 70%, at least 75%, at least 80%, at least 85%, at least 90%, at least 95%, at least 96%, at least 97%, at least 98%, at least 99%, or 100% identical to at least one of SEQ ID NO: 20, SEQ ID NO:22, SEQ ID NO:24, or SEQ ID NO:26, or to a subsequence thereof that encodes (i) one, two or three VH-CDRs; (ii) one, two or three VL-CDRs; (iii) a VH; (iv) a VL; (v) a HC; (vi) a LC; (vii) a fragment thereof; or, (ix) a combination thereof, wherein the antibody or antigen binding portion thereof which specifically binds to CTLA-4 encoded by said polynucleotide sequence binds to at least one CTLA-4 molecule.

In one embodiment, the anti-CTLA-4 polynucleotide (e.g., RNA, e.g., mRNA) encodes an ORF encoding a VH and/or an ORF encoding a VL, wherein the ORF encoding the VH has:

(i) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to Treme-HC-Var-IgG1-CO14 or Treme-HC-Var-IgG1-CO22;

(ii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to Treme-HC-Var-IgG1-CO15, Treme-HC-Var-IgG1-CO20, Treme-HC-Var-IgG1-CO23, or Treme-HC-Var-IgG1-CO25;

(iii) at least 87%, at least 88%, at least 89%, at least 90%, at least 91%, at least 92%, at least 93%, at least 94%, at least 95%, at least 96%, at least 97%, at least 98%, at least 99%, or 100% sequence identity to Treme-HC-Var-IgG1-CO16, Treme-HC-Var-IgG1-CO17, or Treme-HC-Var-IgG1-CO19;

(iv) at least 88%, at least 89%, at least 90%, at least 91%, at least 92%, at least 93%, at least 94%, at least 95%, at least 96%, at least 97%, at least 98%, at least 99%, or 100% sequence identity to Treme-HC-Var-IgG1-CO1, Treme-HC-Var-IgG1-CO3, Treme-HC-Var-IgG1-CO4, Treme-HC-Var-IgG1-CO6, or Treme-HC-Var-IgG1-CO21;

(v) at least 89%, at least 90%, at least 91%, at least 92%, at least 93%, at least 94%, at least 95%, at least 96%, at least 97%, at least 98%, at least 99%, or 100% sequence identity to Treme-HC-Var-IgG1-CO2, Treme-HC-Var-IgG1-CO7, Treme-HC-Var-IgG1-CO9, Treme-HC-Var-IgG1-CO13, or Treme-HC-Var-IgG1-CO24; or (vi) at least 90%, at least 91%, at least 92%, at least 93%, at least 94%, at least 95%, at least 96%, at least 97%, at least 98%, at least 99%, or 100% identical to Treme-HC-Var-IgG1-CO5, Treme-HC-Var-IgG1-CO8, Treme-HC-Var-IgG1-CO10, Treme-HC-Var-IgG1-CO11, Treme-HC-Var-IgG1-CO12, or Treme-HC-Var-IgG1-CO18;

(vii) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-HC-Var-IgG2-CO11;

(vii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-HC-Var-IgG2-CO21 or Treme-HC-Var-IgG2-CO23;

(viii) at least 87%, at least 88%, at least 89%, at least 90%, at least 91%, at least 92%, at least 93%, at least 94%, at least 95%, at least 96%, at least 97%, at least 98%, at least 99%, or 100% identical to Treme-HC-Var-IgG2-CO3, Treme-HC-Var-IgG2-CO4, Treme-HC-Var-IgG2-CO7, Treme-HC-Var-IgG2-CO15, or Treme-HC-Var-IgG2-CO16;

(ix) at least 88%, at least 89%, at least 90%, at least 91%, at least 92%, at least 93%, at least 94%, at least 95%, at least 96%, at least 97%, at least 98%, at least 99%, or 100% identical to Treme-HC-Var-IgG2-CO5, Treme-HC-Var-IgG2-CO9, or Treme-HC-Var-IgG2-CO14;

(x) at least 89%, at least 90%, at least 91%, at least 92%, at least 93%, at least 94%, at least 95%, at least 96%, at least 97%, at least 98%, at least 99%, or 100% identical to Treme-HC-Var-IgG2-CO1, Treme-HC-Var-IgG2-CO6, Treme-HC-Var-IgG2-CO10, Treme-HC-Var-IgG2-CO13, Treme-HC-Var-IgG2-CO17, or Treme-HC-Var-IgG2-CO18;

(xi) at least 90%, at least 91%, at least 92%, at least 93%, at least 94%, at least 95%, at least 96%, at least 97%, at least 98%, at least 99%, or 100% identical to Treme-HC-Var-IgG2-CO2, Treme-HC-Var-IgG2-CO8, Treme-HC-Var-IgG2-CO12, or Treme-HC-Var-IgG2-CO19;

(xii) at least 91%, at least 92%, at least 93%, at least 94%, at least 95%, at least 96%, at least 97%, at least 98%, at least 99%, or 100% identical to Treme-HC-Var-IgG2-CO20, Treme-HC-Var-IgG2-CO22, or Treme-HC-Var-IgG2-CO24; or (xiii) at least 92%, at least 93%, at least 94%, at least 95%, at least 96%, at least 97%, at least 98%, at least 99%, or 100% identical to Treme-HC-Var-IgG2-CO25; and/or wherein the ORF encoding the VL is:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-LC-Var-CO16;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-LC-Var-CO3, Treme-LC-Var-CO7, Treme-LC-Var-CO10, Treme-LC-Var-CO12, Treme-LC-Var-CO13, Treme-LC-Var-CO19, Treme-LC-Var-CO24, or Treme-LC-Var-CO25;

(iii) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-LC-Var-CO5, Treme-LC-Var-CO20, or Treme-LC-Var-CO22;

(iv) at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to Treme-LC-Var-CO1, Treme-LC-Var-CO2, Treme-LC-Var-CO4, Treme-LC-Var-CO5, Treme-LC-Var-CO9, Treme-LC-Var-CO11, Treme-LC-Var-CO14, Treme-LC-Var-CO15, Treme-LC-Var-CO17, Treme-LC-Var-CO21, or Treme-LC-Var-CO23; or (v) at least 87%, at least 88%, at least 89%, at least 90%, at least 91%, at least 92%, at least 93%, at least 94%, at least 95%, at least 96%, at least 97%, at least 98%, at least 99%, or 100% identical to Treme-LC-Var-CO8 or Treme-LC-Var-CO18, and wherein the VH and VL form an antibody or antigen-binding portion thereof which specifically binds to an antigen, e.g., CTLA-4.

In another embodiment, the anti-CTLA-4 polynucleotide (e.g., RNA, e.g., mRNA) comprises an ORF encoding a VH and an ORF encoding a VL, wherein the ORF encoding the VH has:

(i) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-HC-Var-CO5, IPI-HC-Var-CO11, or IPI-HC-Var-CO23;

(ii) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-HC-Var-CO1, IPI-HC-Var-CO4, IPI-HC-Var-CO7, IPI-HC-Var-CO10, IPI-HC-Var-CO14, or IPI-HC-Var-CO20;

(iii) at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-HC-Var-CO3, IPI-HC-Var-CO78, IPI-HC-Var-CO12, or IPI-LC-Var-CO17;

(iv) at least 88%, at least 89%, at least 90%, at least 91%, at least 92%, at least 93%, at least 94%, at least 95%, at least 96%, at least 97%, at least 98%, at least 99%, or 100% sequence identity to IPI-HC-Var-CO18, IPI-HC-Var-CO19, IPI-HC-Var-CO22, or IPI-HC-Var-CO24;

(v) at least 89%, at least 90%, at least 91%, at least 92%, at least 93%, at least 94%, at least 95%, at least 96%, at least 97%, at least 98%, at least 99%, or 100% sequence identity to IPI-HC-Var-CO9, IPI-HC-Var-CO16, or IPI-HC-Var-CO25;

(vi) at least 90%, at least 91%, at least 92%, at least 93%, at least 94%, at least 95%, at least 96%, at least 97%, at least 98%, at least 99%, or 100% identical to IPI-HC-Var-$CO_2$, IPI-HC-Var-CO13, or IPI-HC-Var-CO21; (vii) at least 91%, at least 92%, at least 93%, at least 94%, at least 95%, at least 96%, at least 97%, at least 98%, at least 99%, or 100% sequence identity to IPI-HC-Var-CO6; or (viii) at least 92%, at least 93%, at least 94%, at least 95%, at least 96%, at least 97%, at least 98%, at least 99%, or 100% sequence identity to IPI-HC-Var-CO15; and/or wherein the ORF encoding the VL has:

(i) at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO3;

(ii) at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO9 or IPI-LC-Var-CO22;

(iii) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO7 or IPI-LC-Var-CO18;

(iv) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO1, IPI-LC-Var-CO6, IPI-LC-Var-CO10, or IPI-LC-Var-CO25;

(v) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO2, IPI-LC-Var-CO4, IPI-LC-Var-CO13, IPI-LC-Var-CO14, IPI-LC-Var-CO15, IPI-LC-Var-CO16, IPI-LC-Var-CO23, or IPI-LC-Var-CO24;

(vi) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO5, IPI-LC-Var-$CO_8$, IPI-LC-Var-CO11, IPI-LC-Var-CO12, IPI-LC-Var-CO19, or IPI-LC-Var-CO21;

(vii) at least 87%, at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO20; or (viii) at least 88%, at least 89%, at least 90%, at least 91%, at least 92%, at least 93%, at least 94%, at least 95%, at least 96%, at least 97%, at least 98%, at least 99%, or 100% sequence identity to IPI-LC-Var-CO17.

In some embodiments, the anti-CTLA-4 polynucleotide is sequence optimized. In certain embodiments, the anti-CTLA-4 polynucleotides are optimized by a known technique in the art.

In other embodiments, the sequence-optimized anti-CTLA-4 polynucleotide sequences disclosed herein are distinct from the corresponding wild type nucleotide acid sequences and from other known sequence-optimized nucleotide sequences, e.g., these sequence-optimized nucleic acids have unique compositional characteristics. See FIG. 80A to 88B In some embodiments, the percentage of uracil or thymine nucleobases in a sequence-optimized nucleotide sequence (e.g., encoding an antibody or antigen-binding portion thereof that specifically binds to CTLA-4, e.g., tremelimumab or ipilimumab, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100. In some embodiments, the sequence-optimized nucleotide sequence has a lower uracil or thymine content than the uracil or thymine content in the reference wild-type sequence. In some embodiments, the uracil or thymine content in a sequence-optimized nucleotide sequence disclosed herein is greater than the uracil or thymine content in the reference wild-type sequence and still maintain beneficial effects, e.g., increased expression and/or reduced Toll-Like Receptor (TLR) response when compared to the reference wild-type sequence.

The uracil or thymine content of wild-type tremelimumab VH is about 17%. In some embodiments, the uracil or thymine content of a uracil- or thymine-modified sequence encoding a tremelimumab VH of the disclosure is less than 17%. In some embodiments, the uracil or thymine content of a uracil- or thymine-modified sequence encoding a tremelimumab VH of the disclosure is less than 16%, less than 15%, less than 14%, less than 12%, less than 11%, less than 10%, less than 9%, less that 8%, less than 7%, or less than 6%. In some embodiments, the uracil or thymine content is not less than 1%, 2%, or 3%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding a tremelimumab VH disclosed herein is between 14% and 18%, between 14% and 19%, between 14% and 20%, between 13% and 18%, between 13% and 19%, between 13% and 20%, between 12% and 18%, between 12% and 19%, between 12% and 20%, between 14% and 16%, or between 15% and 16%.

A uracil- or thymine-modified sequence encoding tremelimumab VH disclosed herein can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

In some embodiments, the % $U_{WT}$ or % $T_{WT}$ of a uracil- or thymine-modified sequence encoding tremelimumab VH of the disclosure is above 60%, above 65%, above 70%, above 75%, above 80%, above 85%, above 90%, or above 95%.

In some embodiments, the % $U_{WT}$ or % $T_{WT}$ of a uracil- or thymine modified sequence encoding tremelimumab VH of the disclosure is between 85% and 110%, between 80% and 110%, between 75% and 110%, between 85% and 105%, between 80% and 95%, between 70% and 85%, between 65% and 90%, between 65% and 95%, or between 70% and 90%.

In a particular embodiment, the % $U_{WT}$ or % $T_{WT}$ of a uracil- or thymine-modified sequence encoding tremelimumab VH of the disclosure is between about 80% and about 95%.

Uracil- or thymine-content relative to the uracil or thymine theoretical minimum, refers to a parameter determined by dividing the number of uracils or thymines in a sequence-optimized nucleotide sequence by the total number of uracils or thymines in a hypothetical nucleotide sequence in which all the codons in the hypothetical sequence are replaced with synonymous codons having the lowest possible uracil or thymine content and multiplying by 100. This parameter is abbreviated herein as % $U_{TM}$ or % $T_{TM}$ For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding tremelimumab VH disclosed herein is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding tremelimumab VH disclosed herein is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%.

In some embodiments, the % $U_{TM}$ of a uracil-modified sequence encoding tremelimumab VH is between 120% and 150%, between 121% and 155%, between 120% and 160%, between 119% and 165%, between 118% and 170%, between 117% and 155%, between 116% and 160%, or between 110% and 160%.

In some embodiments, the % $U_{TM}$ of a uracil-modified sequence encoding tremelimumab VH of the disclosure is between about 118% and about 151%.

In some embodiments, a uracil-modified sequence encoding tremelimumab VH disclosed herein has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide. For example, if the polypeptide, e.g., wild type tremelimumab VH, has, e.g., 3 phenylalanines, the absolute minimum number of uracil pairs (UU) that a uracil-modified sequence encoding the polypeptide, e.g, wild type tremelimumab VH, may contain is 3.

Wild type tremelimumab VH contains 4 uracil pairs (UU), and 1 uracil triplets (UUU). In some embodiments, a uracil-modified sequence encoding tremelimumab VH disclosed herein has a reduced number of uracil triplets (UUU) with respect to the wild-type nucleic acid sequence. In some embodiments, a uracil-modified sequence encoding a tremelimumab VH of the disclosure contains 3, 2, 1 or no uracil triplets (UUU).

In some embodiments, a uracil-modified sequence encoding tremelimumab VH has a reduced number of uracil pairs (UU) with respect to the number of uracil pairs (UU) in the wild-type nucleic acid sequence. In some embodiments, a uracil-modified sequence encoding tremelimumab VH disclosed herein has a number of uracil pairs (UU) corresponding to the minimum possible number of uracil pairs (UU) in the wild-type nucleic acid sequence, e.g., 4 uracil pairs in the case of wild type tremelimumab VH.

In some embodiments, a uracil-modified sequence encoding tremelimumab VH disclosed herein has at least 1, 2, 3, 4, 5, 6, 7, 8, 9, 10, 11, or 12 uracil pairs (UU) less than the number of uracil pairs (UU) in the wild-type nucleic acid sequence. In some embodiments, a uracil-modified sequence encoding tremelimumab VH of the disclosure has between 1 and 3 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, a uracil-modified sequence encoding tremelimumab VH disclosed herein has a % $UU_{wt}$ less than 275%, less than 250%, less than 200%, less than 150%, less than 140%, less than 130%, less than 120%, less than 110%, less than 100%, less than 95%, less than 90%, less than 85%, less than 80%, less than 75%, less than 70%, less than 65%, less than 60%, less than 65%, less than 60%, less than 55%, or less than 50%.

In some embodiments, a uracil-modified sequence encoding tremelimumab VH has a % $UU_{wt}$ between 50% and 275%.

In some embodiments, the anti-CTLA-4 polynucleotide comprises a uracil-modified sequence encoding tremelimumab VH disclosed herein. In some embodiments, the uracil-modified sequence encoding tremelimumab VH comprises at least one chemically modified nucleobase, e.g., 5-methoxyuracil. In some embodiments, at least 95% of a nucleobase (e.g., uracil) in a uracil-modified sequence encoding tremelimumab VH of the disclosure are modified nucleobases. In some embodiments, at least 95% of uracil in a uracil-modified sequence encoding tremelimumab VH is 5-methoxyuracil. In some embodiments, the anti-CTLA-4 polynucleotide comprising a uracil-modified sequence further comprises a miRNA binding site, e.g., a miRNA binding site that binds to miR-122. In some embodiments, the anti-CTLA-4 polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab VH with respect to the theoretical maximum guanine content of a nucleotide sequence encoding tremelimumab VH abbreviated as % $G_{TMX}$ is at least 60%, at least 61%, at least 62%, at least about 63%, at least about 64%, at least about 65%, at least about 66%, about 67%, about 68%, about 69%, about 70%, or about 71%. In some embodiments, the % $G_{TMX}$ is between about 60% and about 80%, between about 65% and about 75%, between about 61% and about 78%, or between about 61% and about 77%.

In some embodiments, the "cytosine content of the ORF relative to the theoretical maximum cytosine content of a nucleotide sequence encoding tremelimumab VH abbreviated as % $C_{TMX}$, is at least 50%, at least 51%, at least about 52%, at least about 53%, at least about 54%, at least about 55%, at least about 56%, at least about 57%, at least about 58%, about 59%, about 60%, about 61%, about 62%, about 63%, about 64%, about 65%, or about 66%. In some embodiments, the % $C_{TMX}$ is between about 60% and about 80%, between about 62% and about 80%, between about 63% and about 79%, or between about 68% and about 76%.

In some embodiments, the "guanine and cytosine content (G/C) of the ORF relative to the theoretical maximum G/C content in a nucleotide sequence encoding tremelimumab VH abbreviated as % $G/C_{TMX}$ is at least about 81%, at least about 85%, at least about 90%, at least about 95%, or about 100%. The % $G/C_{TMX}$ is between about 80% and about 100%, between about 85% and about 99%, between about 90% and about 97%, or between about 91% and about 96%.

In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, or at least 106%.

In some embodiments, the anti-CTLA-4 polynucleotide comprises an open reading frame (ORF) encoding tremelimumab VH, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of wild-type tremelimumab VL is about 24%. In some embodiments, the uracil or thymine content of a uracil- or thymine-modified sequence encoding tremelimumab VL is less than 24%. In some embodiments, the uracil or thymine content of a uracil- or thymine-modified sequence encoding tremelimumab VL of the disclosure is less than 23%, less than 22%, less than 21%, less than 20%, less than 19%, less than 18%, less than 17%, less that 16%, less than 15%, or less than 14%. In some embodiments, the uracil or thymine content is not less than 8%, 9%, or 10%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding tremelimumab VL of the disclosure is between 14% and 18%, between 14% and 19%, between 14% and 20%, between 13% and 18%, between 13% and 19%, between 13% and 20%, between 12% and 18%, between 12% and 19%, between 12% and 20%, between 14% and 16%, or between 15% and 16%.

A uracil- or thymine-modified sequence encoding tremelimumab VL of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

In some embodiments, the % $U_{WT}$ or % $T_{WT}$ of a uracil- or thymine-modified sequence encoding tremelimumab VL of the disclosure is above 50%, above 52%, above 54%, above 56%, above 58%, above 60%, above 62%, or above 64%.

In some embodiments, the % $U_{WT}$ or % $T_{WT}$ of a uracil- or thymine modified sequence encoding tremelimumab VL of the disclosure is between 50% and 80%, between 55% and 80%, between 60% and 80%, between 50% and 90%, between 50% and 70%, between 60% and 85%, between 60% and 90%, between 60% and 95%, or between 70% and 90%.

In a particular embodiment, the % $U_{WT}$ or % $T_{WT}$ of a uracil- or thymine-modified sequence encoding tremelimumab VL of the disclosure is between about 55% and about 75%.

In some embodiments, the % $U_{TM}$ of a uracil-modified sequence encoding tremelimumab VL of the disclosure is below 215%, below 210%, below 205%, below 200%, below 195%, below 190%, below 185%, below 180%, below 175%, below 170%, below 165%, below 160%, below 155%, below 150%, below 145%, below 140%, below 135%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding tremelimumab VL of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%.

In some embodiments, the % $U_{TM}$ of a uracil-modified sequence encoding tremelimumab VL of the disclosure is between 120% and 170%, between 121% and 165%, between 120% and 160%, between 119% and 165%, between 118% and 170%, between 117% and 155%, between 116% and 160%, or between 110% and 160%.

In some embodiments, the % $U_{TM}$ of a uracil-modified sequence encoding tremelimumab VL of the disclosure is between about 127% and about 163%.

In some embodiments, a uracil-modified sequence encoding tremelimumab VL of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide. Wild type tremelimumab VL has 5 phenylalanines, thus, the absolute minimum number of uracil pairs (UU) that a uracil-modified sequence encoding the polypeptide, e.g, wild type tremelimumab VL, may contain is 2, 3, 4, 5, 6, 7, 8, 9, 10, or 11 respectively.

Wild type tremelimumab VL contains 7 uracil pairs (UU), and 4 uracil triplets (UUU). In some embodiments, a uracil-modified sequence encoding tremelimumab VL of the disclosure has a reduced number of uracil triplets (UUU) with respect to the wild-type nucleic acid sequence. In some embodiments, a uracil-modified sequence encoding a tremelimumab VH of the disclosure contains 2, 1 or no uracil triplets (UUU).

In some embodiments, a uracil-modified sequence encoding tremelimumab VL has a reduced number of uracil pairs (UU) with respect to the number of uracil pairs (UU) in the wild-type nucleic acid sequence. In some embodiments, a uracil-modified sequence encoding tremelimumab VH of the disclosure has a number of uracil pairs (UU) corresponding to the minimum possible number of uracil pairs (UU) in the wild-type nucleic acid sequence, e.g., 4 uracil pairs in the case of wild type tremelimumab VL.

In some embodiments, a uracil-modified sequence encoding tremelimumab VL of the disclosure has at least 1, 2, 3, or 4 uracil pairs (UU) less than the number of uracil pairs (UU) in the wild-type nucleic acid sequence. In some embodiments, a uracil-modified sequence encoding tremelimumab VH of the disclosure has between 1 and 3 uracil pairs (UU).

In some embodiments, a uracil-modified sequence encoding tremelimumab VL of the disclosure has a % $UU_{wt}$ less than 150%, less than 145%, less than 140%, less than 135%, less than 130%, less than 125%, less than 120%, less than 110%, less than 100%, less than 95%, less than 90%, less than 85%, less than 80%, less than 75%, less than 70%, less than 65%, less than 60%, less than 65%, less than 60%, less than 55%, or less than 50%.

In some embodiments, a uracil-modified sequence encoding tremelimumab VL has a % $UU_{wt}$ between 12% and 145%.

In some embodiments, the polynucleotide of the disclosure comprises a uracil-modified sequence encoding tremelimumab VL disclosed herein. In some embodiments, the uracil-modified sequence encoding tremelimumab VL comprises at least one chemically modified nucleobase, e.g., 5-methoxyuracil. In some embodiments, at least 95% of a nucleobase (e.g., uracil) in a uracil-modified sequence encoding tremelimumab VL of the disclosure are modified nucleobases. In some embodiments, at least 95% of uracil in a uracil-modified sequence encoding tremelimumab VL is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab VL with respect to the theoretical maximum guanine content of a nucleotide sequence encoding tremelimumab VL abbreviated as % $G_{TMX}$ is at least 60%, at least 61%, at least 62%, at least about 63%, at least about 64%, at least about 65%, at least about 66%, about 67%, about 68%, about 69%, about 70%, or about 71%. In some embodiments, the % $G_{TMX}$ is between about 60% and about 80%, between about 65% and about 75%, between about 61% and about 78%, or between about 60% and about 70%.

In some embodiments, the "cytosine content of the ORF relative to the theoretical maximum cytosine content of a nucleotide sequence encoding tremelimumab VL abbreviated as % $C_{TMX}$, is about 60%, about 61%, about 62%, about 63%, about 64%, about 65%, about 66%, at least 70%, at least 72%, at least about 74%, at least about 76%, or at least about 78%. In some embodiments, the % $C_{TMX}$ is between about 60% and about 80%, between about 62% and about 80%, between about 63% and about 79%, or between about 68% and about 76%.

In some embodiments, the "guanine and cytosine content (G/C) of the ORF relative to the theoretical maximum G/C content in a nucleotide sequence encoding tremelimumab VH abbreviated as % $G/C_{TMX}$ is at least about 81%, at least about 82%, at least about 83%, at least about 84%, at least about 85%, at least about 90%, at least about 95%, at least about 99%, or 100%. The % $G/C_{TMX}$ is between about 80% and about 100%, between about 85% and about 99%, between about 90% and about 97%, or between about 91% and about 96%.

In some embodiments, the "G/C content in the ORF relative to the G/C content in the corresponding wild-type ORF," abbreviated as % $G/C_{WT}$ is at least 100%, at least 105%, at least 110%, at least 115%, at least 120%, at least 125%, at least 130%, at least 135%, at least 140%, at least 145%, at least 150%, or at least 155%.

In some embodiments, the anti-CTLA-4 polynucleotide of the disclosure comprises an open reading frame (ORF) encoding tremelimumab VL, wherein the ORF has been sequence optimized, and wherein each of % $U_{TL}$, % $U_{WT}$, % $U_{TM}$, % $C_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of wild-type tremelimumab VH is about 17%. In some embodiments, the uracil or thymine content of a uracil- or thymine-modified sequence encoding tremelimumab VH is less than 17%. In some embodiments, the uracil or thymine content of a uracil- or thymine-modified sequence encoding a tremelimumab VH of the disclosure is less than 19%, is less than 18%, is less than 17%, is less than 16%, less than 15%, less than 14%, less than 12%, less than 11%, less than 10%, less than 9%, less that 8%, less than 7%, or less than 6%. In some embodiments, the uracil or thymine content is not less than 1%, 2%, or 3%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding tremelimumab VH of the disclosure is between 12% and 21%, between 12% and 20%, between 12% and 19%, between 13% and 18%, between 13% and 17%, between 13% and 19%, between 14% and 21%, between 14% and 20%, and between 14% and 19%.

A uracil- or thymine-modified sequence encoding tremelimumab VH of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

In some embodiments, the % $U_{WT}$ or % $T_{WT}$ of a uracil- or thymine-modified sequence encoding tremelimumab VH of the disclosure is above 60%, above 65%, above 70%, above 75%, above 80%, above 85%, above 90%, above 95%, above 100%, or above 105%.

In some embodiments, the % $U_{WT}$ or % $T_{WT}$ of a uracil- or thymine modified sequence encoding tremelimumab VH of the disclosure is between 90% and 125%, between 85% and 125%, between 80% and 125%, between 90% and 120%, between 85% and 110%, between 75% and 100%, between 70% and 105%, between 70% and 110%, or between 75% and 105%.

In a particular embodiment, the % $U_{WT}$ or % $T_{WT}$ of a uracil- or thymine-modified sequence encoding tremelimumab VH of the disclosure is between about 86% and about 110%.

In some embodiments, the % $U_{TM}$ of a uracil-modified sequence encoding tremelimumab VH of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 153%, below 152%, below 151%, below 150%, below 149%, below 148%, below 147%, below 146%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below or 120%.

In some embodiments, the % $U_{TM}$ of a uracil-modified sequence encoding tremelimumab VH of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, above 132%, above 133%, above 134%, above 135%, above 136%, above 137%, above 138%, above 139%, above 140%, above 141%, above 142%, above 143%, above 144%, above 145%, above 146%, above 147%, above 148%, above 149%, or above 150%.

In some embodiments, the % $U_T$m of a uracil-modified sequence encoding a caTLR4 polypeptide of the disclosure is between 120% and 150%, between 121% and 155%, between 120% and 160%, between 119% and 165%, between 118% and 170%, between 117% and 155%, between 116% and 160%, or between 110% and 160%.

In some embodiments, the % $U_{TM}$ of a uracil-modified sequence encoding tremelimumab VH of the disclosure is between about 119% and about 152%.

In some embodiments, a uracil-modified sequence encoding tremelimumab VH of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Wild type tremelimumab VH contains 4 uracil pairs (UU), and 1 uracil triplets (UUU). In some embodiments, a uracil-modified sequence encoding tremelimumab VH of the disclosure has a reduced number of uracil triplets (UUU) with respect to the wild-type nucleic acid sequence. In some embodiments, a uracil-modified sequence encoding a tremelimumab VH of the disclosure contains 3, 2, 1 or no uracil triplets (UUU).

In some embodiments, a uracil-modified sequence encoding tremelimumab VH has a reduced number of uracil pairs (UU) with respect to the number of uracil pairs (UU) in the wild-type nucleic acid sequence. In some embodiments, a uracil-modified sequence encoding tremelimumab VH of the disclosure has a number of uracil pairs (UU) corresponding to the minimum possible number of uracil pairs (UU) in the wild-type nucleic acid sequence, e.g., 4 uracil pairs in the case of wild type tremelimumab VH.

In some embodiments, a uracil-modified sequence encoding tremelimumab VH of the disclosure has at least 1, 2, 3, 4, 5, 6, 7, 8, 9, 10, 11, or 12 uracil pairs (UU) less than the number of uracil pairs (UU) in the wild-type nucleic acid sequence. In some embodiments, a uracil-modified sequence encoding tremelimumab VH of the disclosure has between 1 and 3 uracil pairs (UU).

In some embodiments, a uracil-modified sequence encoding tremelimumab VH of the disclosure has a % $UU_{wt}$ less than 275%, less than 250%, less than 200%, less than 150%, less than 140%, less than 130%, less than 120%, less than 110%, less than 100%, less than 95%, less than 90%, less than 85%, less than 80%, less than 75%, less than 70%, less than 65%, less than 60%, less than 65%, less than 60%, less than 55%, or less than 50%.

In some embodiments, a uracil-modified sequence encoding tremelimumab VH has a % $UU_{wt}$ between 50% and 275%.

In some embodiments, the anti-CTLA-4 polynucleotide of the disclosure comprises a uracil-modified sequence encoding tremelimumab VH disclosed herein. In some embodiments, the uracil-modified sequence encoding tremelimumab VH comprises at least one chemically modified nucleobase, e.g., 5-methoxyuracil. In some embodiments, at least 95% of a nucleobase (e.g., uracil) in a uracil-modified sequence encoding tremelimumab VH of the disclosure are modified nucleobases. In some embodiments, at least 95% of uracil in a uracil-modified sequence encoding tremelimumab VH is 5-methoxyuracil. In some embodiments, the anti-CTLA-4 polynucleotide comprising a uracil-modified sequence further comprises a miRNA binding site, e.g., a miRNA binding site that binds to miR-122. In some embodiments, the anti-CTLA-4 polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab VH with respect to the theoretical maximum guanine content of a nucleotide sequence encoding tremelimumab VH abbreviated as % $G_{TMX}$ is above 60%, at least 61%, at least 62%, at least 63%, at least 64%, at least 65%, at least 66%, at least 67%, at least 68%, at least 69%, at least 70%, or at least 71%. In some embodiments, the % $G_{TMX}$ is between about 60% and about 85%, between about 65% and about 80%, between about 65% and about 78%, or between about 67% and about 76%.

In some embodiments, the "cytosine content of the ORF relative to the theoretical maximum cytosine content of a nucleotide sequence encoding tremelimumab VH abbreviated as % $C_{TMX}$, is at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, or at least 66%. In some embodiments, the % $C_{TMX}$ is between about 60% and about 85%, between about 62% and about 83%, between about 63% and about 81%, or between about 66% and about 80%.

In some embodiments, the "guanine and cytosine content (G/C) of the ORF relative to the theoretical maximum G/C content in a nucleotide sequence encoding tremelimumab VH abbreviated as % $G/C_{TMX}$ is at least about 80%, at least about 85%, at least about 89%, at least about 90%, at least about 95%, or about 100%. The % $G/C_{TMX}$ is between about 80% and about 100%, between about 85% and about 99%, between about 87% and about 97%, or between about 89% and about 96%.

In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, or at least 106%.

In some embodiments, the anti-CTLA-4 polynucleotide of the disclosure comprises an open reading frame (ORF) encoding tremelimumab VH, wherein the ORF has been sequence optimized, and wherein each of % $U_{TL}$, % $U_{WT}$, % $U_{TM}$, % $G_{TL}$, % $G_{WT}$, % $G_{TMX}$, % Cm, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of wild-type tremelimumab VL is about 25%. In some embodiments, the uracil or thymine content of a uracil- or thymine-modified sequence encoding tremelimumab VL is less than 25%. In some embodiments, the uracil or thymine content of a uracil- or thymine-modified sequence encoding a tremelimumab VL of the disclosure is less than 19%, less than 18%, less than 17%, less than 16%, less than 15%, less than 14%, less than 12%, less than 11%, less than 10%, less than 9%, less that 8%, less than 7%, or less than 6%. In some embodiments, the uracil or thymine content is not less than 1%, 2%, or 3%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding tremelimumab VL of the disclosure is between 12% and 21%, between 12% and 20%, between 12% and 19%, between 13% and 21%, between 13% and 20%, between 13% and 19%, between 14% and 21%, between 14% and 20%, and between 14% and 19%.

A uracil- or thymine-modified sequence encoding tremelimumab VL of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

In some embodiments, the % $U_{WT}$ or % $T_{WT}$ of a uracil- or thymine-modified sequence encoding tremelimumab VL of the disclosure is above 58%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding tremelimumab VL of the disclosure is between 65% and 90%, between 60% and 90%, between 55% and 90%, between 65% and 85%, between 60% and 75%, between 50% and 65%, between 45% and 70%, between 45% and 75%, or between 50% and 70%.

In a particular embodiment, the % $U_{WT}$ or % $T_{WT}$ of a uracil- or thymine-modified sequence encoding tremelimumab VL of the disclosure is between about 58% and about 76%.

In some embodiments, the % $U_{TM}$ of a uracil-modified sequence encoding tremelimumab VL of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding tremelimumab VL of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, above 132%, above 133%, above 134%, above 135%, above 136%, above 137%, above 138%, above 139%, above 140%, above 141%, above 142%, above 143%, above 144%, above 145%, above 146%, above 147%, above 148%, above 149%, above 150%, above 151%, above 152%, above 153%, above 154%, above 155%, above 156%, above 157%, above 158%, above 159%, or above 160%.

In some embodiments, the % $U_{TM}$ of a uracil-modified sequence encoding a caTLR4 polypeptide of the disclosure is between 125% and 165%, between 127% and 170%, between 125% and 175%, between 124% and 180%, between 123% and 185%, between 122% and 170%, between 121% and 175%, or between 115% and 175%.

In some embodiments, the % $U_{TM}$ of a uracil-modified sequence encoding tremelimumab VL of the disclosure is between about 127% and about 164%.

In some embodiments, a uracil-modified sequence encoding tremelimumab VL of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide.

Wild type tremelimumab VL contains 7 uracil pairs (UU), and 4 uracil triplets (UUU). In some embodiments, a uracil-modified sequence encoding tremelimumab VL of the disclosure has a reduced number of uracil triplets (UUU) with respect to the wild-type nucleic acid sequence. In some embodiments, a uracil-modified sequence encoding a tremelimumab VL of the disclosure contains 3, 2, 1 or no uracil triplets (UUU).

In some embodiments, a uracil-modified sequence encoding tremelimumab VL has a reduced number of uracil pairs (UU) with respect to the number of uracil pairs (UU) in the wild-type nucleic acid sequence. In some embodiments, a uracil-modified sequence encoding tremelimumab VL of the disclosure has a number of uracil pairs (UU) corresponding to the minimum possible number of uracil pairs (UU) in the wild-type nucleic acid sequence, e.g., 4 uracil pairs in the case of wild type tremelimumab VL.

In some embodiments, a uracil-modified sequence encoding tremelimumab VL of the disclosure has at least 1, 2, 3, 4, 5, 6, 7, 8, 9, 10, 11, or 12 uracil pairs (UU) less than the number of uracil pairs (UU) in the wild-type nucleic acid sequence. In some embodiments, a uracil-modified sequence encoding tremelimumab VL of the disclosure has between 1 and 3 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, a uracil-modified sequence encoding tremelimumab VL of the disclosure has a % $UU_{wt}$ less than 275%, less than 250%, less than 200%, less than 150%, less than 140%, less than 130%, less than 120%, less than 110%, less than 100%, less than 95%, less than 90%, less than 85%, less than 80%, less than 75%, less than 70%, less than 65%, less than 60%, less than 65%, less than 60%, less than 55%, or less than 50%.

In some embodiments, a uracil-modified sequence encoding tremelimumab VL has a % $UU_{wt}$ between 12% and 143%.

In some embodiments, the polynucleotide of the disclosure comprises a uracil-modified sequence encoding tremelimumab VL disclosed herein. In some embodiments, the uracil-modified sequence encoding tremelimumab VL comprises at least one chemically modified nucleobase, e.g., 5-methoxyuracil. In some embodiments, at least 95% of a nucleobase (e.g., uracil) in a uracil-modified sequence encoding tremelimumab VL of the disclosure are modified nucleobases. In some embodiments, at least 95% of uracil in a uracil-modified sequence encoding tremelimumab VL is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab VL with respect to the theoretical maximum guanine content of a nucleotide sequence encoding tremelimumab VL abbreviated as % $G_{TMX}$ is at least 60%, at least 61%, at least 62%, at least 63%, at least 64%, at least 65%, at least 66%, at least 67%, at least 68%, at least 69%, at least 70%, or at least 71%. In some embodiments, the % $G_{TMX}$ is between about 50% and about 80%, between about 55% and about 75%, between about 57% and about 73%, or between about 60% and about 71%.

In some embodiments, the "cytosine content of the ORF relative to the theoretical maximum cytosine content of a nucleotide sequence encoding tremelimumab VL abbreviated as % $C_{TMX}$, is at least 50%, at least 55%, at least 60%, at least 65%, at least 70%, at least 71%, at least 72%, or at least 73%. In some embodiments, the % $C_{TMX}$ is between about 65% and about 90%, between about 70% and about 85%, between about 72% and about 83%, or between about 73% and about 82%.

In some embodiments, the "guanine and cytosine content (G/C) of the ORF relative to the theoretical maximum G/C content in a nucleotide sequence encoding tremelimumab VL abbreviated as % $G/C_{TMX}$ is at least about 80%, at least about 85%, at least about 89%, at least about 90%, at least about 95%, or about 100%. The % $G/C_{TMX}$ is between about 80% and about 100%, between about 85% and about 99%, between about 87% and about 98%, or between about 89% and about 97%.

In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, at least 106%, at least 110%, at least 115%, at least 120%, at least 121%, at least 122%, at least 123%, or at least 124%.

In some embodiments, the polynucleotide of the disclosure comprises an open reading frame (ORF) encoding tremelimumab VL, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of wild-type tremelimumab-IPI CL is about 18.38%. In some embodiments, the uracil or thymine content of a uracil- or thymine-modified sequence encoding tremelimumab-IPI CL is less than 18.38%. In some embodiments, the uracil or thymine content of a uracil- or thymine-modified sequence encoding a tremelimumab-IPI CL of the disclosure is less than 16%, less than 18%, less than 17%, less than 16%, less than 15%, less than 15%, less than 14%, less that 13%, less than 12%, less than 11%, less than 10%, or less than 9%. In some embodiments, the uracil or thymine content is not less than 17%, 16%, 15%, 14%, 13%, 12%, 11%, or 10%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding tremelimumab-IPI CL of the disclosure is between 10% and 18%, between 10.5% and 170.5%, between 11% and 17%, between 11.5% and 17%, between 12% and 17%, between 120.5% and 17%, or between 13% and 17%.

A uracil- or thymine-modified sequence encoding tremelimumab-IPI CL of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

In some embodiments, the % $U_{WT}$ or % $T_{WT}$ of a uracil- or thymine-modified sequence encoding tremelimumab-IPI CL of the disclosure is above 60%, above 65%, above 70%, above 75%, above 80%, above 85%, above 90%, or above 95%.

In some embodiments, the % $U_{WT}$ or % $T_{WT}$ of a uracil- or thymine modified sequence encoding tremelimumab-IPI CL of the disclosure is between 61% and 103%, between 61% and 102%, between 62% and 101%, between 63% and 100%, between 64% and 99%, between 65% and 98%, between 66% and 97%, between 67% and 96%, between 68% and 95%, between 69% and 94%, between 70% and 83%, or between 71% and 93%.

In a particular embodiment, the % $U_{WT}$ or % $T_{WT}$ of a uracil- or thymine-modified sequence encoding tremelimumab-IPI CL of the disclosure is between about 70% and about 94%.

In some embodiments, the % $U_{TM}$ of a uracil-modified sequence encoding tremelimumab-IPI CL of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding tremelimumab-IPI CL of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, about 132%, above 133%, above 134%, above 135%, above 136%, above 137%, above 138%, above 139%, above 140%, above 141%, above 142%, above 143%, above 144%, above 145%, above 146%, above 147%, above 148%, above 149%, above 150%, above 151%, above 152%, above 153%, above 154%, above 155%, above 156%, above 157%, above 158%, above 159%, above 160%, above 161%, above 162%, above 163%, above 164%, above 165%, above 166%, above 167%, above 168%, above 169%, above 170%, or above 171%.

In some embodiments, the % $U_{TM}$ of a uracil-modified sequence encoding a caTLR4 polypeptide of the disclosure is between 145% and 147%, between 144% and 148%, between 143% and 149%, between 142% and 150%, between 141% and 151%, between 140% and 152%, between 139% and 153%, or between 138% and 154%.

In some embodiments, the % $U_{TM}$ of a uracil-modified sequence encoding tremelimumab-IPI CL of the disclosure is between about 131% and about 172%.

In some embodiments, a uracil-modified sequence encoding tremelimumab-IPI CL of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide. For example, wild-type tremelimumab-IPI CL has 4 phenylalanines. Thus, the absolute minimum number of uracil pairs (UU) that a uracil-modified sequence encoding the tremelimumab-IPI CL of the disclosure would be 4.

Wild type tremelimumab-IPI CL contains 6 uracil pairs (UU), and 0 uracil triplets (UUU). In some embodiments, a uracil-modified sequence encoding tremelimumab-IPI CL of the disclosure has no uracil triplets (UUU).

In some embodiments, a uracil-modified sequence encoding tremelimumab-IPI CL has a reduced number of uracil pairs (UU) with respect to the number of uracil pairs (UU) in the wild-type nucleic acid sequence. In some embodiments, a uracil-modified sequence encoding tremelimumab-IPI CL of the disclosure has a number of uracil pairs (UU) corresponding to the minimum possible number of uracil pairs (UU) in the wild-type nucleic acid sequence, e.g., 4 uracil pairs in the case of wild type tremelimumab-IPI CL.

In some embodiments, a uracil-modified sequence encoding tremelimumab-IPI CL of the disclosure has at least 1, 2, 3, 4, or 5 uracil pairs (UU) less than the number of uracil pairs (UU) in the wild-type nucleic acid sequence. In some embodiments, a uracil-modified sequence encoding tremelimumab-IPI CL of the disclosure has between 1 and 6 uracil pairs (UU).

In some embodiments, a uracil-modified sequence encoding tremelimumab-IPI CL of the disclosure has a % $UU_{wt}$ less than 275%, less than 250%, less than 200%, less than 150%, less than 140%, less than 130%, less than 120%, less than 110%, less than 100%, less than 95%, less than 90%, less than 85%, less than 80%, less than 75%, less than 70%, less than 65%, less than 60%, less than 65%, less than 60%, less than 55%, less than 50%, less than 40%, less than 30%, less than 20%, or less than 10%.

In some embodiments, a uracil-modified sequence encoding tremelimumab-IPI CL has a % $UU_{wt}$ between 11% and 105%.

In some embodiments, the polynucleotide of the disclosure comprises a uracil-modified sequence encoding tremelimumab-IPI CL disclosed herein. In some embodiments, the uracil-modified sequence encoding tremelimumab-IPI CL comprises at least one chemically modified nucleobase, e.g., 5-methoxyuracil. In some embodiments, at least 95% of a nucleobase (e.g., uracil) in a uracil-modified sequence encoding tremelimumab-IPI CL of the disclosure are modified nucleobases. In some embodiments, at least 95% of uracil in a uracil-modified sequence encoding tremelimumab-IPI CL is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab-IPI CL with respect to the theoretical maximum guanine content of a nucleotide sequence encoding tremelimumab-IPI CL," abbreviated as % $G_{TMX}$ is at least 66%, at least 67%, at least 68%, at least about 69%, at least about 70%, at least about 75%, at least about 80%, at least about 85%, at least about 90%, at least about 95%, at least about 100%. In some embodiments, the % $G_{TMX}$ is between about 65% and about 85%, between about 66% and about 84%, between about 67% and about 83%, between about 68% and about 82%, or between about 68% and about 82%.

In some embodiments, the "cytosine content of the ORF relative to the theoretical maximum cytosine content of a nucleotide sequence encoding tremelimumab-IPI CL," abbreviated as % $C_{TMX}$, is at least about 62%, at least about 63%, at least about 64%, at least about 65%, at least about 70%, at least about 75%, at least about 80%, at least about 85%, at least about 90%, at least about 95%, or at least about 100%. In some embodiments, the % $C_{TMX}$ is between about 60% and about 100%, between about 61% and about 99%, between about 62% and about 98%, between about 63% and about 97%, or between about 64% and about 96%.

In some embodiments, the "guanine and cytosine content (G/C) of the ORF relative to the theoretical maximum G/C content in a nucleotide sequence encoding tremelimumab-IPI CL," abbreviated as % $G/C_{TMX}$, is at least about 90%, at least about 91%, at least about 92%, at least about 93%, at least about 94%, at least about 95%, at least about 96%, at least about 97%, at least about 98%, at least about 99, or about 100%. The % $G/C_{TMX}$ is between about 90% and about 130%, between about 91% and about 129%, or between about 92% and about 128%. or between about 92% and about 127%.

In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, or at least 106%. In some embodiments, the polynucleotide of the disclosure comprises an open reading frame (ORF) encoding tremelimumab-IPI CL, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of wild-type tremelimumab IgG2 CH is about 16.05%. In some embodiments, the uracil or thymine content of a uracil- or thymine-modified sequence encoding tremelimumab IgG2 CH is less than 16.05%. In some embodiments, the uracil or thymine content of a uracil- or thymine-modified sequence encoding a tremelimumab IgG2 CH of the disclosure is less than 16%, less than 15%, less than 15%, less than 14%, less that 13%, less than 12%, less than 11%, less than 10%, or less than 9%. In some embodiments, the uracil or thymine content is not less than 15%, 14%, 13%, 12%, 11%, or 10%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding tremelimumab IgG2 CH of the disclosure is between 10% and 16%, between 10.5% and 16%, between 11% and 16%, between 11.5% and 16%, between 12% and 16%, between 12.5% and 16%, between 13% and 16%, between 13.5% and 16%, or between 14% and 16%.

A uracil- or thymine-modified sequence encoding tremelimumab IgG2 CH of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

In some embodiments, the % $U_{WT}$ or % $T_{WT}$ of a uracil- or thymine-modified sequence encoding tremelimumab IgG2 CH of the disclosure is above 60%, above 65%, above 70%, above 75%, above 80%, above 85%, above 90%, above 95%, or above 100%.

In some embodiments, the % $U_{WT}$ or % $T_{WT}$ of a uracil- or thymine modified sequence encoding tremelimumab IgG2 CH of the disclosure is between 79% and 112%, between 80% and 111%, between 81% and 110%, between 82% and 109%, between 83% and 108%, between 84% and 107%, between 85% and 106%, between 86% and 105%, between 87% and 104%, between 88% and 103%, or between 89% and 102%.

In a particular embodiment, the % $U_{WT}$ or % $T_{WT}$ of a uracil- or thymine-modified sequence encoding tremelimumab IgG2 CH of the disclosure is between about 85% and about 105%.

In some embodiments, the % $U_{TM}$ of a uracil-modified sequence encoding tremelimumab IgG2 CH of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, or below 130%.

In some embodiments, the % $U_{TM}$ of a uracil-modified sequence encoding tremelimumab IgG2 CH of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, about 132%, above 133%, above 134%, above 135%, above 136%, above 137%, above 138%, above 139%, above 140%, above 141%, above 142%, above 143%, above 144%, above 145%, above 146%, above 147%, above 148%, above 149%, or above 150%.

In some embodiments, the % $U_{TM}$ of a uracil-modified sequence encoding a caTLR4 polypeptide of the disclosure is between 138% and 140%, between 137% and 141%, between 136% and 142%, between 135% and 143%, between 134% and 144%, between 133% and 145%, between 132% and 146%, between 131% and 147%, between about 130% and 148%, between about 129% and 149%, between about 128% and 150%, or between about 127% and 151%.

In some embodiments, the % $U_{TM}$ of a uracil-modified sequence encoding tremelimumab IgG2 CH of the disclosure is between about 131% and about 150%.

In some embodiments, a uracil-modified sequence encoding tremelimumab IgG2 CH of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide. For example, the wild-type tremelimumab IgG2 CH has 13 phenylalanines. Thus, the absolute minimum number of uracil pairs (UU) that a uracil-modified sequence encoding the tremelimumab IgG2 CH of the disclosure would be 13.

Wild type tremelimumab IgG2 CH contains 15 uracil pairs (UU), and no uracil triplets (UUU). In some embodiments, a uracil-modified sequence encoding tremelimumab IgG2 CH of the disclosure has tremelimumab IgG2 CH 6, 5, 4, 3, 2, or 1 uracil triplets (UUU).

In some embodiments, a uracil-modified sequence encoding tremelimumab IgG2 CH has a reduced number of uracil pairs (UU) with respect to the number of uracil pairs (UU) in the wild-type nucleic acid sequence. In some embodiments, a uracil-modified sequence encoding tremelimumab IgG2 CH of the disclosure has a number of uracil pairs (UU) corresponding to the minimum possible number of uracil pairs (UU) in the wild-type nucleic acid sequence, e.g., 4 uracil pairs in the case of wild type tremelimumab IgG2 CH.

In some embodiments, a uracil-modified sequence encoding tremelimumab IgG2 CH of the disclosure has at least 1, 2, 3, 4, 5, 6 or 7 uracil pairs (UU) less than the number of uracil pairs (UU) in the wild-type nucleic acid sequence. In some embodiments, a uracil-modified sequence encoding tremelimumab IgG2 CH of the disclosure has between 8 and 14 uracil pairs (UU).

In some embodiments, a uracil-modified sequence encoding tremelimumab IgG2 CH of the disclosure has a % $UU_{wt}$ less than 275%, less than 250%, less than 200%, less than 150%, less than 140%, less than 130%, less than 120%, less than 110%, less than 100%, less than 95%, less than 90%, less than 85%, less than 80%, less than 75%, less than 70%, less than 65%, less than 60%, less than 65%, less than 60%, less than 55%, less than 50%, or less than 40%.

In some embodiments, a uracil-modified sequence encoding tremelimumab IgG2 CH has a % $UU_{wt}$ between 50% and 100%.

In some embodiments, the polynucleotide of the disclosure comprises a uracil-modified sequence encoding tremelimumab IgG2 CH disclosed herein. In some embodiments, the uracil-modified sequence encoding tremelimumab IgG2 CH comprises at least one chemically modified nucleobase, e.g., 5-methoxyuracil. In some embodiments, at least 95% of a nucleobase (e.g., uracil) in a uracil-modified sequence encoding tremelimumab IgG2 CH of the disclosure are modified nucleobases. In some embodiments, at least 95% of uracil in a uracil-modified sequence encoding tremelimumab IgG2 CH is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding tremelimumab IgG2 CH with respect to the theoretical maximum guanine content of a nucleotide sequence encoding tremelimumab IgG2 CH," abbreviated as % $G_{TMX}$ is at least 67%, at least 68%, at least about 69%, at least about 70%, at least about 75%, at least about 80%, at least about 85%, at least about 90%, at least about 95%, at least about 100%. In some embodiments, the % $C_{TMX}$ is between about 100% and about 118%, between about 101% and about 117%, between about 102% and about 116%, between about 103% and about 116%, between about 104% and about 116%, or between about 105% and about 116%.

In some embodiments, the "cytosine content of the ORF relative to the theoretical maximum cytosine content of a nucleotide sequence encoding tremelimumab IgG2 CH," abbreviated as % $C_{TMX}$, is at least about 67%, at least about 68%, at least about 69%, at least about 70%, at least about 75%, at least about 80%, at least about 85%, at least about 90%, at least about 95%, or at least about 100%. In some embodiments, the % $C_{TMX}$ is between about 65% and about 80%, between about 66% and about 79%, between about 67% and about 78%, between about 68% and about 77%, or between about 69% and about 6%.

In some embodiments, the "guanine and cytosine content (G/C) of the ORF relative to the theoretical maximum G/C content in a nucleotide sequence encoding tremelimumab IgG2 CH," abbreviated as % $G/C_{TMX}$ is at least about 90%, at least about 91%, at least about 92%, at least about 93%, at least about 94%, at least about 95%, at least about 96%, at least about 97%, at least about 98%, at least about 99, or about 100%. The % $G/C_{TMX}$ is between about 90% and about 100%, between about 91% and about 99%, between about 92% and about 98%, between about 92% and about 97%, or between about 92% and about 96%. In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, or at least 106%.

In some embodiments, the polynucleotide of the disclosure comprises an open reading frame (ORF) encoding tremelimumab IgG2 CH, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

The uracil or thymine content of the IgG1 constant region used in the (tremelimumab and ipilimumab antibody heavy chains disclosed herein (referred to as the "IgG1 constant region of the disclosure" in the present disclosure) is about 16%. In some embodiments, the uracil or thymine content of a uracil- or thymine-modified sequence encoding the IgG1 constant region of the disclosure is less than 16%. In some embodiments, the uracil or thymine content of a uracil- or thymine-modified sequence encoding the IgG1 constant region of the disclosure is less than 16%, less than 15%, less than 14%, less than 12%, or less than 11%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding the IgG1 constant region of the disclosure is between 14% and 18%, between 14% and 19%, between 14% and 20%, between 13% and 18%, between 13% and 19%, between 13% and 20%, between 12% and 18%, between 12% and 19%, between 12% and 20%, between 14% and 16%, or between 15% and 16%.

A uracil- or thymine-modified sequence encoding the IgG1 constant region of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or % $T_{TM}$).

In some embodiments, the % $U_{WT}$ or % $T_{WT}$ of a uracil- or thymine-modified sequence encoding the IgG1 constant region of the disclosure is above 60%, above 65%, above 70%, above 75%, above 80%, above 85%, above 90%, or above 95%.

In some embodiments, the % $U_{WT}$ or % $T_{WT}$ of a uracil- or thymine modified sequence encoding the IgG1 constant region of the disclosure is between 75% and 105%, between 80% and 110%, between 75% and 110%, between 80% and 105%, between 80% and 100%, between 70% and 100%, between 65% and 100%, between 65% and 110%, or between 70% and 110%.

In a particular embodiment, the % $U_{WT}$ or % $T_{WT}$ of a uracil- or thymine-modified sequence encoding the IgG1 constant region of the disclosure is between about 80% and about 100%.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding the IgG1 constant region of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding the IgG1 constant region of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, above 132%, above 133%, above 134%, above 135%, above 136%, above 137%, above 138%, above 139%, above 140%, above 141%, above 142%, above 143%, above 144%, above 145%, above 146%, above 147%, above 148%, above 149%, or above 150%.

In some embodiments, the % $U_{TM}$ of a uracil-modified sequence encoding the IgG1 constant region of the disclosure is between about 127% and about 148%.

In some embodiments, a uracil-modified sequence encoding the IgG1 constant region of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide. For example, the IgG1 constant region of the disclosure has 10 phenylalanines. Thus, the absolute minimum number of uracil pairs (UU) that a uracil-modified sequence encoding the IgG1 constant region of the disclosure would be 10.

The wild type IgG1 constant region of the disclosure contains 12 uracil pairs (UU), and no uracil triplets (UUU) or quadruplets (UUUU). In some embodiments, a uracil-modified sequence encoding the IgG1 constant region of the disclosure has a reduced number of uracil triplets (UUU) with respect to the wild-type nucleic acid sequence. In some embodiments, a uracil-modified sequence encoding the IgG1 constant region of the disclosure contains 4, 3, 2, 1 or no uracil triplets (UUU).

In some embodiments, a uracil-modified sequence encoding the IgG1 constant region of the disclosure has a reduced number of uracil pairs (UU) with respect to the number of uracil pairs (UU) in the wild-type nucleic acid sequence. In some embodiments, a uracil-modified sequence encoding the IgG1 constant region of the disclosure has a number of uracil pairs (UU) corresponding to the minimum possible number of uracil pairs (UU) in the wild-type nucleic acid sequence, e.g., 10 uracil pairs in the case of the IgG1 constant region of the disclosure.

In some embodiments, a uracil-modified sequence encoding the IgG1 constant region of the disclosure has at least 1, 2, 3, 4, 5, 6, 7, 8, 9, 10, 11, or 12 uracil pairs (UU) less than the number of uracil pairs (UU) in the wild-type nucleic acid sequence. In some embodiments, a uracil-modified sequence encoding the IgG1 constant region of the disclosure has between 6 and 16 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, a uracil-modified sequence encoding the IgG1 constant region of the disclosure has a % $UU_{wt}$ less than 134%, less than 130%, less than 125%, less than 120%, less than 115%, less than 110%, less than 105%, less than 100%, less than 95%, less than 90%, less than 85%, less than 80%, less than 75%, less than 70%, less than 65%, less than 60%, less than 65%, less than 60%, less than 55%, or less than 50%.

In some embodiments, a uracil-modified sequence encoding the IgG1 constant region of the disclosure has a % $UU_{wt}$ between 40% and 140%. In some embodiments, a uracil-modified sequence encoding the IgG1 constant region of the disclosure has a % $UU_{wt}$ between 50% and 134%.

In some embodiments, the polynucleotide of the disclosure comprises a uracil-modified sequence encoding the IgG1 constant region of the disclosure disclosed herein. In some embodiments, the uracil-modified sequence encoding the IgG1 constant region of the disclosure comprises at least one chemically modified nucleobase, e.g., 5-methoxyuracil. In some embodiments, at least 95% of a nucleobase (e.g., uracil) in a uracil-modified sequence encoding the IgG1 constant region of the disclosure are modified nucleobases. In some embodiments, at least 95% of uracil in a uracil-modified sequence encoding the IgG1 constant region of the disclosure is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding the IgG1 constant region of the disclosure with respect to the theoretical maximum guanine content of a nucleotide sequence encoding the IgG1 constant region of the disclosure," abbreviated as % $G_{TMX}$, is at least 60%, at least 61%, at least 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, or at least about 80%. In some embodiments, the % $G_{TMX}$ is between about 60% and about 85%, between about 65% and about 80%, between about 67% and about 78%, or between about 68% and about 77%.

In some embodiments, the "cytosine content of the ORF relative to the theoretical maximum cytosine content of a nucleotide sequence encoding the IgG1 constant region of the disclosure," abbreviated as % $C_{TMX}$, is at least 60%, at least 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, or at least about 80%. In some embodiments, the % $C_{TMX}$ is between about 60% and about 85%, between about 65% and about 80%, between about 67% and about 79%, or between about 69% and about 76%.

In some embodiments, the "guanine and cytosine content (G/C) of the ORF relative to the theoretical maximum G/C content in a nucleotide sequence encoding the IgG1 constant region of the disclosure," abbreviated as % $G/C_{TMX}$ is at least about 81%, at least about 85%, at least about 90%, at least about 95%, or about 100%. The % $G/C_{TMX}$ is between about 80% and about 100%, between about 85% and about 99%, between about 90% and about 98%, or between about 92% and about 97%.

In some embodiments, the "G/C content in the ORF relative to the G/C content in the corresponding wild-type ORF," abbreviated as % $G/C_{WT}$ is at least 95%, at least 96%, at least 97%, at least 98%, at least 99%, at least 100%, at least 101%, at least 102%, at least 103%, at least 104%, at least 105%, at least 106%, at least 107%, at least 109%, or at least 110%.

In some embodiments, the polynucleotide of the disclosure comprises an open reading frame (ORF) encoding the IgG1 constant region of the disclosure, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

Sequence Optimized Anti-CTLA-4 Antibodies:

The present disclosure also provides sequence optimized mRNA sequences encoding anti-CTLA-4 antibodies. Compositions comprising these sequence optimized mRNAs can be administered to a subject in need thereof to facilitate in vivo expression and assembly of a therapeutic antibody. Each of the sequence optimized nucleotide sequences disclosed herein is not a wild type nucleotide sequence encoding a therapeutic antibody known in the art.

The present disclosure provides polynucleotides comprising sequence optimized mRNA sequences encoding anti-CTLA-4 antibodies which can be used to express the antibodies, for example, in vivo in a host organism (e.g., in a particular tissue or cell). The sequence optimized mRNA sequences presented in the instant disclosure can present improved properties related to expression efficacy after administration in vivo to a subject in need thereof. Such properties include, but are not limited to, improving nucleic acid stability (e.g., mRNA stability), increasing translation efficacy in the target tissue, reducing the number of truncated proteins expressed, improving the folding or prevent misfolding of the expressed proteins, reducing toxicity of the expressed products, reducing cell death caused by the expressed products, increasing or decreasing protein aggregation, etc.

The sequence optimized nucleotide sequences disclosed herein have been optimized for expression in human subjects, having structural and/or chemical features that avoid one or more of the problems in the art, for example, features which are useful for optimizing formulation and delivery of nucleic acid-based therapeutics while retaining structural and functional integrity, overcoming the threshold of expression, improving expression rates, half-life and/or protein concentrations, optimizing protein localization, and avoiding deleterious bio-responses such as the immune response and/or degradation pathways.

Sequence optimized polynucleotides encoding the anti-CTLA-4 antibodies of the present disclosure are shown in TABLE 2. These codon optimized polynucleotides can be used to practice the methods disclosed elsewhere in the present application, for example, as alternatives or complementing the sequences disclosed in TABLE 1.

TABLE 2

Sequence optimized polynucleotides encoding anti-CTLA-4 antibodies, and their respective polypeptide sequences

| SEQ ID NO | Construct Name | Description |
|---|---|---|
| 251 | aCTLA-4_Ab1_HC_IgG1_001 | Sequence, NT (5' UTR, ORF, 3' UTR) |
| 252 | aCTLA-4_Ab1_HC_IgG1_001 | ORF Sequence, AA |
| 253 | aCTLA-4_Ab1_HC_IgG1_001 | ORF Sequence, NT |
| 254 | aCTLA-4_Ab1_HC_IgG1_001 | mRNA Sequence (assumes T100 tail) |
| 255 | aCTLA-4_Ab1_HC_IgG1_001 | ORF Sequence, AA (without leader sequence) |
| 256 | aCTLA-4_Ab1_HC_IgG1_002 | Sequence, NT (5' UTR, ORF, 3' UTR) |
| 257 | aCTLA-4_Ab1_HC_IgG1_002 | ORF Sequence, AA |
| 258 | aCTLA-4_Ab1_HC_IgG1_002 | ORF Sequence, NT |
| 259 | aCTLA-4_Ab1_HC_IgG1_002 | mRNA Sequence (assumes T100 tail) |
| 260 | aCTLA-4_Ab1_HC_IgG1_002 | ORF Sequence, AA (without leader sequence) |
| 261 | aCTLA-4_Ab1_HC_IgG1_003 | Sequence, NT (5' UTR, ORF, 3' UTR) |
| 262 | aCTLA-4_Ab1_HC_IgG1_003 | ORF Sequence, AA |
| 263 | aCTLA-4_Ab1_HC_IgG1_003 | ORF Sequence, NT |
| 264 | aCTLA-4_Ab1_HC_IgG1_003 | mRNA Sequence (assumes T100 tail) |
| 265 | aCTLA-4_Ab1_HC_IgG1_003 | ORF Sequence, AA (without leader sequence) |
| 266 | aCTLA-4_Ab1_LC_K_001 | Sequence, NT (5' UTR, ORF, 3' UTR) |

TABLE 2-continued

Sequence optimized polynucleotides encoding anti-CTLA-4 antibodies, and their respective polypeptide sequences

| SEQ ID NO | Construct Name | Description |
|---|---|---|
| 267 | aCTLA-4_Ab1_LC_K_001 | ORF Sequence, AA |
| 268 | aCTLA-4_Ab1_LC_K_001 | ORF Sequence, NT |
| 269 | aCTLA-4_Ab1_LC_K_001 | mRNA Sequence (assumes T100 tail) |
| 270 | aCTLA-4_Ab1_LC_K_001 | ORF Sequence, AA (without leader sequence) |
| 271 | aCTLA-4_Ab1_LC_K_002 | Sequence, NT (5' UTR, ORF, 3' UTR) |
| 272 | aCTLA-4_Ab1_LC_K_002 | ORF Sequence, AA |
| 273 | aCTLA-4_Ab1_LC_K_002 | ORF Sequence, NT |
| 274 | aCTLA-4_Ab1_LC_K_002 | mRNA Sequence (assumes T100 tail) |
| 275 | aCTLA-4_Ab1_LC_K_002 | ORF Sequence, AA (without leader sequence) |
| 276 | aCTLA-4_Ab1_LC_K_003 | Sequence, NT (5' UTR, ORF, 3' UTR) |
| 277 | aCTLA-4_Ab1_LC_K_003 | ORF Sequence, AA |
| 278 | aCTLA-4_Ab1_LC_K_003 | ORF Sequence, NT |
| 279 | aCTLA-4_Ab1_LC_K_003 | mRNA Sequence (assumes T100 tail) |
| 280 | aCTLA-4_Ab1_LC_K_003 | ORF Sequence, AA (without leader sequence) |
| 281 | aCTLA-4_Ab2_HC_IgG1_001 | Sequence, NT (5' UTR, ORF, 3' UTR) |
| 282 | aCTLA-4_Ab2_HC_IgG1_001 | ORF Sequence, AA |
| 283 | aCTLA-4_Ab2_HC_IgG1_001 | ORF Sequence, NT |
| 284 | aCTLA-4_Ab2_HC_IgG1_001 | mRNA Sequence (assumes T100 tail) |
| 285 | aCTLA-4_Ab2_HC_IgG1_001 | ORF Sequence, AA (without leader sequence) |
| 286 | aCTLA-4_Ab2_HC_IgG1_002 | Sequence, NT (5' UTR, ORF, 3' UTR) |
| 287 | aCTLA-4_Ab2_HC_IgG1_002 | ORF Sequence, AA |
| 288 | aCTLA-4_Ab2_HC_IgG1_002 | ORF Sequence, NT |
| 289 | aCTLA-4_Ab2_HC_IgG1_002 | mRNA Sequence (assumes T100 tail) |
| 290 | aCTLA-4_Ab2_HC_IgG1_002 | ORF Sequence, AA (without leader sequence) |
| 291 | aCTLA-4_Ab2_HC_IgG1_003 | Sequence, NT (5' UTR, ORF, 3' UTR) |
| 292 | aCTLA-4_Ab2_HC_IgG1_003 | ORF Sequence, AA |
| 293 | aCTLA-4_Ab2_HC_IgG1_003 | ORF Sequence, NT |
| 294 | aCTLA-4_Ab2_HC_IgG1_003 | mRNA Sequence (assumes T100 tail) |
| 295 | aCTLA-4_Ab2_HC_IgG1_003 | ORF Sequence, AA (without leader sequence) |
| 296 | aCTLA-4_Ab2_HC_IgG2_001 | Sequence, NT (5' UTR, ORF, 3' UTR) |
| 297 | aCTLA-4_Ab2_HC_IgG2_001 | ORF Sequence, AA |
| 298 | aCTLA-4_Ab2_HC_IgG2_001 | ORF Sequence, NT |
| 299 | aCTLA-4_Ab2_HC_IgG2_001 | mRNA Sequence (assumes T100 tail) |
| 300 | aCTLA-4_Ab2_HC_IgG2_001 | ORF Sequence, AA (without leader sequence) |
| 301 | aCTLA-4_Ab2_HC_IgG2_002 | Sequence, NT (5' UTR, ORF, 3' UTR) |
| 302 | aCTLA-4_Ab2_HC_IgG2_002 | ORF Sequence, AA |
| 303 | aCTLA-4_Ab2_HC_IgG2_002 | ORF Sequence, NT |
| 304 | aCTLA-4_Ab2_HC_IgG2_002 | mRNA Sequence (assumes T100 tail) |
| 305 | aCTLA-4_Ab2_HC_IgG2_002 | ORF Sequence, AA (without leader sequence) |
| 306 | aCTLA-4_Ab2_HC_IgG2_003 | Sequence, NT (5' UTR, ORF, 3' UTR) |
| 307 | aCTLA-4_Ab2_HC_IgG2_003 | ORF Sequence, AA |
| 308 | aCTLA-4_Ab2_HC_IgG2_003 | ORF Sequence, NT |
| 309 | aCTLA-4_Ab2_HC_IgG2_003 | mRNA Sequence (assumes T100 tail) |
| 310 | aCTLA-4_Ab2_HC_IgG2_003 | ORF Sequence, AA (without leader sequence) |
| 311 | aCTLA-4_Ab2_LC_K_001 | Sequence, NT (5' UTR, ORF, 3' UTR) |
| 312 | aCTLA-4_Ab2_LC_K_001 | ORF Sequence, AA |
| 313 | aCTLA-4_Ab2_LC_K_001 | ORF Sequence, NT |
| 314 | aCTLA-4_Ab2_LC_K_001 | mRNA Sequence (assumes T100 tail) |
| 315 | aCTLA-4_Ab2_LC_K_001 | ORF Sequence, AA (without leader sequence) |
| 316 | aCTLA-4_Ab2_LC_K_002 | Sequence, NT (5' UTR, ORF, 3' UTR) |
| 317 | aCTLA-4_Ab2_LC_K_002 | ORF Sequence, AA |
| 318 | aCTLA-4_Ab2_LC_K_002 | ORF Sequence, NT |
| 319 | aCTLA-4_Ab2_LC_K_002 | mRNA Sequence (assumes T100 tail) |
| 320 | aCTLA-4_Ab2_LC_K_002 | ORF Sequence, AA (without leader sequence) |
| 321 | aCTLA-4_Ab2_LC_K_003 | Sequence, NT (5' UTR, ORF, 3' UTR) |
| 322 | aCTLA-4_Ab2_LC_K_003 | ORF Sequence, AA |
| 323 | aCTLA-4_Ab2_LC_K_003 | ORF Sequence, NT |
| 324 | aCTLA-4_Ab2_LC_K_003 | mRNA Sequence (assumes T100 tail) |
| 325 | aCTLA-4_Ab2_LC_K_003 | ORF Sequence, AA (without leader sequence) |

Sequence optimized anti-CTLA-4 polynucleotides encoding tremelimumab and ipilimumab are shown in TABLE 3. These sequence optimized anti-CTLA-4 polynucleotides can be used to practice the methods disclosed elsewhere in the present application, for example, as alternatives or complementing the sequences disclosed in TABLES 1 and 2.

TABLE 3 presents the protein sequences of the light chains of tremelimumab (Treme-LC) and ipilimumab (IPI-LC), as well as heavy chains of tremelimumab (two forms, an IgG1 form and an IgG2) and ipilimumab (only an IgG1 form).

The protein subsequences corresponding to the constant regions, variable regions, and signal peptides are provided. Also included in TABLE 3 are sequence optimized anti-CTLA-4 polynucleotide sequences corresponding to each of the heavy chains and light chain for tremelimumab and ipilimumab. A person skilled in the art can easily determine with regions in the sequence optimized polynucleotides correspond to each one of the domains in the heavy or light chain.

Compositional analyses of the regions encoding the different domain of the codon optimized heavy and light chain sequences are presented in FIGS. 80A to 86D. The VH region is common to the IgG1 and IgG2 forms of the heavy chain of tremelimumab. The constant region of the LC is also common to the light chains for tremelimumab and ipilimumab.

Sequence comparison data provided in the specification and claims refers to sequences and subsequence in TABLE 3. The schema used to define a subsequence corresponding to a codon optimized sequence in TABLE 3 would be the following schema:

[Antibody sequence]-[Chain]-[Domain]-[Codon optimized sequence]

Accordingly, IPI-HC-Var-CO9, would be the sequence corresponding to Ipilimumab, heavy chain, variable region, from codon optimized sequence 09 (CO09).

TABLE 3

Optimized Tremelimumab and Ipilimumab Sequences

| SEQ ID NO | Description | Sequence |
|---|---|---|
| 326 | Treme_LC (full light chain) | METPAQLLFLLLLWLPDTTGDIQMTQSPSSLSASVGDRVTITCRASQSINSY<br>LDWYQQKPGKAPKLLIYAASSLQSGVPSRFSGSGSGTDFTLTISSLQPEDFA<br>TYYCQQYYSTPFTFGPGTKVEIKRTVAAPSVFIFPPSDEQLKSGTASVVCLL<br>NNFYPREAKVQWKVDNALQSGNSQESVTEQDSKDSTYSLSSTLTLSKADYEK<br>HKVYACEVTHQGLSSPVTKSFNRGEC |
| 327 | Treme_LC (signal peptide) | METPAQLLFLLLLWLPDTTG |
| 328 | Treme_LC (variable region, VL) | DIQMTQSPSSLSASVGDRVTITCRASQSINSYLDWYQQKPGKAPKLLIYAAS<br>SLQSGVPSRFSGSGSGTDFTLTISSLQPEDFATYYCQQYYSTPFTFGPGTKV<br>EIK |
| 329 | Treme_LC (constant region, CL) | RTVAAPSVFIFPPSDEQLKSGTASVVCLLNNFYPREAKVQWKVDNALQSGNS<br>QESVTEQDSKDSTYSLSSTLTLSKADYEKHKVYACEVTHQGLSSPVTKSFNR<br>GEC |
| 330 | Treme_LC-CO01 | ATGGAGACGCCCGCGCAGCTCCTCTTCCTCCTCCTCCTCTGGCTCCCCGACA<br>CCACCGGGGATATCCAGATGACCCAGTCCCCGAGCTCACTCTCCGCCAGCGT<br>TGGGGACCGGGTTACCATTACCTGCCGGGCGAGCCAGAGCATCAACAGCTAC<br>CTCGACTGGTACCAACAGAAGCCCGGCAAGGCCCCCAAGCTCCTTATTTACG<br>CCGCCAGCTCCTTACAGAGCGGGGTGCCCTCCAGGTTCAGCGGCTCCGGCTC<br>CGGCACCGACTTCACCCTAACCATCAGCAGCCTCCAGCCCGAAGACTTCGCC<br>ACGTACTACTGCCAGCAGTACTACAGCACCCCCTTCACCTTCGGGCCCGGCA<br>CCAAGGTGGAGATCAAGAGGACCGTGGCCGCCCCCAGCGTGTTTATCTTCCC<br>GCCCAGCGACGAGCAGTTAAAGTCCGGCACCGCGAGCGTGGTGTGTCTGCTG<br>AACAATTTCTACCCCCGGGAGGCCAAGGTGCAGTGGAAGGTGGATAACGCCC<br>TGCAGAGCGGCAATAGCCAGGAGTCCGTGACCGAGCAGGACAGCAAGGACAG<br>CACCTACTCCCTCAGCAGTACCCTGACTCTGAGCAAGGCCGATTACGAGAAG<br>CATAAGGTGTACGCCTGCGAGGTGACGCACCAAGGGCTGAGCTCACCCGTAA<br>CCAAGAGCTTCAACAGGGGGGAGTGC |
| 331 | Treme_LC-CO02 | ATGGAGACACCCGCCCAGCTTCTCTTCCTCTTGCTCCTTTGGCTCCCCGACA<br>CCACGGGGGACATCCAGATGACCCAGTCGCCCAGCAGCCTCAGCGCCAGCGT<br>TGGCGACAGGGTCACCATAACCTGTAGGGCCAGCCAGAGCATCAACAGCTAC<br>CTCGACTGGTACCAGCAGAAGCCGGGCAAGGCGCCCAAGCTCCTCATATACG<br>CCGCCTCCAGCCTCCAGTCCGGCGTCCCCAGCCGCTTCTCGGGCTCGGGCAG<br>CGGCACCGACTTCACGCTCACCATCTCCTCGCTCCAGCCCGAGGACTTTGCC<br>ACCTACTACTGTCAGCAGTACTATTCGACCCCCTTCACCTTCGGGCCGGGGA<br>CCAAGGTGGAGATCAAACGGACCGTGGCCGCCCCCAGCGTCTTTATCTTCCC<br>TCCCAGCGACGAGCAGTTGAAAAGCGGGACCGCCTCCGTGGTGTGCCTGCTG<br>AACAACTTTTATCCCAGGGAGGCCAAAGTGCAGTGGAAGGTGGACAATGCCC<br>TGCAGAGTGGCAACTCCCAGGAGAGCGTGACCGAGCAAGACTCCAAGGATTC<br>CACCTATAGCCTGTCCAGCACCCTCACCCTGTCCAAGGCCGACTATGAGAAG<br>CATAAGGTCTACGCCTGCGAGGTCACCCACCAGGGGCTGTCCAGCCCCGTGA<br>CCAAGAGCTTCAACAGGGGCGAGTGC |
| 332 | Treme_LC-CO03 | ATGGAGACACCCGCCCAGCTCCTCTTCCTCCTCCTTCTCTGGCTCCCCGACA<br>CCACCGGGGATATCCAGATGACCCAGAGCCCCAGCTCCCTATCGGCCTCCGT<br>AGGCGACCGCGTCACCATCACGTGCCGAGCCTCCCAATCCATTAATAGCTAT<br>TTGGACTGGTACCAACAGAAGCCGGGCAAGGCACCGAAGCTCTTGATCTACG<br>CCGCCAGCTCGCTCCAAAGCGGCGTACCGAGCCGCTTCAGCGGCAGCGGCTC<br>CGGGACCGATTTCACCCTCACCATCAGCAGCCTCCAGCCCGAGGACTTCGCC<br>ACCTACTATTGCCAGCAGTATTACAGCACCCCCTTCACCTTCGGGCCCGGAA<br>CCAAGGTGGAGATCAAGCGCACCGTGGCCGCCCCCAGCGTGTTTATCTTTCC<br>CCCGAGCGATGAGCAGCTGAAAAGCGGCACTGCCAGCGTGGTGTGCCTGCTG<br>AACAACTTCTACCCGCGCGAGGCGAAGGTCCAATGGAAAGTGGACAATGCCC<br>TGCAGAGCGGGAATAGCCAGGAGTCCGTGACCGAGCAGGACAGCAAGGACAG<br>CACCTACAGCCTGTCCAGCACCCTGACGCTGTCCAAAGCCGACTACGAGAAG<br>CACAAGGTCTACGCCTGCGAGGTGACCCACCAGGGCCTGAGCAGCCCCGTGA<br>CCAAGAGCTTCAATAGGGGGGAGTGC |

TABLE 3-continued

| Optimized Tremelimumab and Ipilimumab Sequences | | |
|---|---|---|
| SEQ ID NO | Description | Sequence |
| 333 | Treme_LC-CO04 | ATGGAGACGCCCGCCCAGCTCCTCTTCCTCCTCCTCCTCTGGCTCCCCGACA<br>CCACCGGGGATATCCAGATGACCCAGTCCCCCAGCAGCCTCAGCGCCTCCGT<br>CGGGGACAGGGTCACCATCACCTGCCGGGCCTCCCAGTCCATCAATTCCTAC<br>CTCGACTGGTACCAGCAGAAGCCCGGCAAGGCCCCCAAGCTCCTCATCTACG<br>CCGCCAGCAGCTTGCAGAGCGGCGTCCCTTCCCGTTTCAGCGGCAGCGGGAG<br>CGGCACGGACTTCACCCTCACCATCTCGAGCCTCCAACCCGAGGATTTCGCC<br>ACCTACTACTGCCAGCAGTATTACAGCACCCCCTTCACCTTTGGCCCAGGGA<br>CCAAGGTGGAGATAAAGCGGACGGTGGCCGCCCCCAGCGTGTTCATCTTCCC<br>GCCCAGCGACGAACAGCTGAAAAGCGGGACCGCCAGCGTGGTGTGCCTGCTG<br>AACAACTTCTACCCCAGGGAGGCCAAGGTACAGTGGAAGGTGGACAATGCCC<br>TGCAAAGCGGGAACAGCCAGGAGAGCGTGACCGAGCAGGACTCCAAAGATTC<br>CACCTACAGCCTGTCCAGCACCCTGACTCTATCCAAGGCCGACTACGAAAAA<br>CACAAGGTGTACGCCTGCGAAGTCACCCACCAGGGTCTGAGCAGCCCCGTGA<br>CCAAGAGCTTTAACAGGGGGGAGTGC |
| 334 | Treme_LC-CO05 | ATGGAAACCCCCGCCCAGCTCCTCTTCCTCTTACTCCTCTGGCTCCCCGATA<br>CCACAGGGGACATCCAGATGACCCAGAGCCCCAGCTCCCTCTCCGCCAGCGT<br>CGGCGACCGGGTCACCATCACGTGCAGGGCCAGCCAGAGCATCAACTCGTAC<br>CTCGACTGGTATCAGCAGAAGCCCGGGAAGGCCCCCAAGCTCCTCATCTACG<br>CCGCCTCCTCCCTCCAGAGCGGCGTCCCGTCGAGGTTCAGCGGGTCGGGGTC<br>GGGCACCGACTTCACCCTAACCATCTCCAGCCTACAGCCGGAGGACTTTGCC<br>ACCTACTACTGCCAGCAATACTACTCCACGCCCTTCACCTTCGGCCCCGGCA<br>CCAAGGTGGAAATCAAGAGGACCGTGGCCGCCCCCTCCGTGTTTATCTTCCC<br>GCCCAGCGACGAGCAGCTCAAGAGCGGGACCGCCAGCGTGGTGTGCCTGCTC<br>AATAACTTCTACCCCCGGGAGGCCAAAGTGCAGTGGAAGGTGGACAACGCGC<br>TGCAGAGCGGTAACAGCCAGGAGTCCGTGACGGAGCAGGACTCCAAGGATTC<br>GACCTACTCCCTGAGCTCGACGCTGACCCTGAGCAAGGCCGACTACGAGAAG<br>CACAAGGTGTACGCCTGCGAGGTGACCCACCAAGGGCTGTCCAGCCCCGTGA<br>CCAAATCCTTCAACAGAGGGGAGTGC |
| 335 | Treme_LC-CO06 | ATGGAGACGCCCGCCCAGCTCCTCTTTCTTTTGCTCCTCTGGCTCCCGGACA<br>CAACCGGCGATATCCAGATGACCCAATCCCCCAGCAGCCTCAGCGCCAGCGT<br>CGGGGACAGGGTCACCATCACCTGCCGGGCCAGCCAGAGCATCAACAGCTAT<br>CTCGACTGGTACCAGCAGAAGCCCGGCAAGGCCCCCAAGCTTCTAATATACG<br>CCGCCAGCTCCCTCCAAAGCGGCGTACCGAGCCGGTTCTCCGGCAGCGGCAG<br>CGGGACCGACTTCACCCTCACGATCAGCAGCCTCCAGCCCGAAGACTTCGCG<br>ACCTATTACTGCCAACAGTATTACAGCACCCCGTTCACCTTCGGGCCCGGGA<br>CCAAGGTAGAGATCAAGCGCACCGTGGCCGCACCCTCCGTGTTTATCTTCCC<br>CCCGAGCGATGAGCAGCTGAAAAGCGGGACCGCCAGCGTGGTGTGCCTGCTG<br>AATAATTTTTACCCCAGGGAAGCCAAGGTGCAGTGGAAGGTGGACAACGCCC<br>TGCAGTCCGGCAACTCCCAGGAGTCCGTGACGGAGCAGGACAGCAAGGACAG<br>CACCTACAGCCTGTCCAGCACCCTCACCCTGAGCAAGGCCGACTACGAAAAG<br>CACAAGGTCTACGCCTGTGAGGTGACGCACCAGGGGCTGAGCTCCCCCGTCA<br>CCAAGAGCTTCAATCGCGGGGAGTGT |
| 336 | Treme_LC-CO07 | ATGGAGACTCCCGCCCAGCTCCTTTTCCTCCTTCTCCTCTGGTTGCCCGATA<br>CCACGGGCGACATCCAGATGACGCAGAGCCCCTCCAGCCTCAGCGCCTCCGT<br>TGGCGATAGGGTCACCATCACGTGTCGAGCCAGCCAGAGCATCAACTCCTAC<br>CTTGACTGGTACCAGCAGAAGCCCGGAAAGGCGCCCAAGCTCCTAATCTACG<br>CCGCCAGCAGCCTCCAAAGCGGCGTCCCCAGCCGCTTCAGCGGGTCCGGGTC<br>CGGCACCGACTTCACCCTCACCATATCGAGCCTACAGCCCGAGGATTTTGCA<br>ACGTACTATTGCCAGCAATATTATAGCACCCCCTTCACCTTCGGCCCCGGCA<br>CCAAGGTCGAGATTAAGCGGACCGTGGCGGCCCCCAGCGTGTTCATCTTCCC<br>TCCGAGCGATGAGCAGCTGAAAAGCGGGACCGCCAGCGTGGTCTGCCTGCTG<br>AACAACTTCTACCCCAGGGAGGCCAAGGTCCAGTGGAAGGTCGACAACGCCC<br>TCCAGTCTGGCAACAGCCAGGAGTCCGTGACCGAGCAGGACAGCAAGGACTC<br>CACGTACTCCCTGTCGAGCACCCTGACCCTGAGCAAGGCCGACTACGAGAAG<br>CACAAGGTCTACGCCTGTGAGGTGACCCATCAGGGCCTGTCCAGCCCCGTGA<br>CCAAGAGCTTTAACAGGGGAGAGTGC |
| 337 | Treme_LC-CO08 | ATGGAGACACCCGCCCAGCTCCTCTTCCTCCTCCTCCTATGGCTTCCAGACA<br>CCACCGGAGACATCCAGATGACCCAGAGCCCCAGCTCCCTCTCCGCCAGCGT<br>CGGCGACCGAGTCACCATCACCTGCAGGGCGAGCCAGAGCATAAACAGCTAC<br>CTCGACTGGTATCAGCAGAAGCCGGGCAAAGCCCCGAAGCTGCTCATTTACG<br>CCGCCAGCAGTCTCCAGAGCGGCGTACCCAGCAGGTTCAGCGGCAGCGGCTC<br>CGGCACCGACTTCACCCTCACGATAAGCAGCCTCCAGCCCGAGGACTTCGCG<br>ACCTACTACTGCCAGCAGTATTACTCCACGCCCTTCACCTTTGGCCCCGGGA<br>CCAAGGTGGAGATCAAGCGCACCGTGGCCGCCCCGAGCGTGTTCATCTTCCC<br>ACCCAGCGATGAGCAGCTGAAAAGCGGCACGGCCAGCGTCGTCTGCCTGCTG<br>AATAATTTCTACCCCCGGGAGGCCAAGGTGCAGTGGAAAGTGGACAATGCCC<br>TCCAGAGCGGCAACAGCCAGGAGAGCGTGACCGAGCAGGACTCCAAGGACAG<br>CACCTACAGCCTGTCCTCGACGCTGACCCTGTCCAAGGCCGACTACGAGAAA<br>CACAAAGTGTATGCCTGCGAGGTCACCCACCAGGGACTGAGCAGCCCGGTCA<br>CGAAGTCCTTCAACCGGGGCGAGTGC |

TABLE 3-continued

Optimized Tremelimumab and Ipilimumab Sequences

| SEQ ID NO | Description | Sequence |
|---|---|---|
| 338 | Treme_LC-CO09 | ATGGAGACGCCCGCGCAGCTCCTCTTCCTCCTCCTCCTCTGGCTCCCCGACA CCACCGGCGACATCCAGATGACCCAGTCTCCGAGCTCCCTCTCCGCGAGCGT CGGCGACCGGGTCACCATAACCTGCAGGGCCAGCCAGAGCATCAACAGCTAT CTCGACTGGTACCAGCAGAAGCCCGGCAAGGCCCCCAAACTCCTCATCTACG CCGCCTCCAGCCTCCAGAGCGGCGTTCCCAGCCGGTTCAGCGGGTCCGGCAG CGGCACGGACTTTACCCTCACCATCAGCAGCCTCCAACCGGAGGACTTCGCC ACCTACTACTGCCAGCAGTATTACAGCACCCCCTTCACCTTTGGGCCCGGCA CTAAGGTGGAGATCAAGCGCACCGTGGCCGCCCCCAGCGTGTTCATCTTCCC GCCCAGCGACGAACAGCTGAAGTCCGGCACAGCCAGCGTGGTGTGCCTGCTG AACAATTTCTACCCCAGGGAAGCCAAGGTGCAGTGGAAGGTGGACAACGCCC TGCAGTCCGGCAACAGCCAGGAGTCCGTGACGGAACAGGACTCCAAGGACTC CACCTACAGCCTATCCTCCACTCTCACCCTGTCCAAGGCCGACTACGAGAAG CACAAGGTGTACGCCTGCGAGGTGACCCACCAGGGCCTCTCCAGCCCCGTTA CCAAAAGCTTCAACCGGGGAGAGTGC |
| 339 | Treme_LC-CO10 | ATGGAGACGCCCGCCCAGCTTCTCTTCCTCCTCCTCCTCTGGCTTCCGGACA CCACCGGCGACATCCAGATGACGCAGTCGCCCAGCAGCCTCAGCGCCTCCGT CGGGGACAGGGTCACCATCACCTGCAGGGCCTCCCAGTCCATCAACTCCTAC CTCGACTGGTACCAGCAGAAGCCGGGGAAAGCCCCCAAGCTCTTAATCTACG CCGCGAGCAGCCTCCAGAGCGGGGTACCCTCGAGGTTCAGCGGCAGCGGCAG CGGCACGGACTTCACCCTTACCATCAGCAGCCTCCAGCCCGAGGATTTCGCC ACCTACTACTGTCAGCAGTACTACAGCACCCCCTTCACCTTCGGCCCCGGTA CCAAGGTGGAGATCAAGAGGACCGTGGCCGCCCCCAGCGTCTTCATCTTCCC GCCCAGCGATGAGCAGCTGAAATCCGGCACCGCCAGCGTGGTTTGCCTGCTG AACAACTTCTACCCTCGGGAGGCCAAGGTGCAATGGAAGGTGGACAACGCGC TGCAGTCGGGCAACAGCCAGGAAAGCGTGACCGAGCAGGACTCCAAGGACAG CACCTATAGCCTGAGCTCCACGCTGACCCTGTCCAAGGCGGATTACGAGAAG CACAAGGTGTACGCCTGCGAGGTCACGCACCAGGGCCTGTCAAGTCCGGTGA CCAAAAGCTTCAACAGGGGCGAGTGC |
| 340 | Treme_LC-CO11 | ATGGAGACTCCCGCCCAGCTCCTTTTCCTCCTCCTCCTCTGGCTCCCGGACA CCACCGGCGATATCCAGATGACCCAGAGCCCGTCCTCCCTAAGCGCCAGCGT AGGCGACAGGGTCACAATCACCTGCAGGGCCAGCCAGAGCATCAACAGCTAT TTGGACTGGTACCAGCAGAAGCCCGGCAAAGCCCCAAAGCTCCTAATCTACG CCGCCAGCTCCCTTCAGAGCGGCGTCCCCTCCCGGTTTTCCGGTAGCGGATC CGGGACCGACTTTACCTTGACCATCAGCAGCCTCCAGCCGGAAGATTTCGCC ACCTATTACTGCCAGCAGTACTACAGCACCCCCTTCACCTTCGGCCCCGGCA CCAAGGTGGAAATCAAAAGGACCGTGGCCGCCCCCAGCGTGTTCATTTTCCC TCCCAGCGATGAGCAGCTGAAGTCGGGGACCGCCTCCGTGGTCTGCCTGCTG AACAACTTTTATCCCAGGGAGGCCAAGGTGCAATGGAAAGTGGACAACGCCC TGCAAAGCGGGAACAGCCAGGAGAGCGTGACCGAGCAGGACAGCAAGGACTC CACCTACAGCCTGTCCTCCACCCTGACCCTCAGCAAGGCGGACTACGAAAAG CATAAGGTGTATGCCTGCGAGGTGACCCACCAGGGGCTGTCCAGCCCGGTGA CGAAGTCCTTCAACAGGGGGGAGTGC |
| 341 | Treme_LC-CO12 | ATGGAAACGCCCGCCCAACTACTTTTCCTCCTCCTCCTCTGGCTCCCCGACA CCACGGGCGACATCCAGATGACCCAATCCCCCAGCAGCCTCAGCGCCAGCGT AGGGGATAGGGTCACCATAACCTGCCGCGCCAGCCAGAGCATCAATAGCTAT CTCGACTGGTACCAGCAGAAGCCGGGGAAGGCCCCGAAGCTCCTCATCTACG CCGCCTCCTCACTCCAGAGCGGGGTCCCCTCTCGCTTCAGCGGAAGCGGGAG CGGCACCGACTTCACGCTCACCATCTCCTCCCTCCAGCCCGAGGACTTTGCT ACCTACTACTGCCAGCAGTACTATAGCACCCCCTTCACCTTCGGGCCCGGCA CCAAGGTGGAGATCAAGAGGACGGTGGCCGCCCCCTCCGTGTTCATATTCCC CCCGAGCGACGAGCAGCTGAAAAGCGGCACCGCCAGCGTGGTGTGCCTGCTG AATAACTTCTACCCCAGGGAAGCCAAGGTGCAGTGGAAGGTGGACAACGCCC TGCAGAGCGGCAACAGCCAGGAGTCCGTCACCGAACAGGACTCGAAGGACAG CACGTACAGCCTCAGCAGCACCCTGACCCTGAGTAAGGCCGACTACGAGAAG CATAAGGTGTACGCATGCGAAGTCACCCACCAGGGCCTGAGCAGCCCCGTGA CAAAGTCCTTCAACCGGGGGGAGTGT |
| 342 | Treme_LC-CO13 | ATGGAAACCCCCGCCCAGCTCCTCTTCCTCCTCCTCCTCTGGCTCCCCGACA CCACGGGGGACATCCAGATGACCCAGAGCCCCAGCTCCCTCTCCGCCAGCGT CGGAGATCGGGTCACGATCACCTGCCGGGCCAGCCAGTCCATCAACAGCTAC CTCGACTGGTACCAGCAGAAGCCCGGCAAGGCCCCCAAGCTCCTTATATACG CCGCCTCCAGCCTTCAGAGCGGGGTCCCGAGCCGATTCAGCGGCTCCGGGTC CGGCACAGATTTCACCCTCACCATCAGCTCCCTACAGCCGGAAGACTTCGCC ACCTACTACTGCCAGCAGTACTACTCAACCCCGTTCACGTTTGGCCCCGGTA CAAAGGTGGAGATCAAAAGGACCGTCGCCGCCCCCAGCGTGTTCATTTTCCC GCCCAGCGACGAGCAGCTGAAAAGCGGCACTGCCAGCGTGGTGTGCCTGCTC AACAACTTTTACCCCAGGGAGGCCAAGGTGCAGTGGAAAGTGGACAACGCCC TCCAGAGCGGGAACAGCCAGGAGAGCGTCACCGAGCAGGACAGCAAAGACAG CACGTACTCTCTGTCCAGCACCCTGACCCTCAGCAAGGCGGACTATGAGAAA CACAAGGTGTACGCCTGCGAAGTGACCCACCAGGGCCTGAGCAGCCCGGTGA CCAAGTCCTTCAACAGGGGCGAGTGC |

TABLE 3-continued

Optimized Tremelimumab and Ipilimumab Sequences

| SEQ ID NO | Description | Sequence |
|---|---|---|
| 343 | Treme_LC-CO14 | ATGGAGACTCCCGCCCAGCTCCTCTTTCTTCTCCTCCTATGGCTCCCCGACA CCACAGGCGACATCCAGATGACCCAGAGCCCCTCCAGCCTCAGCGCCTCGGT CGGCGACAGGGTCACCATCACCTGCAGGGCCAGCCAGTCCATCAATAGCTAC CTCGACTGGTACCAGCAGAAGCCCGGCAAGGCCCCCAAGCTCCTTATCTACG CCGCCAGCAGCCTCCAGAGCGGGGTCCCGAGCCGTTTCAGCGGCAGCGGTAG CGGCACGGACTTCACCCTCACCATCAGCAGCCTCCAGCCCGAGGATTTTGCC ACCTACTACTGCCAGCAGTATTACTCCACCCCCTTCACCTTCGGACCCGGGA CGAAGGTAGAGATCAAGAGGACGGTGGCGGCCCCCTCGGTGTTCATCTTCCC GCCCAGCGATGAGCAGCTAAAGTCCGGCACCGCCAGCGTGGTGTGCCTGCTG AACAACTTTTACCCGAGGGAGGCCAAGGTTCAGTGGAAGGTGGACAACGCCC TGCAGAGCGGGAACTCCCAGGAGTCCGTGACGGAGCAGGACAGCAAGGACAG CACCTACAGCCTGAGCAGCACCCTGACCCTGAGCAAGGCCGATTACGAGAAG CACAAGGTGTACGCCTGCGAGGTGACCCATCAGGGCCTGAGCTCCCCGGTCA CCAAGAGCTTCAACAGGGGCGAGTGC |
| 344 | Treme_LC-CO15 | ATGGAAACGCCCGCCCAGCTCCTCTTTCTCCTCCTCCTCTGGCTCCCCGACA CCACGGGCGACATCCAGATGACCCAGTCCCCCAGCAGCCTCTCCGCCAGCGT CGGCGATAGGGTCACCATCACCTGCCGGGCGTCCCAAAGCATCAACTCCTAC CTGGACTGGTACCAGCAGAAGCCCGGCAAGGCGCCCAAGCTCCTTATCTACG CCGCCAGCAGCCTCCAGAGCGGCGTCCCCAGCAGGTTCTCCGGGAGCGGGTC CGGCACCGACTTCACCCTCACGATCTCCAGCCTCCAGCCCGAGGACTTCGCC ACGTACTATTGTCAGCAGTACTACTCCACCCCGTTCACCTTCGGCCCGGGCA CCAAGGTGGAGATCAAGAGGACGGTGGCCGCGCCCAGCGTGTTCATCTTCCC TCCCTCCGATGAGCAGCTGAAGTCCGGCACCGCCTCCGTGGTCTGTCTGCTG AACAACTTCTACCCCCGGGAGGCCAAGGTGCAGTGGAAGGTGGATAATGCCC TGCAGAGCGGCAACAGCCAGGAGAGCGTGACCGAGCAGGACTCCAAGGACAG CACCTACAGCCTCAGCTCCACCCTGACCCTGAGCAAGGCCGACTACGAGAAG CACAAGGTGTATGCCTGTGAGGTCACCCATCAAGGGCTGTCCTCCCCCGTGA CCAAGAGCTTCAACCGTGGCGAGTGT |
| 345 | Treme_LC-CO16 | ATGGAGACGCCCGCCCAATTGCTGTTCTTGCTCCTCCTCTGGCTCCCCGACA CGACGGGCGACATCCAGATGACCCAGAGCCCCAGCTCCCTATCCGCCAGCGT CGGCGACAGGGTCACCATCACCTGCCGCGCCTCCCAGAGCATCAATAGCTAC CTCGACTGGTACCAGCAGAAGCCCGGCAAGGCCCCCAAACTCCTAATCTACG CCGCCTCCTCGCTCCAATCCGGAGTCCCCAGCCGGTTCAGCGGGAGCGGCAG CGGAACGGATTTCACCCTCACGATCAGCTCCCTCCAGCCGGAGGACTTTGCC ACCTACTACTGTCAGCAGTACTACTCCACGCCCTTTACCTTTGGGCCCGGCA CCAAGGTTGAGATCAAGCGGACGGTGGCCGCGCCCAGCGTGTTCATCTTCCC GCCCTCCGACGAGCAGCTCAAGAGCGGGACCGCCAGCGTGGTCTGTCTGCTG AACAACTTCTACCCGAGGGAGGCCAAGGTGCAGTGGAAGGTGGACAACGCCC TGCAGAGCGGCAACTCCCAGGAGAGCGTCACCGAGCAAGACTCGAAGGACAG CACCTACTCACTGTCCAGCACCCTGACCCTGTCGAAGGCCGACTATGAGAAG CACAAGGTCTACGCCTGCGAGGTGACCCACCAGGGCCTTAGCAGCCCGGTGA CCAAGAGCTTCAACAGGGGCGAGTGC |
| 346 | Treme_LC-CO17 | ATGGAGACACCCGCCCAGCTTCTCTTCCTCCTCCTCCTCTGGCTCCCCGACA CCACCGGCGACATCCAGATGACCCAAAGCCCCAGCAGCCTCTCCGCCAGCGT CGGCGACAGGGTCACCATAACTTGCCGGGCCTCCCAGTCCATCAATAGCTAC CTAGACTGGTATCAGCAGAAGCCCGGCAAGGCCCCCAAATTACTCATCTACG CCGCCAGCTCCCTCCAGTCCGGCGTCCCCAGCCGGTTCAGCGGGAGCGGCTC GGGCACCGACTTCACGCTCACCATTTCCAGCCTCCAGCCGGAGGACTTCGCG ACATACTACTGCCAGCAGTACTACAGCACCCCCTTCACGTTCGGGCCCGGCA CCAAGGTGGAGATCAAGCGGACCGTGGCCGCCCCGAGCGTGTTCATCTTCCC GCCCTCCGATGAGCAGCTGAAGTCCGGCACCGCTTCCGTGGTGTGTCTCCTG AACAACTTTTACCCAAGGGAGGCCAAGGTGCAGTGGAAAGTTGACAACGCTC TGCAGAGCGGCAACAGCCAGGAGAGCGTGACCGAGCAGGACAGCAAAGACTC CACCTACAGCCTTAGCAGCACACTGACCCTGTCCAAGGCCGACTACGAGAAG CACAAGGTGTACGCCTGTGAGGTGACCCACCAGGGGCTGTCCAGCCCCGTGA CCAAGAGCTTCAATAGGGGGGAGTGC |
| 347 | Treme_LC-CO18 | ATGGAGACGCCGGCCCAGCTCCTCTTTCTCCTCCTCCTCTGGCTCCCGGACA CGACGGGGGATATCCAGATGACCCAGAGCCCCAGCTCCCTCAGCGCCAGCGT CGGCGATCGAGTCACGATCACCTGCCGGGCGTCCCAGAGCATCAACAGTTAC CTCGACTGGTACCAGCAGAAGCCCGGCAAGGCCCCCAAGCTCTTAATCTACG CCGCCAGCAGCCTCCAGAGCGGCGTTCCGTCCAGGTTCAGCGGCTCCGGCTC GGGGACCGACTTCACCTTGACCATCAGCAGCCTCCAGCCCGAGGACTTCGCC ACCTACTACTGTCAGCAGTACTATTCCACCCCATTCACCTTCGGCCCCGGCA CCAAGGTCGAGATCAAGCGAACCGTGGCCGCCCCCAGCGTGTTTATCTTCCC GCCCAGCGACGAGCAGCTGAAAAGCGGCACCGCCAGCGTGGTGTGCCTGCTG AACAACTTCTACCCGAGGGAGGCCAAGGTGCAGTGGAAGGTGGACAATGCCC TGCAGAGCGGCAACTCCCAGGAGAGCGTGACGGAGCAGGACAGCAAGGACTC CACCTACAGCTTGTCAAGCACCCTGACGCTTAGCAAGGCTGACTATGAGAAG CACAAGGTTTACGCCTGCGAAGTGACCCATCAAGGGCTGAGCTCACCCGTGA CGAAAAGCTTCAATAGGGGTGAGTGC |

TABLE 3-continued

| Optimized Tremelimumab and Ipilimumab Sequences | | |
|---|---|---|
| SEQ ID NO | Description | Sequence |
| 348 | Treme_LC-CO19 | ATGGAGACGCCCGCCCAGCTCCTCTTCCTCCTCCTCCTCTGGCTCCCCGATA<br>CCACCGGCGACATCCAGATGACCCAGTCACCCTCCAGCCTCAGCGCGAGCGT<br>CGGGGATCGAGTAACTATCACCTGCCGGGCCAGCCAGAGCATCAACAGCTAC<br>CTCGATTGGTACCAGCAAAAGCCCGGCAAGGCCCCCAAATTACTCATATACG<br>CGGCCAGCTCCCTCCAGTCCGGAGTCCCGTCCCGGTTCAGCGGCAGCGGGAG<br>CGGGACCGACTTCACCCTCACAATCTCAAGCCTCCAGCCCGAGGACTTCGCC<br>ACGTACTATTGCCAGCAGTACTACAGCACCCCCTTCACCTTCGGCCCCGGCA<br>CCAAGGTGGAGATCAAGAGGACGGTGGCCGCGCCCAGCGTCTTCATCTTTCC<br>CCCCTCCGACGAACAGCTGAAAAGCGGGACCGCCTCGGTGGTGTGCCTGCTG<br>AACAACTTTTACCCAAGGGAGGCCAAGGTGCAGTGGAAGGTGGACAACGCCC<br>TCCAGTCCGGGAACTCCCAGGAGTCCGTGACCGAGCAGGACTCTAAGGACAG<br>CACCTACTCCCTGTCCAGCACGCTGACGCTCAGCAAGGCGGACTACGAGAAG<br>CACAAGGTGTACGCCTGTGAGGTGACCCACCAGGGCCTGTCGAGCCCCGTCA<br>CCAAGAGCTTCAACAGGGGCGAGTGT |
| 349 | Treme_LC-CO20 | ATGGAGACTCCCGCCCAGCTCCTCTTTCTCCTCCTCCTCTGGCTCCCCGACA<br>CGACCGGGGACATCCAAATGACCCAGAGCCCCAGCAGCCTCAGCGCAAGCGT<br>AGGCGATCGGGTCACCATCACCTGCAGGGCCAGCCAGTCCATCAACTCGTAC<br>CTCGACTGGTACCAGCAGAAGCCCGGCAAAGCTCCCAAGCTCCTCATATACG<br>CCGCTAGCTCCCTCCAGAGCGGGGTCCCTAGTAGGTTCAGCGGGTCCGGGAG<br>CGGCACCGACTTCACGCTCACCATCTCCAGCTTGCAGCCCGAGGACTTCGCC<br>ACTTACTACTGCCAGCAGTACTACAGCACCCCCTTTACGTTTGGCCCCGGCA<br>CCAAGGTGGAGATCAAGAGGACCGTGGCCGCCCCCAGCGTGTTCATCTTCCC<br>GCCCAGCGACGAGCAGCTGAAGTCGGGCACCGCTTCAGTTGTCTGTCTGCTG<br>AACAACTTTTACCCCCGCGAGGCCAAGGTGCAGTGGAAGGTGGACAACGCCC<br>TCCAGAGCGGGAACAGCCAGGAGAGCGTGACGGAGCAGGACTCCAAGGATAG<br>CACCTACAGCCTGAGTTCGACCCTCACGCTGAGCAAGGCCGACTACGAGAAA<br>CACAAGGTGTATGCCTGCGAGGTGACCCACCAGGGGCTTTCCTCCCCCGTCA<br>CCAAGAGCTTCAATAGGGGGGAGTGC |
| 350 | Treme_LC-CO21 | ATGGAGACGCCCGCGCAACTTCTCTTCCTACTCCTCCTCTGGCTCCCCGACA<br>CCACCGGGGACATCCAGATGACCCAGTCCCCCTCGAGCCTCTCAGCCTCCGT<br>AGGGGACCGGGTCACCATCACTTGCAGGGCCAGCCAAAGCATCAACAGCTAC<br>CTCGACTGGTACCAGCAGAAGCCCGGGAAGGCCCCGAAGCTCCTCATCTACG<br>CCGCCAGCAGCCTCCAGTCCGGCGTACCCAGCAGGTTCTCCGGCTCCGGGAG<br>CGGAACCGACTTCACACTCACCATCTCGTCCCTCCAGCCCGAGGATTTTGCC<br>ACCTACTACTGTCAGCAGTACTACAGCACCCCCTTTACCTTTGGCCCCGGCA<br>CCAAAGTGGAGATCAAACGGACCGTGGCCGCCCCCTCGGTGTTCATATTCCC<br>GCCAAGCGACGAGCAGCTGAAAAGCGGCACGGCCTCCGTGGTGTGCCTGCTG<br>AACAACTTCTATCCCCGCGAAGCCAAGGTGCAGTGGAAGGTCGATAACGCCC<br>TGCAATCAGGGAACAGCCAGGAGTCGGTGACCGAGCAGGACAGCAAAGATAG<br>CACCTACTCCCTGAGCAGCACCCTGACCCTGTCCAAGGCGGACTACGAGAAA<br>CATAAGGTGTACGCGTGCGAGGTGACCCATCAGGGACTGAGCAGCCCCGTGA<br>CGAAGTCCTTCAACCGGGGCGAGTGC |
| 351 | Treme_LC-CO22 | ATGGAGACACCCGCCCAGCTCCTCTTCCTCCTCTTGCTCTGGCTCCCCGACA<br>CGACCGGGGACATCCAGATGACGCAGAGCCCTTCTTCGTTGTCCGCCTCCGT<br>CGGCGACCGGGTCACCATCACCTGCAGAGCCTCCCAGAGCATCAATAGCTAC<br>CTCGACTGGTACCAGCAGAAGCCGGGCAAGGCCCCCAAGCTCCTCATCTACG<br>CCGCCAGCAGCTTACAGAGCGGGGTACCCAGCCGGTTCTCGGGGAGCGGGAG<br>CGGCACCGACTTCACCCTCACCATCAGCAGCCTCCAGCCCGAGGACTTCGCC<br>ACCTATTACTGCCAGCAGTACTATAGCACCCCCTTCACCTTTGGGCCGGGCA<br>CGAAGGTGGAAATTAAGCGGACCGTGGCCGCCCCCAGCGTGTTCATCTTCCC<br>ACCCTCCGACGAGCAGCTCAAGAGCGGAACCGCCAGCGTGGTGTGTCTGCTG<br>AATAACTTCTACCCGCGCGAGGCCAAGGTCCAGTGGAAGGTGGACAACGCCC<br>TGCAGAGCGGGAACAGCCAGGAGTCCGTGACCGAGCAGGACAGCAAGGACAG<br>CACGTACAGCCTGTCCAGCACCCTGACCCTGTCCAAGGCCGACTATGAGAAG<br>CACAAGGTGTATGCCTGCGAGGTGACCCACCAAGGGCTGTCCAGCCCCGTGA<br>CCAAGTCCTTCAACAGGGGTGAGTGC |
| 352 | Treme_LC-CO23 | ATGGAGACGCCCGCGCAACTCCTCTTCCTCCTCCTCCTCTGGTTACCCGACA<br>CCACGGGCGATATCCAGATGACCCAGTCGCCCAGCAGCTTGTCCGCCAGCGT<br>AGGGGACAGGGTCACCATCACCTGCCGGGCATCTCAGAGCATCAACTCCTAC<br>CTCGACTGGTACCAGCAGAAGCCCGGCAAGGCCCCCAAGCTCTTGATCTACG<br>CCGCCAGCAGCCTCCAGAGCGGCGTCCCCTCGCGGTTCAGCGGGAGCGGCAG<br>CGGGACGGACTTCACCCTCACCATAAGCTCTCTCCAGCCAGAGGATTTCGCC<br>ACGTACTACTGTCAGCAGTATTACAGCACCCCGTTCACGTTCGGCCCCGGCA<br>CGAAGGTGGAGATCAAGCGGACCGTGGCCGCCCCCTCGGTGTTCATCTTTCC<br>CCCCTCCGACGAACAGCTGAAGTCGGGCACCGCCAGCGTGGTGTGCCTGCTG<br>AACAACTTCTACCCGCGCGAAGCCAAGGTGCAGTGGAAGGTAGACAATGCAC<br>TGCAGTCCGGCAACAGCCAAGAGTCCGTAACCGAGCAGGACTCCAAGGACAG<br>CACATACAGCCTGAGCAGTACCCTCACGCTCAGCAAGGCAGACTACGAGAAG<br>CACAAGGTCTATGCCTGCGAGGTGACCCACCAGGGCCTGAGCTCCCCCGTGA<br>CCAAGAGCTTTAACAGGGGCGAGTGC |

TABLE 3-continued

Optimized Tremelimumab and Ipilimumab Sequences

| SEQ ID NO | Description | Sequence |
|---|---|---|
| 353 | Treme_LC-CO24 | ATGGAGACGCCCGCCCAGCTCCTCTTTCTCCTCCTCCTCTGGCTCCCCGACA<br>CCACGGGGGACATCCAGATGACCCAGAGCCCCTCCAGCCTCAGCGCCTCGGT<br>AGGCGACAGGGTTACCATCACCTGCCGGGCCTCCCAGTCGATCAATTCCTAC<br>CTCGACTGGTACCAGCAGAAGCCGGGCAAGGCCCCCAAGCTCCTCATTTACG<br>CCGCGAGCTCCCTCCAGTCCGGCGTCCCCAGCCGGTTTTCCGGCTCGGGCAG<br>CGGCACCGATTTTACCCTCACGATCTCCAGCTTGCAGCCCGAGGACTTCGCC<br>ACCTACTACTGTCAGCAGTATTACTCCACCCCGTTCACCTTTGGCCCCGGGA<br>CCAAAGTGGAGATCAAGCGTACGGTCGCCGCCCCCAGCGTGTTCATTTTCCC<br>ACCCAGCGACGAGCAACTCAAGTCCGGCACCGCCAGCGTGGTGTGCCTCCTG<br>AACAACTTTTATCCCCGCGAGGCCAAGGTGCAGTGGAAGGTGGACAACGCCC<br>TGCAAAGCGGCAACAGCCAGGAAAGCGTGACGGAGCAGGACTCCAAAGACTC<br>CACGTACAGCCTCTCCAGCACCCTGACCCTGAGCAAAGCAGACTACGAGAAA<br>CACAAGGTGTACGCCTGCGAGGTGACCCACCAGGGGCTCAGCAGCCCCGTGA<br>CCAAGAGCTTTAACCGGGGTGAGTGC |
| 354 | Treme_LC-CO25 | ATGGAAACGCCCGCCCAGCTTCTCTTCCTCCTACTCCTCTGGCTCCCCGACA<br>CCACCGGGGACATCCAGATGACCCAGAGCCCCTCCAGCCTCTCGGCCTCGGT<br>TGGCGACAGAGTAACCATAACCTGCCGGGCCTCCCAGAGCATCAACAGCTAC<br>CTCGACTGGTACCAGCAGAAGCCCGGCAAGGCGCCCAAGCTCTTGATTTACG<br>CGGCAAGCAGCTTGCAGTCCGGCGTCCCCTCACGGTTCAGCGGGAGCGGGTC<br>AGGCACCGACTTTACGCTCACCATCTCGAGCCTCCAGCCAGAGGACTTTGCC<br>ACCTACTACTGCCAACAGTATTACAGCACCCCGTTCACCTTCGGCCCAGGAA<br>CCAAGGTGGAGATCAAGCGCACCGTGGCCGCCCCCAGCGTCTTCATCTTCCC<br>GCCCAGCGACGAGCAGCTGAAAAGCGGCACCGCCTCCGTGGTGTGCCTGCTG<br>AATAACTTTTACCCGCGGGAGGCCAAGGTGCAGTGGAAGGTGGACAACGCCC<br>TCCAGAGCGGGAACTCCCAGGAGAGCGTGACCGAACAGGACAGCAAGGACTC<br>CACGTACTCCCTTAGCAGCACCCTGACCCTGTCGAAGGCCGATTACGAGAAG<br>CACAAGGTGTACGCCTGCGAGGTGACCCACCAGGGTTTATCCTCGCCCGTGA<br>CCAAGTCCTTCAACCGAGGCGAGTGC |
| 355 | Treme_HC_IgG2 (tremelimumab IgG2 heavy chain) | METPAQLLFLLLLWLPDTTGQVQLVESGGGVVQPGRSLRLSCAASGFTFSSY<br>GMHWVRQAPGKGLEWVAVIWYDGSNKYYADSVKGRFTISRDNSKNTLYLQMN<br>SLRAEDTAVYYCARDPRGATLYYYYYGMDVWGQGTTVTVSSASTKGPSVFPL<br>APCSRSTSESTAALGCLVKDYFPEPVTVSWNSGALTSGVHTFPAVLQSSGLY<br>SLSSVVTVPSSNFGTQTYTCNVDHKPSNTKVDKTVERKCCVECPPCPAPPVA<br>GPSVFLFPPKPKDTLMISRTPEVTCVVVDVSHEDPEVQFNWYVDGVEVHNAK<br>TKPREEQFNSTFRVVSVLTVVHQDWLNGKEYKCKVSNKGLPAPIEKTISKTK<br>GQPREPQVYTLPPSREEMTKNQVSLTCLVKGFYPSDIAVEWESNGQPENNYK<br>TTPPMLDSDGSFFLYSKLTVDKSRWQQGNVFSCSVMHEALHNHYTQKSLSLS<br>PGK |
| 356 | Treme_HC_IgG2 (signal peptide) | METPAQLLFLLLLWLPDTTG |
| 357 | Treme_HC_IgG2 (variable region, VH) | QVQLVESGGGVVQPGRSLRLSCAASGFTFSSYGMHWVRQAPGKGLEWVAVIW<br>YDGSNKYYADSVKGRFTISRDNSKNTLYLQMNSLRAEDTAVYYCARDPRGAT<br>LYYYYYGMDVWGQGTTVTVSS |
| 358 | Treme_HC_IgG2 (constant region) | ASTKGPSVFPLAPCSRSTSESTAALGCLVKDYFPEPVTVSWNSGALTSGVHT<br>FPAVLQSSGLYSLSSVVTVPSSNFGTQTYTCNVDHKPSNTKVDKTVERKCCV<br>ECPPCPAPPVAGPSVFLFPPKPKDTLMISRTPEVTCVVVDVSHEDPEVQFNW<br>YVDGVEVHNAKTKPREEQFNSTFRVVSVLTVVHQDWLNGKEYKCKVSNKGLP<br>APIEKTISKTKGQPREPQVYTLPPSREEMTKNQVSLTCLVKGFYPSDIAVEW<br>ESNGQPENNYKTTPPMLDSDGSFFLYSKLTVDKSRWQQGNVFSCSVMHEALH<br>NHYTQKSLSLSPGK |
| 359 | Treme_HC_IgG2-CO01 | ATGGAGACGCCGGCCCAGCTATTGTTCCTCCTCCTCCTCTGGCTCCCCGACA<br>CCACCGGGCAGGTCCAGCTAGTTGAGAGCGGCGGGGGCGTCGTCCAGCCCGG<br>CAGGTCCCTCAGGCTCAGCTGCGCCGCCTCGGGGTTCACCTTCAGCTCCTAC<br>GGCATGCACTGGGTCAGGCAGGCCCCCGGCAAGGGGCTCGAGTGGGTCGCCG<br>TCATCTGGTACGACGGTAGCAATAAGTATTACGCCGATAGCGTCAAGGGCCG<br>GTTTACCATAAGCAGGGACAACAGCAAGAACACCCTCTACCTGCAGATGAAC<br>AGTCTGAGGGCCGAGGATACCGCCGTGTACTACTGTGCTCGGGACCCCAGGG<br>GTGCCACTCTGTACTACTACTACTACGGCATGGACGTGTGGGGCCAGGGCAC<br>GACGGTGACCGTGAGCTCCGCCTCCACCAAGGGCCCCTCTGTGTTCCCGCTG<br>GCCCCCTGCAGCCGGTCCACCAGCGAAAGCACCGCCGCCCTGGGCTGCCTGG<br>TGAAGGACTACTTCCCCGAGCCCGTGACCGTCAGCTGGAACAGCGGAGCTCT<br>GACCAGCGGCGTGCACACCTTTCCCGCCGTGCTCCAGAGCAGCGGCTTGTAC<br>AGCCTGTCCAGCGTGGTGACCGTGCCGAGCAGCAACTTCGGCACCCAAACGT<br>ACACCTGCAACGTGGACCATAAGCCCAGCAACACCAAGGTGGACAAGACCGT<br>GGAGCGGAAATGCTGCGTGGAGTGCCCACCCTGTCCCGCCCCCGCCGGTGGCC<br>GGCCCCTCCGTGTTTCTGTTTCCGCCCAAGCCGAAGGACACCCTGATGATCA<br>GCCGCACCCCGGAGGTGACCTGCGTGGTGGTGGACGTGAGCCACGAGGACCC<br>CGAGGTGCAATTCAACTGGTACGTTGATGGCGTGGAGGTCCACAACGCCAAG<br>ACCAAGCCCAGGGAGGAACAGTTTAACTCCACCTTCCGGGTCGTGAGCGTGC |

TABLE 3-continued

Optimized Tremelimumab and Ipilimumab Sequences

| SEQ ID NO | Description | Sequence |
|---|---|---|
| | | TGACTGTGGTGCACCAGGACTGGCTGAACGGCAAGGAGTACAAGTGCAAGGT GAGCAACAAGGGGCTGCCCGCCCCCATCGAGAAGACGATCTCCAAGACCAAG GGCCAGCCCCGCGAACCCCAAGTGTACACCCTGCCCCCCAGCCGGGAGGAAA TGACCAAAAACCAGGTGAGCCTTACCTGTCTGGTGAAGGGCTTTTACCCCAG CGACATCGCCGTGGAATGGGAGTCGAACGGCCAGCCGGAGAACAACTATAAA ACCACCCCTCCCATGCTGGACAGCGACGGCTCTTTCTTCCTGTATAGCAAGC TGACTGTGGACAAGAGCCGCTGGCAGCAGGGCAACGTGTTCTCATGCTCCGT GATGCACGAAGCCCTACACAACCACTACACCCAGAAAAGCCTCAGCCTCAGC CCCGGCAAG |
| 360 | Treme_HC_IgG2-CO02 | ATGGAGACGCCCGCCCAACTCCTCTTTCTCCTCCTCCTCTGGCTCCCCGACA CGACCGGCCAAGTCCAGCTCGTCGAGAGCGGCGGCGGCGTCGTCCAGCCGGG GAGGTCCCTCAGGCTCTCGTGCGCCGCCAGCGGCTTCACCTTCAGTTCCTAC GGCATGCACTGGGTCAGGCAGGCCCCCGGCAAGGGTCTGGAGTGGGTCGCCG TCATCTGGTACGACGGCAGCAACAAGTACTACGCCGACAGCGTAAAGGGCCG GTTCACCATCAGCAGGGACAATTCGAAGAACACCCTGTATCTGCAGATGAAC TCCCTCAGGGCCGAGGACACCGCCGTGTACTACTGCGCCAGGGACCCCAGGG GGGCCACCCTCTACTATTACTACTACGGCATGGACGTGTGGGGGCAGGGGAC CACCGTCACCGTGTCCAGCGCCAGCACGAAGGGGCCCAGCGTCTTCCCGCTG GCCCCCTGCAGCAGGAGCACCAGCGAGAGCACCGCTGCCCTGGGGTGCCTGG TGAAGGACTACTTTCCGGAGCCCGTGACAGTGAGCTGGAACAGCGGCGCCCT GACCAGCGGGGTGCACACGTTCCCCGCAGTGCTGCAGAGCAGCGGGCTGTAC AGCCTCTCCAGCGTGGTGACCGTGCCCAGCAGCAACTTTGGCACCCAGACGT ACACCTGCAACGTGGACCACAAGCCCTCAAATACCAAGGTCGACAAGACCGT GGAGCGGAAGTGCTGTGTGGAGTGCCCACCCTGCCCAGCCCCGCCCGTGGCC GGCCCCTCCGTGTTCCTGTTTCCCCCGAAGCCGAAGGACACCCTCATGATCT CCAGGACCCCCGAAGTGACCTGCGTGGTGGTGGACGTGAGCCACGAGGACCC CGAGGTGCAGTTCAACTGGTACGTTGACGGGGTGGAGGTGCACAACGCCAAG ACCAAGCCCCGCGAGGAGCAATTCAACAGCACCTTCAGGGTGGTGAGCGTAC TGACCGTAGTGCACCAGGACTGGCTGAACGGCAAGGAGTACAAGTGTAAGGT GAGCAACAAGGGCCTGCCCGCCCCCATCGAAAAGACAATTTCCAAGACGAAG GGGCAACCCAGGGAGCCCCAGGTGTATACCCTGCCCCCCAGCAGGGAGGAGA TGACGAAGAACCAGGTGTCGCTGACCTGTCTCGTCAAGGGCTTCTATCCGAG CGACATCGCCGTGGAGTGGGAGTCGAACGGGCAACCCGAGAACAACTATAAG ACCACGCCCCCCATGCTGGACTCCGACGGGAGCTTCTTCCTCTACAGCAAGC TGACCGTGGACAAAAGCCGGTGGCAGCAGGGGAACGTGTTCAGCTGCTCCGT GATGCACGAGGCGCTGCATAATCACTACACCCAGAAGTCCCTGAGCCTGAGC CCGGGCAAG |
| 361 | Treme_HC_IgG2-CO03 | ATGGAGACGCCAGCCCAGCTCCTCTTTCTCTTACTCCTCTGGCTACCGGACA CCACCGGCCAGGTCCAGCTCGTCGAGAGCGGCGGCGGCGTCGTCCAGCCGGG CAGGTCCCTCAGGCTCAGCTGCGCCGCCAGCGGCTTCACCTTCAGCTCCTAC GGCATGCACTGGGTAAGGCAGGCGCCGGGCAAGGGCCTAGAGTGGGTCGCCG TTATCTGGTACGACGGGAGCAACAAATACTACGCCGACAGCGTCAAGGGAAG GTTCACCATCAGCAGGGATAACTCCAAAAATACCCTCTACCTCCAGATGAAC TCCCTGAGGGCGGAGGATACCGCGGTGTACTACTGCGCCAGGGATCCCAGGG GCGCCACCCTCTACTATTACTACTACGGCATGGATGTATGGGGCCAGGGGAC CACCGTGACCGTCAGCTCCGCCTCCACCAAAGGCCCGTCCGTGTTCCCCCTG GCGCCCTGCAGCAGGAGCACCAGCGAGAGCACCGCTGCCCTGGGCTGCCTGG TGAAGGACTACTTCCCGGAGCCCGTGACCGTGTCATGGAACTCCGGGGCCCT GACCAGCGGCGTCCACACCTTCCCCGCCGTGCTGCAGTCCTCCGGACTGTAC TCGCTGAGCTCCGTGGTGACGGTCCCCAGCTCCAATTTCGGGACCCAGACCT ACACCTGCAACGTGGACCACAAGCCCAGCAACACCAAGGTGGACAAGACCGT GGAACGAAAGTGCTGCGTCGAGTGTCCCCCCTGCCCCGCCCCGCCCGTCGCC GGCCCCAGCGTGTTCCTGTTCCCACCCAAGCCCAAGGACACGCTGATGATCT CCCGGACCCCCGAGGTGACCTGCGTGGTCGTGGACGTGTCTCACGAGGACCC CGAGGTGCAGTTCAATTGGTACGTGGACGGGGTCGAGGTCCACAACGCCAAG ACTAAGCCCCGGGAGGAGCAGTTCAACAGCACGTTCAGGGTGGTGTCCGTGC TGACCGTCGTCCACCAGGACTGGCTCAACGGCAAGGAGTACAAGTGCAAGGT TTCCAACAAGGGGCTCCCCGCCCCCATCGAGAAGACGATTTCCAAGACCAAG GGCCAACCCCGCGAGCCCCAGGTGTACACCCTGCCCCCCAGCAGGGAGGAGA TGACCAAAAACCAGGTGTCCCTGACCTGCCTGGTGAAGGGGTTCTACCCGAG CGACATCGCCGTGGAGTGGGAGAGCAACGGGCAGCCCGAGAACAACTACAAG ACCACCCCGCCGATGCTGGATAGCGACGGGAGCTTCTTCCTCTACTCCAAGC TCACCGTGGACAAGAGCCGCTGGCAGCAGGGCAACGTGTTCAGCTGCAGCGT GATGCACGAGGCCCTGCATAACCACTACACCCAGAAAAGCCTGTCCCTGAGC CCCGGCAAG |
| 362 | Treme_HC_IgG2-CO04 | ATGGAGACACCCGCCCAACTCCTCTTTTTGCTCCTCCTTTGGCTCCCCGACA CCACCGGCCAGGTCCAGCTCGTCGAGAGCGGCGGCGGGGTTGTCCAGCCGGG CCGCTCCCTCAGGCTCAGCTGTGCCGCCAGCGGCTTCACTTTCAGCAGCTAC GGCATGCACTGGGTCAGGCAGGCCCCCGGCAAGGGCTTGGAGTGGGTTGCCG TTATCTGGTACGACGGCAGCAACAAGTACTACGCCGATTCCGTCAAGGGCCG CTTCACCATAAGCAGAGACAACAGCAAAAACACGCTCTATCTGCAGATGAAC AGCCTGCGGGCCGAGGACACCGCCGTGTATTACTGTGCCAGGGATCCGCGCG |

TABLE 3-continued

Optimized Tremelimumab and Ipilimumab Sequences

| SEQ ID NO | Description | Sequence |
|---|---|---|
| | | GCGCCACCCTGTACTACTATTACTACGGGATGGACGTGTGGGGCCAGGGCAC CACTGTTACCGTCTCCAGCGCCAGCACGAAGGGGCCCAGCGTCTTTCCGCTG GCCCCCTGCAGCCGGAGCACGTCCGAGAGCACTGCCGCCCTGGGGTGCCTGG TGAAGGACTACTTCCCCGAGCCCGTGACCGTCTCATGGAACTCCGGCGCTCT GACCTCCGGGGTGCATACCTTCCCCGCCGTGCTTCAGTCCAGCGGCCTGTAC AGCCTGAGCTCCGTGGTGACCGTGCCCTCCAGCAACTTTGGGACTCAGACCT ACACCTGCAACGTCGACCACAAGCCAAGCAACACCAAGGTAGACAAGACCGT GGAGCGGAAGTGCTGCGTGGAGTGCCCGCCCTGCCCTGCCCCTCCCGTCGCC GGCCCAAGCGTGTTCCTGTTCCCACCCAAGCCCAAGGATACCCTGATGATTT CCCGGACCCCCGAGGTGACCTGCGTCGTGGTGGACGTCAGCCACGAAGACCC CGAGGTGCAGTTCAATTGGTACGTGGATGGCGTGGAAGTGCACAACGCCAAG ACGAAGCCAAGGGAGGAGCAGTTTAACTCCACCTTCCGGGTGGTGAGCGTGC TCACCGTCGTCCACCAGGACTGGCTCAATGGGAAGGAGTACAAGTGCAAGGT GTCCAATAAGGGCCTGCCCGCCCCCATCGAGAAAACGATCAGCAAGACCAAG GGGCAGCCAAGGGAGCCCCAGGTGTACACCCTCCCACCCAGCCGGGAGGAGA TGACCAAGAATCAGGTCAGCCTCACTTGCCTGGTGAAGGGCTTTTACCCCTC CGACATCGCCGTGGAGTGGGAGAGCAACGGCCAGCCCGAAAATAACTACAAG ACCACCCCACCGATGCTGGATAGCGACGGCAGCTTCTTCCTGTACAGCAAGC TGACCGTGGACAAGTCCCGCTGGCAGCAGGGCAACGTGTTCTCGTGCAGCGT GATGCACGAGGCTCTGCATAACCACTACACCCAGAAATCCCTCTCCCTGTCC CCCGGCAAG |
| 363 | Treme_HC_IgG2-CO05 | ATGGAGACACCCGCCCAGCTCCTCTTCCTCCTCCTATTGTGGCTCCCGGATA CCACCGGGCAGGTCCAGCTGGTGGAGAGCGGCGGGGGCGTCGTACAGCCCGG CAGGAGCCTCAGGCTCAGCTGCGCCGCCAGCGGCTTCACCTTCAGCAGCTAC GGCATGCACTGGGTCAGGCAGGCCCCAGGGAAGGGGTTGGAGTGGGTCGCCG TCATCTGGTACGACGGGAGCAACAAATACTACGCAGACAGCGTCAAGGGCCG ATTCACCATTAGCCGGGATAACAGCAAGAACACCCTCTACCTGCAAATGAAC AGCCTGAGGGCCGAGGACACGGCCGTATACTATTGCGCCAGGGACCCCCGTG GCGCCACACTGTACTATTACTACTACGGTATGGACGTTTGGGGGCAGGGTAC TACCGTGACCGTCTCGAGCGCCAGCACCAAAGGCCCCAGCGTGTTCCCCCTG GCCCCCTGCTCCAGGAGCACCAGCGAGTCCACCGCCGCGCTGGGCTGCCTGG TGAAGGATTACTTCCCCGAGCCCGTGACGGTGAGCTGGAACAGCGGGGCCCT GACAAGCGGAGTGCATACCTTCCCGGCAGTGCTGCAAAGCAGCGGCCTCTAC AGCCTGAGCAGCGTCGTGACCGTGCCCAGCAGCAACTTCGGCACACAGACCT ACACCTGCAACGTGGACCACAAGCCCAGCAACACGAAGGTGGACAAGACCGT GGAGAGGAAGTGCTGCGTGGAATGCCCACCCTGCCCCGCCCCGCCCGTGGCC GGCCCCAGTGTGTTTCTGTTCCCACCCAAGCCGAAGGATACCCTGATGATCT CCCGGACCCCCGAGGTGACCTGCGTGGTGGTGGATGTGAGCCACGAGGACCC CGAAGTGCAGTTCAACTGGTATGTCGACGGCGTGGAGGTACACAATGCCAAG ACCAAGCCCAGGGAGGAACAGTTCAACAGCACGTTTCGGGTGGTGAGCGTGC TCACTGTCGTCCACCAAGACTGGCTGAACGGCAAGGAGTACAAGTGCAAGGT GAGCAACAAGGGGCTGCCCGCGCCCATCGAGAAAACCATCTCCAAGACCAAA GGCCAGCCGCGGGAGCCCCAGGTGTATACCCTGCCACCGAGCAGGGAGGAGA TGACCAAAAATCAAGTGTCGCTGACCTGCCTCGTCAAGGGCTTTTACCCAAG CGATATCGCGGTGGAGTGGGAAAGCAACGGCCAGCCCGAAAACAACTACAAG ACCACCCCGCCCATGCTCGACTCAGATGGTAGCTTCTTTCTGTACAGCAAGC TGACCGTGGACAAGAGCAGGTGGCAGCAGGGCAACGTGTTCTCCTGCAGCGT GATGCACGAGGCCCTGCACAACCACTATACCCAAAAGAGCCTAAGCCTGAGC CCCGGCAAG |
| 364 | Treme_HC_IgG2-CO06 | ATGGAGACGCCCGCCCAGCTCCTCTTCCTCCTATTGCTGTGGCTCCCCGATA CCACCGGGCAGGTCCAGCTCGTAGAGTCGGGCGGCGGAGTAGTCCAACCGGG GAGGAGCCTCAGGCTCAGCTGCGCAGCCTCCGGCTTCACCTTCAGCAGCTAC GGCATGCACTGGGTACGGCAGGCCCCGGGAAAGGGCCTCGAGTGGGTCGCCG TCATCTGGTACGACGGCAGCAACAAGTACTACGCCGACAGCGTCAAGGGCCG CTTCACCATCTCCAGGGATAACAGCAAGAACACCCTTTACCTGCAGATGAAC AGCCTCAGGGCCGAGGACACCGCCGTGTATTACTGCGCGCGGGATCCCCGCG GCGCGACGCTGTACTACTACTACTATGGGATGGACGTGTGGGGCCAGGGCAC TACCGTCACCGTGTCCAGCGCTAGCACGAAGGGCCCGTCCGTGTTCCCCCTG GCCCCCTGCTCCCGGAGCACCTCCGAGAGCACCGCCGCCCTGGGTTGCCTGG TGAAGGACTATTTCCCCGAGCCCGTCACCGTGAGCTGGAACAGCGGCGCCCT CACATCCGGCGTGCATACCTTCCCGGCCGTGCTCCAGAGCAGCGGCCTGTAT TCACTGTCGAGCGTGGTGACCGTGCCCAGCAGCAACTTTGGCACCCAGACGT ACACCTGCAACGTGGACCACAAGCCGAGCAACACCAAGGTGGACAAGACCGT GGAGCGGAAGTGCTGCGTGGAGTGTCCCCCGTGTCCCGCCCCGCCCGTAGCC GGCCCCTCCGTATTCCTCTTCCCTCCCAAGCCCAAGGACACGCTCATGATCT CGCGGACACCCGAGGTGACCTGCGTGGTGGTGGACGTCAGCCACGAGGATCC CGAGGTGCAGTTCAACTGGTATGTGGACGGAGTGGAGGTGCATAACGCCAAA ACCAAGCCCAGGGAAGAACAGTTCAACAGCACCTTCAGGGTGGTGAGCGTTC TGACCGTCGTGCACCAGGACTGGCTCAACGGCAAGGAGTACAAGTGTAAGGT GTCCAACAAGGGGCTGCCCGCCCCCATCGAGAAGACCATCTCGAAAACCAAA GGCCAGCCCCGCGAGCCCCAGGTGTACACCCTCCCCCCGTCCCGGGAGGAGA TGACCAAGAACCAGGTAAGCCTGACCTGTCTGGTGAAGGGCTTCTACCCCAG CGACATCGCTGTGGAGTGGGAGAGCAACGGGCAGCCCGAGAATAACTACAAA |

TABLE 3-continued

| Optimized Tremelimumab and Ipilimumab Sequences | | |
|---|---|---|
| SEQ ID NO | Description | Sequence |
| | | ACCACCCCGCCCATGCTGGACAGCGACGGAAGCTTTTTCTTGTACTCCAAGC<br>TGACCGTCGACAAGAGCCGGTGGCAGCAGGGCAACGTGTTCAGCTGCAGCGT<br>GATGCACGAGGCCCTGCACAACCACTACACCCAGAAAAGCCTCAGCCTGAGC<br>CCCGGGAAG |
| 365 | Treme_HC_IgG2-CO07 | ATGGAAACCCCGGCCCAACTCCTCTTCCTTCTTCTCCTCTGGCTCCCCGACA<br>CCACCGGCCAGGTCCAGCTCGTTGAGTCCGGCGGCGGCGTAGTCCAGCCCGG<br>GCGTTCGCTCAGGCTCAGCTGCGCCGCGTCCGGCTTCACCTTTAGCAGCTAC<br>GGCATGCACTGGGTACGGCAGGCCCCCGGCAAAGGGCTCGAGTGGGTCGCCG<br>TCATTTGGTACGACGGCAGCAATAAGTACTACGCAGACAGCGTCAAGGGAAG<br>GTTCACCATCAGCAGGGATAACTCCAAGAATACCCTCTACCTGCAAATGAAC<br>TCCCTGCGGGCCGAGGACACCGCCGTGTACTATTGCGCCCGGGACCCCAGGG<br>GGGCCACCCTGTACTACTACTACTACGGCATGGATGTGTGGGGCCAGGGCAC<br>CACCGTGACCGTCAGCTCAGCCAGCACCAAGGGCCCCAGCGTGTTCCCCCTC<br>GCCCCGTGTAGCCGGAGCACCTCCGAGAGCACCGCGGCCCTGGGGTGCCTGG<br>TGAAGGACTACTTCCCCGAACCCGTCACCGTGAGCTGGAACAGCGGGGCCCT<br>GACCAGCGGAGTGCACACCTTCCCGGCCGTGCTACAGAGCAGCGGCCTGTAC<br>TCCCTGTCATCCGTGGTGACCGTGCCCTCGTCCAACTTCGGCACCCAGACCT<br>ATACCTGCAACGTGGACCACAAACCCTCCAACACCAAGGTGGACAAGACCGT<br>GGAGAGGAAGTGCTGCGTGGAATGCCCTCCCTGCCCCGCGCCCCCAGTGGCC<br>GGGCCCTCCGTCTTCCTGTTCCCCCCGAAGCCGAAAGATACGCTGATGATCA<br>GCAGGACCCCCGAGGTGACCTGTGTGGTGGTGGACGTGAGCCACGAAGATCC<br>CGAGGTGCAGTTTAACTGGTACGTCGACGGGGTGGAAGTCCACAACGCCAAG<br>ACCAAGCCCAGAGAGGAACAGTTCAACAGCACGTTCCGGGTGGTGTCGGTGC<br>TCACCGTGGTCCACCAGGATTGGCTGAACGGAAAGGAGTATAAGTGCAAGGT<br>GAGCAACAAGGGGCTCCCGGCCCCGATCGAGAAGACCATCTCCAAAACCAAA<br>GGGCAGCCCCGGGAACCCCAGGTATACACCCTGCCACCAAGCAGGGAGGAGA<br>TGACCAAGAACCAGGTGAGCCTGACCTGTCTGGTGAAGGGCTTCTACCCCAG<br>CGACATCGCAGTGGAGTGGGAGAGCAACGGCCAGCCCGAGAACAACTACAAG<br>ACAACACCGCCCATGCTGGACAGCGACGGCTCCTTTTTTCTGTACTCCAAGC<br>TGACGGTGGACAAGAGCCGCTGGCAGCAGGGCAACGTGTTCAGCTGCAGCGT<br>GATGCATGAGGCCCTGCACAACCACTACACCCAGAAGTCCCTGTCCCTCAGC<br>CCGGGCAAG |
| 366 | Treme_HC_IgG2-CO08 | ATGGAGACGCCCGCCCAGCTCCTCTTCCTCCTTTTGCTGTGGCTCCCCGACA<br>CCACGGGCCAGGTCCAGCTCGTAGAGTCCGGCGGCGGCGTCGTACAGCCCGG<br>CCGGAGCCTCAGGTTGTCGTGCGCCGCCTCCGGTTTCACCTTCTCCAGCTAC<br>GGGATGCATTGGGTTCGGCAGGCCCCCGGGAAGGGCCTAGAGTGGGTCGCCG<br>TCATCTGGTACGACGGCTCCAATAAATACTACGCCGACAGCGTCAAGGGGCG<br>ATTCACTATCAGCAGGGACAACAGCAAGAACACCCTCTACCTGCAGATGAAC<br>AGCCTGCGCGCGGAGGACACCGCGGTGTACTATTGCGCCAGGGACCCGCGAG<br>GCGCCACCCTGTACTACTACTACTACGGCATGGACGTGTGGGGTCAGGGCAC<br>CACCGTGACCGTGAGCAGCGCCAGCACGAAGGGTCCCAGCGTGTTCCCCCTG<br>GCGCCCTGCTCCAGGAGCACGTCCGAGAGCACCGCCGCACTGGGCTGCCTGG<br>TGAAGGATTACTTCCCGGAGCCCGTGACCGTCAGCTGGAACTCCGGGGCCCT<br>CACGAGCGGCGTGCATACCTTCCCCGCCGTCCTGCAGAGCTCCGGCCTGTAC<br>AGCCTCTCCTCCGTGGTCACCGTCCCAAGCAGCAATTTCGGCACCCAGACCT<br>ACACCTGCAACGTGGATCATAAGCCCAGCAATACCAAGGTGGACAAGACCGT<br>GGAGCGCAAGTGCTGTGTCGAGTGCCCTCCCTGCCCGGCCCCACCCGTCGCC<br>GGCCCGAGCGTGTTCCTCTTCCCTCCCAAGCCCAAGGACACGCTGATGATCA<br>GCCGCACCCCCGAGGTGACCTGTGTCGTCGTGGATGTGAGCCACGAGGATCC<br>CGAGGTGCAGTTTAACTGGTACGTAGACGGCGTGGAGGTACACAACGCGAAG<br>ACCAAGCCTAGGGAGGAGCAGTTTAACTCCACCTTCCGGGTGGTGAGCGTCC<br>TGACGGTGGTGCATCAGGACTGGCTCAATGGTAAGGAGTACAAGTGCAAGGT<br>GAGCAACAAGGGCTTGCCCGCCCCTATCGAGAAGACAATCAGCAAGACCAAG<br>GGCCAGCCCCGGGAGCCGCAGGTGTACACCCTGCCCCCTTCGAGGGAGGAAA<br>TGACCAAGAACCAGGTGAGCCTGACCTGTCTGGTGAAGGGTTTTTACCCCAG<br>CGACATCGCGGTGGAGTGGGAGAGCAACGGGCAGCCCGAGAACAACTATAAG<br>ACCACCCCACCCATGCTGGACAGCGACGGGAGCTTCTTCCTGTACAGCAAGC<br>TGACCGTCGACAAGTCCCGATGGCAGCAGGGCAACGTGTTCAGCTGCAGCGT<br>GATGCACGAGGCGCTGCACAATCATTACACCCAGAAAAGCCTGAGCCTGAGC<br>CCCGGCAAA |
| 367 | Treme_HC_IgG2-CO09 | ATGGAGACGCCCGCCCAGCTCCTCTTCCTCCTCCTCCTCTGGCTACCGGACA<br>CCACCGGGCAGGTCCAGCTAGTCGAGTCGGGCGGCGGGGTCGTTCAGCCCGG<br>CCGTAGCCTCCGGCTCAGCTGCGCCGCCTCCGGCTTCACCTTCAGTAGCTAC<br>GGTATGCATTGGGTCCGCCAAGCCCCCGGCAAGGGCCTCGAGTGGGTCGCCG<br>TCATCTGGTACGACGGCTCCAATAAGTACTACGCGGATAGCGTCAAAGGGCG<br>GTTCACCATCAGCCGCGACAACAGCAAAAACACCCTCTACCTGCAGATGAAC<br>AGCCTGAGGGCGGAGGACACCGCCGTGTACTACTGCGCCAGGGACCCTCGTG<br>GGGCCACGCTGTATTACTACTACTATGGCATGGATGTGTGGGGGCAGGGCAC<br>CACCGTGACCGTCAGCTCCGCCAGCACCAAGGGGCCCAGCGTCTTCCCGCTG<br>GCTCCGTGCTCCCGGTCCACCTCCGAGAGCACCGCAGCCCTGGGCTGCCTGG<br>TGAAAGACTACTTTCCCGAACCCGTGACCGTCAGCTGGAACAGCGGCGCCCT<br>GACGAGCGGGGTGCACACCTTCCCCGCAGTGCTGCAGAGCAGCGGCCTGTAC |

TABLE 3-continued

| Optimized Tremelimumab and Ipilimumab Sequences | | |
|---|---|---|
| SEQ ID NO | Description | Sequence |
| | | TCGCTCTCCTCCGTGGTCACGGTGCCCAGTTCCAACTTCGGAACCCAGACAT ATACGTGCAACGTGGACCACAAGCCCAGCAACACCAAGGTGGACAAAACCGT GGAGCGGAAATGCTGCGTGGAGTGCCCGCCCTGTCCCGCCCCTCCCGTCGCC GGACCCAGCGTGTTTCTGTTCCCGCCCAAGCCCAAGGACACCCTTATGATCT CGCGCACCCCTGAGGTAACCTGCGTCGTGGTAGACGTGTCCCACGAGGACCC CGAGGTGCAGTTCAACTGGTACGTGGATGGCGTGGAGGTCCACAACGCCAAA ACCAAGCCGCGGGAGGAACAATTCAACAGCACCTTCAGGGTGGTGTCCGTGC TGACCGTGGTGCACCAGGACTGGCTGAACGGAAAGGAGTACAAGTGCAAGGT GTCCAACAAGGGCCTGCCCGCGCCCATCGAGAAGACGATCAGCAAAACCAAG GGCCAGCCTAGGGAACCCCAGGTCTACACCCTGCCCCCCAGCAGGGAGGAGA TGACCAAGAACCAGGTAAGCCTGACCTGCCTGGTGAAGGGTTTCTATCCGTC CGACATCGCAGTGGAGTGGGAAAGCAACGGCCAGCCCGAGAACAACTATAAG ACCACCCCACCCATGCTGGACAGCGACGGCAGCTTCTTCCTGTACAGCAAGC TGACTGTCGACAAAAGCAGGTGGCAGCAGGGCAACGTGTTTAGCTGCAGCGT CATGCACGAGGCCCTGCATAACCACTACACCCAGAAGTCCCTGAGCCTCTCC CCCGGCAAG |
| 368 | Treme_HC_IgG2-CO10 | ATGGAGACTCCCGCCCAACTCCTCTTTCTACTCCTCCTATGGCTCCCCGACA CCACCGGGCAGGTCCAGCTCGTAGAGTCCGGGGGCGGCGTCGTTCAACCCGG GAGGAGCCTCAGGCTCAGCTGCGCCGCCAGCGGGTTCACCTTCAGCTCCTAC GGCATGCACTGGGTCCGGCAGGCCCCCGGCAAGGGCCTAGAGTGGGTCGCCG TCATCTGGTACGACGGCTCCAACAAGTACTACGCCGACAGCGTCAAGGGCAG GTTCACGATCAGCAGGGACAACAGCAAGAACACCTTGTACCTCCAGATGAAT TCCCTGCGGGCCGAGGACACAGCCGTGTACTACTGCGCCCGCGACCCCAGGG GTGCCACGCTGTACTATTACTACTACGGCATGGACGTGTGGGGGCAGGGCAC CACAGTGACCGTCAGCTCAGCCAGCACCAAGGGCCCCTCGGTGTTTCCCCTG GCCCCATGCAGCAGGAGCACGAGCGAGTCCACCGCCGCGCTCGGCTGCCTAG TGAAGGACTACTTCCCCGAGCCCGTGACGGTGAGCTGGAATAGCGGTGCCCT GACCAGCGGCGTGCACACCTTCCCCGCCGTGCTGCAAAGCAGCGGGCTGTAC TCCCTGAGCTCCGTGGTCACGGTGCCCAGCTCCAACTTTGGCACTCAGACCT ACACCTGCAACGTGGACCACAAGCCCAGCAATACGAAGGTGGACAAGACCGT GGAGCGGAAGTGTTGCGTGGAGTGCCCGCCCTGTCCCGCCCCACCTGTGGCC GGTCCCAGCGTGTTCCTGTTTCCCCCCAAGCCCAAGGACACCCTCATGATAA GCAGGACACCCGAGGTGACCTGCGTCGTGGTCGACGTGTCCCACGAGGACCC CGAGGTGCAGTTCAATTGGTACGTGGACGGCGTGGAGGTGCACAACGCCAAG ACCAAGCCGAGGGAGGAGCAGTTCAACTCAACCTTCCGGGTCGTCAGCGTCC TGACTGTGGTGCACCAGGACTGGCTGAATGGCAAAGAGTACAAGTGCAAGGT GAGCAACAAGGGCCTCCCCGCCCCCATCGAGAAGACCATCTCGAAGACGAAG GGCCAGCCCCGGGAGCCCCAGGTGTACACCCTGCCCCCTAGCAGGGAGGAGA TGACCAAGAACCAGGTGTCCCTGACCTGCCTGGTGAAGGGCTTCTACCCCTC CGACATCGCGGTGGAGTGGGAGAGCAACGGCCAGCCCGAGAACAACTACAAG ACGACGCCCCCCATGCTGGACAGCGACGGGAGCTTCTTCCTGTACAGCAAGC TGACCGTGGACAAATCTCGCTGGCAGCAGGGCAACGTATTCAGCTGCTCGGT GATGCACGAGGCGCTGCACAACCACTACACGCAGAAGTCCCTGAGCCTGAGC CCCGGGAAA |
| 369 | Treme_HC_IgG2-CO11 | ATGGAGACGCCCGCACAGCTCCTCTTCCTCCTCCTACTCTGGCTCCCGGACA CAACCGGGCAGGTACAGCTCGTAGAGTCCGGCGGCGGCGTCGTCCAGCCGGG GAGGAGCCTCAGGCTCAGCTGCGCCGCCAGCGGCTTTACCTTCTCCAGCTAC GGCATGCACTGGGTAAGGCAGGCGCCCGGAAAGGGCCTCGAGTGGGTCGCGG TCATCTGGTACGACGGCAGCAATAAGTACTACGCCGACAGCGTTAAGGGTCG GTTCACCATCAGCAGGGACAATTCCAAGAATACGCTCTACCTGCAGATGAAC AGCCTGCGGGCCGAGGACACCGCCGTCTACTACTGCGCGCGAGATCCCCGGG GGGCCACCCTGTACTACTACTATTACGGAATGGACGTGTGGGGCCAGGGTAC CACCGTGACGGTGTCAAGCGCCAGCACCAAAGGCCCCAGCGTGTTCCCGCTG GCCCCCTGCTCCCGGAGCACCAGCGAGAGCACCGCCGCCCTCGGCTGCCTGG TGAAGGACTACTTCCCCGAACCCGTGACCGTGAGCTGGAACAGCGGCGCCCT GACAAGCGGCGTCCACACCTTCCCCGCCGTGTTGCAGAGCAGCGGTCTGTAC TCCCTGAGCAGCGTGGTCACCGTGCCCAGTAGCAATTTCGGCACCCAGACCT ACACCTGCAACGTGGACCATAAGCCCAGCAACACCAAGGTGGACAAGACCGT GGAGAGGAAATGCTGCGTGGAGTGCCCGCCCTGCCCCGCCCCGCCCGTGGCG GGCCCCAGCGTGTTCCTGTTTCCACCCAAGCCCAAGGACACACTGATGATAA GCAGGACCCCCGAGGTAACCTGCGTGGTGGTGGACGTGAGCCATGAGGACCC CGAAGTGCAGTTTAACTGGTACGTGGATGGCGTGGAGGTCCACAACGCCAAG ACCAAGCCGCGTGAAGAACAGTTTAACTCCACCTTCCGGGTGGTGTCCGTGC TCACCGTCGTCCACCAGGACTGGCTGAACGGGAAGGAATACAAATGCAAGGT CAGCAACAAGGGCCTTCCCGCCCCCATCGAGAAAACCATCTCCAAGACGAAG GGGCAGCCCCGGGAGCCCCAGGTCTACACCCTCCCACCCTCCAGGGAGGAGA TGACCAAGAACCAAGTCTCCCTCACTTGCTTAGTGAAGGGCTTTTACCCCAG CGACATCGCCGTGGAGTGGGAGTCCAACGGCCAGCCCGAGAACAACTACAAA ACGACCCCACCCATGCTGGACAGCGACGGCAGCTTCTTCCTTTACTCCAAGC TGACGGTGGATAAGAGCAGGTGGCAGCAGGGCAACGTGTTCTCGTGCTCCGT GATGCACGAGGCCCTGCACAACCACTACACCCAGAAAAGCCTTTCCCTGAGC CCCGGCAAG |

TABLE 3-continued

Optimized Tremelimumab and Ipilimumab Sequences

| SEQ ID NO | Description | Sequence |
|---|---|---|
| 370 | Treme_HC_IgG2-CO12 | ATGGAGACGCCGGCCCAACTCCTCTTCCTCCTCCTCCTCTGGCTCCCGGACA<br>CCACCGGGCAGGTCCAGCTCGTCGAGAGCGGCGGCGGCGTCGTACAGCCCGG<br>GAGGTCCCTACGCCTCAGCTGCGCAGCCAGCGGCTTTACCTTCAGCAGCTAC<br>GGCATGCACTGGGTCAGGCAGGCCCCCGGCAAGGGGCTCGAGTGGGTCGCCG<br>TTATCTGGTACGACGGGTCCAATAAGTACTACGCCGACAGCGTAAAGGGCCG<br>CTTCACCATCAGCAGGGACAACTCGAAGAACACCCTCTACCTGCAGATGAAC<br>TCACTGCGGGCCGAGGACACCGCCGTGTACTACTGCGCCAGGGACCCCCGGG<br>GCGCCACCCTGTACTACTACTATTACGGGATGGATGTGTGGGGCCAGGGCAC<br>CACCGTGACCGTGAGCAGCGCCTCCACCAAGGGCCCGTCCGTCTTCCCCCTG<br>GCCCCCTGCTCCAGGAGCACGAGCGAGAGCACGGCGGCCCTGGGCTGCCTCG<br>TGAAGGACTACTTCCCCGAACCCGTGACCGTCAGCTGGAACTCCGGCGCCCT<br>CACCTCCGGGGTCCATACCTTCCCCGCCGTGTTACAGAGCAGCGGCCTGTAT<br>AGCCTGAGCAGCGTGGTGACCGTGCCGAGCAGCAACTTCGGCACCCAGACCT<br>ATACCTGTAACGTGGACCACAAGCCCAGCAACACCAAGGTGGACAAGACCGT<br>GGAGAGGAAGTGCTGCGTAGAGTGCCCGCCCTGTCCGGCCCCGCCCGTGGCG<br>GGCCCCAGCGTGTTTCTGTTCCCTCCCAAACCGAAGGACACCCTGATGATCA<br>GCAGGACCCCCGAGGTGACCTGCGTGGTCGTGGATGTGTCCCATGAAGACCC<br>CGAGGTGCAGTTCAACTGGTACGTGGACGGTGTGGAGGTGCATAATGCCAAG<br>ACGAAGCCACGTGAGGAGCAGTTCAATTCCACTTTCCGCGTGGTGTCCGTGC<br>TGACCGTGGTGCATCAGGACTGGCTCAACGGCAAGGAGTATAAGTGCAAGGT<br>GTCTAACAAGGGCCTGCCCGCCCCCATCGAGAAGACTATCTCCAAGACTAAG<br>GGGCAGCCGAGGGAGCCCCAGGTGTATACCCTGCCCCCCAGCAGGGAGGAGA<br>TGACCAAGAACCAGGTCAGCCTGACCTGCCTGGTGAAGGGCTTCTACCCCTC<br>CGACATCGCCGTGGAGTGGGAGAGCAACGGGCAGCCCGAGAACAACTACAAG<br>ACCACCCCGCCCATGCTGGACTCCGACGGGAGCTTTTTTCTGTATTCCAAGC<br>TGACCGTGGACAAGTCCAGGTGGCAGCAGGGGAACGTGTTCTCCTGCTCCGT<br>GATGCACGAAGCCCTGCACAACCACTATACCCAGAAAAGCCTTAGCCTGAGC<br>CCCGGGAAG |
| 371 | Treme_HC_IgG2-CO13 | ATGGAAACCCCCGCCCAATTACTCTTCCTTCTCCTCCTCTGGCTCCCCGACA<br>CCACCGGCCAGGTCCAACTCGTCGAGTCCGGAGGCGGCGTCGTCCAGCCCGG<br>CAGGAGCCTACGGCTCAGCTGCGCCGCCAGCGGCTTCACCTTCTCCAGCTAC<br>GGCATGCACTGGGTTCGCCAGGCCCCAGGCAAGGGGCTCGAGTGGGTCGCCG<br>TCATCTGGTACGACGGCAGCAATAAGTACTACGCCGACTCCGTTAAGGGTAG<br>GTTCACCATCAGCAGGGACAACTCCAAGAACACCCTCTACCTGCAGATGAAC<br>AGCCTGCGTGCCGAGGATACGGCCGTCTACTACTGCGCCCGGGACCCCCGGG<br>GGGCCACCCTCTACTACTATTACTACGGTATGGACGTCTGGGGCCAGGGCAC<br>GACCGTGACCGTGTCCAGCGCCTCGACCAAGGGCCCCAGCGTCTTCCCCCTG<br>GCCCCCTGCAGCAGGAGCACCAGCGAGAGCACCGCCGCCCTGGGGTGCCTCG<br>TGAAGGATTATTTTCCGGAACCCGTGACCGTAAGCTGGAACAGCGGCGCCCT<br>GACCTCCGGCGTGCACACCTTCCCCGCCGTACTCCAGTCCAGCGGACTGTAC<br>AGCCTGAGCTCCGTGGTGACCGTGCCCTCCAGCAACTTCGGCACCCAGACCT<br>ACACCTGCAACGTGGACCACAAACCCAGCAATACCAAGGTGGATAAGACCGT<br>GGAGAGGAAATGCTGCGTGGAGTGTCCCCCTTGCCCCGCCCCGCCCGTGGCC<br>GGGCCGTCTGTGTTCCTGTTCCCACCCAAGCCTAAGGACACCCTCATGATCT<br>CCAGGACCCCCGAGGTGACCTGCGTGGTCGTGGACGTGAGCCACGAGGACCC<br>CGAGGTCCAGTTCAACTGGTATGTGGATGGCGTGGAGGTGCATAACGCCAAG<br>ACCAAGCCCCGTGAGGAGCAGTTCAACAGCACCTTCCGCGTCGTGTCCGTGC<br>TGACCGTGGTCCACCAGGATTGGCTGAACGGGAAAGAGTACAAGTGCAAGGT<br>GTCCAACAAGGGCTTGCCCGCCCCCATCGAAAAGACCATCTCGAAGACCAAG<br>GGCCAGCCCAGGGAGCCCCAGGTTTACACCCTCCCGCCCTCCAGGGAGGAGA<br>TGACCAAGAACCAGGTGAGCCTCACCTGTCTGGTGAAAGGCTTTTATCCCAG<br>CGACATCGCCGTGGAGTGGGAGAGCAACGGCCAGCCCGAGAACAACTACAAG<br>ACCACCCCACCCATGCTGGACAGCGACGGCAGCTTCTTCCTTTACAGCAAGC<br>TGACCGTAGACAAGAGCAGGTGGCAGCAGGGCAATGTGTTCAGCTGCAGCGT<br>GATGCATGAAGCCCTGCATAACCACTACACCCAAAAGTCCCTGAGCCTGAGC<br>CCGGGGAAG |
| 372 | Treme_HC_IgG2-CO14 | ATGGAGACTCCCGCCCAGCTCCTATTCCTCCTCCTCCTCTGGCTCCCGGACA<br>CCACCGGCCAGGTACAGCTTGTGGAGTCCGGCGGCGGAGTTGTCCAGCCCGG<br>GAGGTCCCTCAGGCTCAGCTGCGCCGCCAGCGGGTTCACCTTCAGCAGCTAC<br>GGCATGCACTGGGTCAGGCAGGCCCCCGGGAAAGGACTCGAGTGGGTCGCAG<br>TTATCTGGTACGACGGGAGCAACAAGTACTACGCCGACAGCGTCAAGGGCAG<br>GTTCACCATCTCCAGGGATAATAGCAAGAACACCCTTTACCTGCAGATGAAC<br>AGCCTGCGGGCCGAGGACACAGCCGTGTACTACTGCGCCCGTGACCCCCGCG<br>GCGCCACCCTCTACTACTACTACTACGGCATGGACGTGTGGGGCCAGGGCAC<br>GACCGTGACCGTCAGCTCCGCCAGCACCAAGGGCCCCTCGGTGTTCCCCCTG<br>GCCCCGTGCAGCAGGAGCACCAGCGAGAGCACCGCGGCCCTGGGCTGTCTGG<br>TGAAGGACTACTTTCCCGAGCCCGTGACTGTCTCGTGGAACAGCGGGGCCCT<br>GACGAGCGGCGTGCACACGTTCCCCGCCGTGCTGCAGAGCAGCGGGCTGTAC<br>AGCCTCAGCAGCGTGGTAACCGTGCCCAGCTCCAACTTCGGCACCCAGACCT<br>ACACCTGTAACGTGGACCACAAGCCGAGCAACACCAAGGTGGACAAGACCGT<br>GGAGCGGAAGTGCTGCGTGGAGTGTCCCCCGTGCCCCGCCCCTCCGGTCGCC<br>GGCCCCAGCGTGTTCCTGTTCCCGCCCAAGCCGAAGGACACCCTGATGATCA<br>GCAGGACCCCTGAGGTCACCTGCGTGGTGGTGGACGTCAGCCATGAGGATCC |

TABLE 3-continued

Optimized Tremelimumab and Ipilimumab Sequences

| SEQ ID NO | Description | Sequence |
|---|---|---|
| | | CGAGGTGCAGTTCAACTGGTACGTGGATGGCGTGGAAGTGCATAACGCCAAG<br>ACAAAGCCCAGGGAGGAGCAGTTCAACAGCACCTTCAGGGTGGTGAGCGTCC<br>TGACCGTGGTGCACCAAGATTGGCTGAACGGGAAGGAGTACAAGTGTAAAGT<br>GAGCAACAAAGGGCTGCCCGCCCCCATCGAGAAAACCATCTCCAAGACCAAG<br>GGCCAGCCCAGGGAGCCCCAGGTGTACACCCTGCCCCCCTCACGCGAGGAGA<br>TGACCAAGAACCAGGTGAGCCTGACCTGCCTCGTGAAAGGCTTCTATCCCAG<br>CGACATCGCGGTCGAATGGGAGAGCAACGGCCAGCCCGAGAACAACTACAAG<br>ACGACCCCGCCCATGCTGGACAGCGATGGCAGCTTTTTCCTGTACAGCAAGC<br>TGACCGTCGACAAGTCCAGGTGGCAGCAGGGCAACGTGTTCTCCTGTAGCGT<br>GATGCACGAGGCCCTCCACAACCACTACACCCAGAAATCCCTGAGCCTGAGC<br>CCCGGCAAG |
| 373 | Treme_HC_IgG2-CO15 | ATGGAGACACCGGCCCAGCTCCTCTTCCTCCTCCTCCTTTGGCTCCCCGACA<br>CGACCGGGCAGGTCCAATTGGTGGAGTCCGGCGGCGTCGTTCAGCCCGG<br>CAGGAGCCTTCGGCTCAGCTGCGCCGCCAGCGGTTTTACCTTCAGCTCCTAC<br>GGCATGCACTGGGTCAGGCAGGCCCCCGGTAAGGGCCTCGAGTGGGTCGCCG<br>TCATCTGGTACGACGGGAGCAACAAATACTACGCCGACAGCGTAAAGGGCAG<br>GTTCACCATCTCGAGGGACAACAGCAAGAACACCCTCTACCTGCAGATGAAC<br>AGCCTGAGGGCGGAGGACACCGCAGTGTACTACTGCGCCCGGGACCCTAGGG<br>GCGCCACCCTCTACTATTACTACTACGGCATGGACGTGTGGGGCCAAGGAAC<br>TACCGTGACCGTGTCGTCCGCCAGCACCAAGGGCCCCAGCGTCTTCCCCCTG<br>GCCCCCTGCTCCCGTAGCACATCCGAGAGCACCGCCGCCTTGGGTTGCCTGG<br>TGAAGGATTACTTCCCGGAGCCGGTGACCGTGTCCTGGAACAGCGGGGCGCT<br>GACCTCCGGAGTGCACACCTTCCCCGCCGTGCTGCAGTCTAGCGGTCTGTAT<br>AGCCTGTCCTCCGTGGTGACCGTCCCCTCCAGCAACTTCGGTACACAAACCT<br>ACACCTGCAACGTCGACCACAAGCCCTCTAACACCAAGGTGGACAAAACCGT<br>GGAAAGGAAGTGCTGCGTCGAGTGCCCACCCTGCCCTGCCCCGCCCGTGGCC<br>GGGCCCAGCGTGTTCCTTTTCCCACCCAAACCCAAGGACACCCTGATGATCA<br>GCCGGACCCCCGAGGTGACCTGCGTGGTGGTGGATGTGAGCCACGAGGATCC<br>CGAAGTGCAGTTCAACTGGTACGTGGACGGCGTGGAGGTGCATAACGCGAAG<br>ACCAAGCCCCGGGAGGAGCAGTTCAACTCCACGTTCAGGGTCGTGTCGGTCC<br>TCACCGTCGTGCACCAGGACTGGCTGAACGGAAAGGAGTACAAGTGCAAGGT<br>GAGCAACAAAGGCCTGCCCGCCCCCATCGAGAAGACCATCTCCAAGACCAAG<br>GGGCAGCCCAGGGAGCCCCAGGTCTACACCCTGCCGCCCAGCCGGGAGGAGA<br>TGACCAAAAACCAGGTCAGCCTGACCTGCCTGGTCAAGGGCTTCTACCCCAG<br>CGACATCGCCGTGGAGTGGGAGAGCAACGGCCAGCCCGAGAACAACTACAAA<br>ACTACCCCGCCAATGCTGGACAGCGACGGCTCCTTCTTTCTGTACAGCAAGC<br>TGACCGTCGACAAGTCCAGGTGGCAACAGGGCAACGTGTTTAGCTGCAGTGT<br>GATGCACGAGGCCCTGCACAACCACTACACGCAGAAAAGCCTCAGCCTCAGC<br>CCAGGCAAG |
| 374 | Treme_HC_IgG2-CO16 | ATGGAGACTCCCGCCCAGCTCCTCTTCCTCCTCCTCCTCTGGCTCCCGGATA<br>CCACCGGGCAGGTCCAATTGGTCGAAAGCGGCGGCGGGGTCGTCCAGCCGGG<br>GCGCAGCCTCAGGCTCAGCTGCGCGGCCTCCGGCTTCACCTTCAGCAGCTAC<br>GGAATGCACTGGGTCCGGCAGGCCCCGGGGAAGGGCCTCGAGTGGGTCGCCG<br>TCATCTGGTACGACGGCAGCAATAAGTACTACGCCGACAGCGTCAAGGGTAG<br>GTTCACCATCAGCCGGGACAACTCAAAGAACACCCTCTATCTGCAGATGAAC<br>AGCCTGAGGGCCGAAGATACCGCCGTATACTATTGCGCCCGCGACCCCAGGG<br>GCGCCACCCTCTACTATTATTACTATGGGATGGACGTGTGGGGCCAGGGGAC<br>CACCGTGACCGTGAGCTCCGCCAGCACCAAGGGCCCGTCGGTGTTCCCGCTG<br>GCCCCCTGCTCCCGGAGCACAAGCGAGAGCACCGCCGCCCTGGGGTGTCTGG<br>TCAAGGACTACTTCCCCGAGCCCGTGACGGTGAGCTGGAACAGCGGCGCCCT<br>GACCTCCGGGGTGCACACGTTCCCCGCCGTGCTCCAGAGCAGCGGGCTGTAC<br>AGCCTGAGCTCCGTGGTGACCGTGCCCTCCAGCAACTTCGGCACCCAGACGT<br>ACACCTGCAACGTGGACCACAAGCCTAGCAATACCAAGGTGGACAAGACGGT<br>GGAGAGGAAGTGCTGCGTGGAGTGCCCGCCCTGCCCCGCCCCGCCCGTCGCA<br>GGCCCCTCCGTGTTCCTGTTCCCGCCCAAACCCAAGGACACGCTGATGATCA<br>GCCGGACCCCCGAGGTGACCTGCGTGGTGGTCGATGTGAGCCACGAGGATCC<br>CGAGGTGCAGTTCAATTGGTACGTCGACGGCGTCGAAGTGCACAACGCCAAG<br>ACCAAGCCCCGGGAGGAGCAATTCAACAGCACCTTCCGTGTCGTGTCGGTGC<br>TTACCGTGGTGCACCAGGACTGGCTGAACGGCAAAGAGTATAAGTGCAAGGT<br>CAGCAACAAAGGCCTGCCCGCCCCCATCGAGAAGACCATCAGCAAGACCAAA<br>GGGCAGCCGAGGGAGCCCCAGGTGTATACCCTGCCGCCCTCCAGGGAGGAGA<br>TGACAAAGAACCAGGTGTCCCTCACCTGCCTGGTGAAAGGTTTCTACCCCTC<br>GGACATAGCCGTGGAGTGGGAGTCCAACGGCCAGCCCGAGAACAACTACAAA<br>ACCACGCCCCCCATGCTGGATAGCGACGGCAGCTTCTTTCTGTACAGCAAGC<br>TGACGGTGGACAAGAGCCGCTGGCAGCAGGGCAACGTCTTCTCCTGCAGCGT<br>GATGCACGAGGCCCTGCACAACCACTACACCCAGAAGTCCCTGAGCCTGAGC<br>CCAGGGAAG |
| 375 | Treme_HC_IgG2-CO17 | ATGGAGACTCCCGCCCAGCTCCTCTTTCTCCTCCTCCTCTGGCTTCCCGACA<br>CCACCGGGCAGGTCCAGCTCGTCGAGAGCGGCGGCGGCGTCGTACAGCCCGG<br>CAGGAGCCTCAGGCTCAGCTGCGCCGCCAGCGGCTTCACCTTTTCCTCCTAC<br>GGAATGCACTGGGTCCGGCAGGCCCCCGGCAAGGGGCTCGAGTGGGTAGCCG<br>TCATCTGGTACGACGGTTCCAACAAGTACTACGCCGACAGCGTCAAAGGCAG |

TABLE 3-continued

Optimized Tremelimumab and Ipilimumab Sequences

| SEQ ID NO | Description | Sequence |
|---|---|---|
| | | GTTCACGATCTCCAGGGATAACAGTAAGAACACTCTCTACCTGCAGATGAAC<br>TCGCTGAGGGCCGAGGACACCGCCGTCTACTACTGCGCCAGGGACCCCAGGG<br>GGGCCACCCTTTACTATTACTATTACGGGATGGACGTGTGGGGGCAGGGGAC<br>CACCGTGACCGTGTCATCCGCCTCGACCAAGGGGCCCAGCGTCTTCCCGCTC<br>GCGCCCTGCAGCAGGTCAACCTCCGAGTCGACCGCAGCCCTGGGCTGCCTGG<br>TGAAGGATTACTTCCCCGAGCCCGTGACCGTGAGCTGGAACAGCGGCGCGCT<br>GACGAGCGGGGTCCACACCTTCCCCGCTGTGCTGCAGAGCAGCGGGCTGTAC<br>TCGCTGAGCAGCGTCGTCACCGTGCCCAGCAGCAACTTTGGGACACAGACCT<br>ACACCTGCAACGTGGACCATAAGCCTAGCAACACCAAGGTGGACAAGACCGT<br>GGAACGTAAGTGTTGTGTGGAATGTCCCCCCTGCCCCGCCCCACCCGTGGCC<br>GGCCCCAGCGTGTTTCTGTTCCCACCCAAACCCAAGGACACCCTGATGATCA<br>GCAGGACCCCCGAGGTGACATGCGTGGTGGTGGACGTGAGCCACGAGGATCC<br>CGAGGTGCAGTTTAACTGGTATGTGGACGGGGTGGAGGTGCACAATGCCAAG<br>ACCAAGCCCCGGGAGGAGCAGTTCAACTCGACCTTCCGCGTGGTGAGCGTCC<br>TCACCGTGGTCCACCAGGACTGGCTGAATGGCAAAGAGTATAAATGCAAGGT<br>GAGCAACAAGGGCCTGCCCGCCCCCATCGAGAAGACCATCTCCAAAACCAAA<br>GGGCAGCCCAGGGAGCCCCAGGTCTACACCCTGCCCCCCAGCAGGGAAGAGA<br>TGACCAAGAACCAGGTCAGCCTGACCTGCCTCGTGAAAGGCTTCTACCCCTC<br>CGATATAGCCGTGGAGTGGGAGAGTAACGGCCAGCCAGAGAACAATTACAAG<br>ACGACCCCACCCATGCTGGATTCCGACGGGAGCTTCTTCCTCTACAGCAAAC<br>TGACCGTGGATAAGAGCAGGTGGCAGCAGGGGAACGTGTTCAGCTGCAGCGT<br>GATGCACGAGGCACTGCACAACCACTACACCCAGAAAAGCCTGTCCCTGAGC<br>CCCGGGAAG |
| 376 | Treme_HC_IgG2-CO18 | ATGGAAACCCCCGCCCAGCTTCTCTTCCTTCTCCTCCTATGGCTCCCCGATA<br>CTACCGGCCAAGTCCAGCTCGTCGAGAGCGGAGGGGGCGTCGTTCAGCCCGG<br>CCGGAGCCTCAGGCTCAGCTGCGCCGCCAGCGGGTTCACCTTCAGCAGCTAC<br>GGCATGCATTGGGTCCGGCAGGCCCCCGGCAAAGGCCTCGAGTGGGTCGCCG<br>TTATCTGGTACGACGGGAGCAACAAGTACTACGCCGATAGCGTCAAGGGCAG<br>GTTCACCATCTCCAGGGACAATTCCAAAAATACACTCTACCTGCAGATGAAT<br>AGCCTGCGGGCAGAGGACACCGCCGTGTACTACTGCGCCAGGGATCCCCGGG<br>GCGCAACCCTGTATTACTACTACTACGGGATGGACGTCTGGGGGCAGGGTAC<br>CACCGTGACCGTGTCCAGCGCCAGCACCAAGGGCCCCTCCGTGTTCCCCCTC<br>GCCCCCTGCAGCAGGTCCACCAGCGAGAGCACCGCCGCCCTGGGCTGCCTCG<br>TGAAAGACTACTTCCCCGAGCCCGTGACGGTGTCCTGGAATAGCGGAGCCCT<br>GACCAGCGGCGTGCACACCTTCCCCGCCGTGCTGCAATCCAGCGGCCTGTAT<br>TCGCTGAGCAGCGTGGTGACCGTCCCTTCCTCGAATTTCGGCACGCAGACCT<br>ACACGTGCAACGTGGACCACAAGCCAAGCAATACCAAGGTGGACAAGACTGT<br>GGAACGCAAATGCTGCGTGGAGTGCCCGCCCTGCCCCGCCCCACCGGTGGCC<br>GGGCCCAGCGTCTTCCTGTTCCCGCCCAAGCCGAAAGACACACTGATGATCA<br>GCCGGACCCCCGAGGTGACCTGCGTGGTGGTCGACGTGAGCCATGAGGACCC<br>GGAGGTGCAGTTCAACTGGTACGTGGACGGGGTGGAGGTCCACAACGCCAAG<br>ACCAAGCCCAGGGAGGAGCAATTCAACAGCACCTTCCGAGTGGTCAGCGTGC<br>TGACCGTGGTGCACCAGGACTGGCTGAACGGTAAAGAATACAAGTGCAAGGT<br>GTCCAATAAGGGGCTCCCCGCGCCCATCGAAAAAACCATCTCCAAAACGAAG<br>GGCCAGCCAAGGGAGCCCCAGGTGTACACCCTGCCCCCCAGCCGCGAGGAAA<br>TGACCAAGAACCAGGTGAGCCTGACCTGTCTCGTGAAGGGGTTCTACCCCAG<br>CGACATCGCCGTGGAGTGGGAGTCCAACGGGCAGCCGGAAAACAACTACAAA<br>ACCACGCCGCCCATGCTTGACTCAGATGGGTCCTTCTTCCTGTACAGCAAGC<br>TGACCGTGGACAAAAGCCGGTGGCAGCAGGGCAATGTCTTTTCCTGCTCAGT<br>GATGCACGAGGCCCTGCACAACCACTACACCCAGAAATCACTGAGCCTGAGC<br>CCGGGCAAA |
| 377 | Treme_HC_IgG2-CO19 | ATGGAGACGCCCGCCCAGCTCCTCTTCCTCCTCCTCCTTTGGCTCCCGGACA<br>CCACCGGCCAGGTCCAGCTCGTAGAGAGCGGCGGCGGCGTAGTACAGCCCGG<br>GAGGAGCCTCAGGCTCAGCTGTGCGGCGAGCGGCTTTACCTTCAGCAGCTAC<br>GGCATGCACTGGGTCCGCCAGGCGCCGGGCAAGGGACTCGAGTGGGTAGCCG<br>TCATCTGGTACGACGGAAGCAACAAGTATTACGCCGACAGCGTCAAGGGCCG<br>GTTTACCATCAGCAGGGACAACTCCAAGAACACGCTCTACCTGCAGATGAAT<br>AGCCTCCGGGCCGAGGACACGGCCGTTTACTACTGCGCCAGGGACCCCAGGG<br>GCGCCACCCTGTACTACTACTACTACGGCATGGACGTCTGGGGGCAGGGGAC<br>CACCGTGACCGTGAGCAGCGCCTCCACCAAGGGCCCCAGCGTGTTCCCCCTC<br>GCCCCGTGCAGCCGTAGCACGAGCGAGAGCACCGCAGCCCTGGGCTGCCTGG<br>TGAAAGACTACTTCCCCGAGCCCGTCACCGTCTCCTGGAACAGCGGCGCGCT<br>CACGTCCGGGGTGCACACCTTCCCCGCCGTCCTGCAATCCTCAGGGCTCTAT<br>TCCCTGAGCAGCGTAGTGACCGTGCCCAGCTCCAACTTCGGCACCCAGACCT<br>ACACATGCAATGTGGATCACAAGCCCTCAAACACCAAAGTGGACAAGACCGT<br>GGAGCGGAAGTGCTGCGTGGAGTGCCCTCCCTGCCCCGCCCCACCCGTGGCC<br>GGCCCCAGCGTGTTCCTGTTTCCCCCCAAGCCCAAGGACACCCTGATGATCA<br>GCAGGACCCCCGAGGTGACCTGCGTCGTGGTGGACGTGAGCCACGAGGATCC<br>CGAGGTGCAGTTCAATTGGTATGTCGACGGGGTGGAGGTGCACAACGCGAAG<br>ACGAAGCCCAGGGAGGAGCAGTTCAACAGCACCTTCAGGGTCGTCTCCGTGC<br>TGACCGTGGTGCACCAGGACTGGCTGAACGGCAAGGAGTACAAGTGTAAAGT<br>GAGCAATAAGGGCCTCCCGGCCCCGATCGAGAAGACCATCAGCAAGACCAAG<br>GGCCAGCCGAGGGAGCCGCAGGTGTACACCCTCCCTCCCAGCCGAGAGGAGA |

TABLE 3-continued

Optimized Tremelimumab and Ipilimumab Sequences

| SEQ ID NO | Description | Sequence |
|---|---|---|
| | | TGACCAAAAACCAGGTGTCCCTGACGTGCCTGGTGAAGGGGTTCTACCCAAG CGACATCGCCGTCGAGTGGGAGAGCAATGGCCAGCCCGAGAATAACTACAAG ACCACGCCCCCCATGCTGGACAGCGACGGCTCCTTTTTCCTGTACAGCAAAC TGACCGTGGACAAGAGCAGGTGGCAGCAGGGCAACGTGTTCAGCTGCAGCGT GATGCATGAGGCCCTGCACAACCACTACACCCAGAAGTCCCTCTCCCTAAGC CCCGGTAAG |
| 378 | Treme_HC_IgG2-CO20 | ATGGAGACGCCCGCCCAACTCCTCTTCCTACTCCTCCTCTGGCTCCCGGACA CAACCGGCCAGGTTCAGCTCGTCGAGAGCGGAGGGGGCGTTGTCCAGCCCGG CAGGTCCCTCAGGCTCAGCTGCGCCGCGAGCGGCTTCACCTTCAGCAGCTAC GGCATGCATTGGGTCCGGCAGGCCCCCGGCAAGGGCCTCGAGTGGGTTGCCG TCATCTGGTACGACGGCAGCAACAAGTACTACGCCGACAGCGTCAAGGGGAG GTTCACCATCAGCAGGGACAACTCCAAGAATACCCTCTATCTGCAGATGAAC AGCCTGAGGGCCGAGGACACCGCGGTGTACTACTGCGCCCGGGATCCCAGAG GCGCCACCCTCTATTACTACTACTACGGCATGGACGTCTGGGGGCAGGGGAC CACCGTGACGGTGAGCAGCGCCAGCACCAAGGGGCCCTCGGTGTTCCCCCTC GCGCCCTGCTCACGTTCCACCAGCGAGAGCACCGCCGCCCTCGGCTGTCTGG TGAAGGACTACTTCCCCGAGCCGGTCACCGTGTCCTGGAATAGCGGCGCCCT GACGAGCGGCGTCCACACCTTCCCCGCCGTCCTCCAGAGCTCCGGTCTGTAT AGCCTGTCCAGCGTGGTGACCGTGCCCAGCAGCAATTTCGGAACCCAGACCT ATACTTGCAATGTGGACCACAAGCCGTCCAACACCAAGGTGGACAAGACGGT CGAACGCAAATGCTGCGTTGAGTGCCCACCCTGCCCCGCCCCGCCCGTCGCG GGGCCAAGCGTCTTCCTGTTTCCGCCCAAGCCTAAAGACACCCTCATGATCA GCCGGACCCCCGAGGTGACCTGCGTGGTGGTCGACGTGTCCCACGAAGACCC CGAAGTGCAGTTCAATTGGTACGTGGACGGGGTGGAGGTGCACAACGCCAAG ACGAAACCCAGGGAGGAGCAGTTCAACTCTACTTTCCGGGTGGTGAGCGTGC TGACGGTGGTGCACCAGGACTGGCTGAACGGGAAGGAGTACAAGTGCAAGGT GTCCAACAAGGGACTGCCGGCCCCCATCGAGAAGACCATCAGCAAGACCAAG GGCCAGCCCCGAGAGCCCCAAGTGTACACGCTCCCTCCCAGCAGGGAAGAGA TGACCAAGAACCAGGTGAGCCTGACATGCCTGGTGAAGGGTTTCTACCCATC CGACATCGCGGTGGAGTGGGAGTCCAACGGGCAGCCCGAAAACAATTACAAG ACCACCCCTCCCATGCTGGACTCGGACGGCAGCTTCTTTCTGTACTCCAAGC TGACCGTGGACAAGAGCAGGTGGCAGCAGGGCAACGTGTTCAGCTGCAGCGT GATGCACGAGGCCCTGCACAACCATTACACCCAGAAGTCCCTCAGCCTGAGC CCCGGAAAG |
| 379 | Treme_HC_IgG2-CO21 | ATGGAGACTCCCGCCCAGCTTTTGTTCCTCCTCCTCCTATGGCTCCCGGACA CCACCGGACAGGTCCAGCTCGTAGAGAGCGGGGGAGGCGTCGTTCAGCCCGG TCGGTCGCTAAGGCTCTCGTGCGCGGCCAGCGGCTTCACCTTTAGCAGCTAC GGCATGCACTGGGTCAGGCAGGCCCCCGGTAAGGGTCTGGAGTGGGTCGCCG TCATCTGGTACGACGGCTCCAACAAGTATTACGCCGATTCCGTTAAAGGGCG GTTCACCATTTCCAGGGACAACTCCAAGAACACCCTCTACCTGCAGATGAAT TCCCTGCGGGCCGAAGACACCGCCGTGTATTACTGCGCGCGGGACCCCCGGG GGGCCACCCTGTATTATTACTATTACGGGATGGACGTCTGGGGCCAGGGCAC CACCGTCACGGTCAGCTCCGCCAGCACAAAGGGTCCGAGCGTTTTCCCCCTG GCCCCCTGCTCGCGCTCCACCAGCGAGTCCACCGCCGCCCTGGGCTGTCTGG TCAAGGACTACTTCCCCGAGCCGGTGACTGTCAGCTGGAACTCCGGCGCGCT CACGAGCGGGGTGCATACGTTCCCCGCCGTCCTACAGAGTTCGGGGCTGTAC TCCCTGAGCAGCGTGGTGACGGTGCCCAGCTCCAACTTCGGGACCCAGACCT ACACCTGCAACGTGGACCACAAGCCCAGCAACACCAAGGTGGATAAGACGGT GGAGAGGAAGTGCTGCGTGGAGTGCCCGCCCTGTCCGGCCCCGCCCGTGGCC GGCCCCAGCGTGTTCCTCTTTCCCCCCAAGCCCAAGGACACCCTGATGATCT CGAGGACGCCCGAGGTGACCTGCGTGGTGGTCGACGTGAGCCACGAGGATCC CGAGGTGCAATTCAACTGGTACGTGGACGGGGTGGAGGTGCACAACGCCAAA ACCAAGCCAAGGGAAGAACAGTTCAATAGCACCTTTAGGGTGGTAAGCGTGC TGACCGTCGTGCACCAGGATTGGCTGAACGGGAAGGAGTACAAGTGCAAGGT GAGCAACAAGGGCCTCCCCGCCCCAATCGAGAAGACCATCAGCAAAACCAAG GGGCAACCCAGGGAGCCCCAGGTGTATACCCTGCCCCCGTCCAGGGAGGAGA TGACAAAGAACCAGGTGTCCCTGACCTGTCTGGTCAAGGGCTTTTATCCCAG CGACATCGCCGTGGAGTGGGAAAGCAACGGGCAGCCAGAAAACAACTACAAG ACCACGCCCCCCATGCTGGACAGCGATGGTTCCTTTTTCCTGTACAGCAAGC TGACCGTGGACAAGAGTAGGTGGCAACAGGGGAACGTGTTCTCCTGCAGCGT GATGCATGAGGCCCTCCACAACCACTACACCCAGAAAAGCCTGTCACTGTCG CCCGGGAAG |
| 380 | Treme_HC_IgG2-CO22 | ATGGAGACTCCCGCACAGTTGCTGTTCCTCCTACTCCTCTGGCTCCCCGACA CCACGGGACAGGTCCAGTTGGTCGAGTCCGGGGGCGGGGTCGTCCAACCCGG GCGATCCCTCAGGCTCAGCTGTGCCGCCAGCGGCTTCACGTTCAGCAGCTAC GGCATGCACTGGGTCAGGCAGGCCCCCGGCAAGGGGCTCGAGTGGGTCGCCG TCATTTGGTACGACGGCTCCAACAAGTACTACGCCGACAGCGTCAAGGGCCG CTTCACCATCAGCCGGGATAACAGCAAGAACACTCTCTATCTGCAGATGAAC AGCCTGAGGGCCGAAGACACGGCCGTGTACTACTGCGCCAGGGACCCCCGCG GCGCCACCCTGTACTACTACTATTACGGCATGGACGTCTGGGGCCAGGGTAC CACCGTGACCGTGAGCAGCGCCTCCACCAAGGGCCCCAGCGTGTTCCCACTC GCCCCCTGCAGCCGGAGCACAAGCGAATCCACCGCCGCTCTCGGATGCCTGG |

TABLE 3-continued

Optimized Tremelimumab and Ipilimumab Sequences

| SEQ ID NO | Description | Sequence |
|---|---|---|
| | | TGAAGGACTACTTCCCCGAGCCCGTGACCGTGTCGTGGAATAGCGGCGCCCT<br>GACCAGCGGCGTCCACACCTTCCCCGCCGTGCTGCAGAGCAGCGGGCTGTAC<br>TCCCTGAGCTCCGTGGTCACGGTGCCCTCCTCCAATTTCGGCACCCAGACCT<br>ACACCTGCAATGTAGACCACAAGCCCTCCAATACCAAAGTGGACAAGACCGT<br>GGAGAGGAAGTGTTGCGTGGAGTGTCCCCCCTGCCCCGCCCCGCCCGTGGCC<br>GGCCCCAGCGTGTTCCTCTTTCCGCCGAAGCCCAAGGACACCCTGATGATCA<br>GCCGCACGCCGGAGGTGACCTGCGTGGTGGTGGACGTGAGCCACGAAGACCC<br>CGAGGTCCAGTTTAACTGGTATGTGGACGGCGTGGAGGTGCACAACGCCAAG<br>ACCAAGCCCAGGGAGGAGCAGTTCAACAGCACCTTTAGGGTGGTGAGCGTGC<br>TGACGGTCGTGCACCAGGACTGGCTGAATGGCAAAGAGTACAAGTGCAAGGT<br>GTCCAACAAGGGCCTGCCCGCCCCGATCGAGAAGACGATCTCCAAGACCAAG<br>GGCCAGCCCCGCGAGCCCCAGGTCTATACCCTCCCTCCCAGCAGGGAGGAAA<br>TGACCAAAAATCAGGTGTCCCTGACCTGCCTGGTGAAGGGGTTTTACCCCAG<br>CGATATCGCCGTGGAATGGGAGTCGAACGGCCAGCCAGAGAACAACTATAAA<br>ACCACCCCGCCCATGCTGGACTCCGACGGCAGCTTCTTCCTGTACAGCAAGC<br>TGACCGTAGACAAGTCGCGCTGGCAGCAGGGCAATGTCTTCAGCTGCTCGGT<br>GATGCACGAGGCCCTGCATAATCACTACACCCAGAAAAGCCTGAGCCTGTCC<br>CCCGGGAAG |
| 381 | Treme_HC_IgG2-CO23 | ATGGAGACACCCGCCCAGCTCCTCTTCCTCCTCCTACTCTGGTTGCCCGACA<br>CCACCGGACAGGTACAGCTCGTAGAATCCGGCGGCGGCGTCGTACAGCCCGG<br>CAGGTCCCTACGGCTCTCCTGTGCCGCCAGCGGGTTCACGTTCAGCAGCTAC<br>GGCATGCATTGGGTCCGTCAAGCCCCGGGCAAGGGTTTAGAGTGGGTCGCCG<br>TCATCTGGTACGACGGCTCCAACAAGTACTACGCCGACAGCGTCAAGGGCAG<br>GTTCACCATTTCACGGGACAATAGCAAGAACACGCTCTACCTGCAGATGAAC<br>AGCCTGCGAGCCGAGGACACCGCCGTGTACTACTGCGCCCGGGACCCCAGGG<br>GCGCCACCCTCTACTATTACTACTACGGGATGGATGTCTGGGGCCAGGGAAC<br>CACCGTGACCGTGTCCTCCGCCAGCACAAAGGGGCCCTCCGTGTTCCCCCTG<br>GCCCCCTGCAGCAGGAGCACCTCGGAGAGCACCGCCGCCCTGGGCTGCCTGG<br>TGAAGGACTATTTCCCCGAGCCCGTGACCGTCAGCTGGAACAGCGGCGCGCT<br>GACCTCCGGCGTGCATACCTTTCCGGCCGTGCTGCAGAGCAGCGGCCTGTAC<br>TCACTGAGCAGCGTGGTCACCGTCCCGTCCAGCAACTTCGGGACCCAGACCT<br>ATACCTGCAACGTGGACCACAAGCCCAGCAACACCAAGGTCGACAAGACCGT<br>GGAGCGGAAGTGCTGCGTGGAATGCCCCCCGTGCCCGGCGCCGCCCGTGGCC<br>GGCCCCAGCGTCTTCCTGTTCCCACCCAAGCCGAAGGATACCCTGATGATCA<br>GCAGGACCCCCGAGGTCACCTGCGTCGTGGTGGACGTGTCCCACGAGGACCC<br>CGAGGTGCAGTTCAACTGGTACGTCGACGGCGTCGAGGTCCACAACGCCAAG<br>ACAAAGCCAAGGGAGGAGCAGTTTAACAGTACGTTCCGGGTGGTGAGCGTGC<br>TGACCGTGGTCCACCAGGACTGGCTGAACGGCAAGGAGTATAAGTGCAAGGT<br>CAGCAACAAGGGGCTGCCCGCCCCCATCGAAAAGACTATCAGCAAGACCAAA<br>GGGCAGCCCCGGGAACCCCAGGTGTACACCCTCCCCCCAAGCAGGGAGGAGA<br>TGACCAAGAACCAGGTGAGCTTGACATGCCTGGTGAAGGGGTTCTACCCCAG<br>CGACATCGCCGTCGAGTGGGAGTCCAATGGCCAGCCCGAGAACAACTACAAG<br>ACCACCCCGCCCATGCTCGATAGCGACGGCAGCTTCTTCCTGTACAGCAAGC<br>TGACCGTGGACAAGTCCAGGTGGCAGCAGGGCAACGTGTTCTCGTGCAGCGT<br>GATGCACGAGGCCCTGCATAACCACTACACCCAGAAAAGCCTCAGCCTATCC<br>CCCGGCAAG |
| 382 | Treme_HC_IgG2-CO24 | ATGGAGACGCCCGCCCAACTCCTCTTCCTCCTCCTCCTCTGGCTCCCGGACA<br>CCACCGGCCAGGTCCAGCTCGTCGAGAGCGGCGGCGGGGTCGTCCAGCCAGG<br>CAGGAGCCTAAGGCTTTCCTGCGCCGCCAGCGGCTTCACCTTTAGCAGCTAC<br>GGCATGCACTGGGTTCGCCAGGCCCCCGGCAAGGGCCTCGAGTGGGTCGCCG<br>TTATCTGGTACGACGGCAGCAACAAGTACTACGCGGACAGCGTCAAGGGCAG<br>GTTTACCATAAGCAGGGACAACTCCAAGAACACCTTGTACCTGCAGATGAAC<br>AGCCTGCGAGCCGAGGACACTGCCGTGTACTACTGCGCGCGCGACCCCCGCG<br>GCGCGACCCTGTACTACTACTACTACGGGATGGATGTCTGGGGCCAGGGGAC<br>CACCGTGACGGTAAGCTCCGCGAGCACCAAGGGGCCCTCGGTGTTCCCCCTG<br>GCCCCCTGCTCCAGGTCCACCAGCGAGTCCACCGCCGCCCTGGGGTGTCTGG<br>TGAAGGACTACTTCCCCGAGCCCGTGACAGTCTCCTGGAACAGCGGGGCCCT<br>CACAAGCGGCGTGCACACCTTCCCCGCCGTGCTGCAGTCAAGCGGACTGTAC<br>AGCCTGTCCAGCGTGGTGACCGTGCCGTCCAGCAATTTCGGCACCCAGACCT<br>ACACCTGTAACGTCGACCACAAGCCCAGCAACACCAAGGTGGACAAGACCGT<br>GGAGCGCAAGTGCTGCGTGGAATGCCCCCCGTGCCCGGCCCCACCCGTGGCC<br>GGCCCCTCCGTGTTTCTGTTCCCACCCAAACCCAAGGACACGCTGATGATCA<br>GCAGGACCCCCGAGGTCACCTGCGTGGTGGTGGACGTGAGCCACGAAGACCC<br>CGAGGTGCAGTTCAACTGGTACGTGGACGGCGTGGAGGTGCACAACGCCAAG<br>ACCAAGCCGCGGGAGGAGCAGTTCAATAGCACCTTTAGGGTGGTGAGCGTAC<br>TGACCGTGGTGCACCAGGACTGGCTGAACGGGAAGGAATACAAGTGTAAGGT<br>CAGCAACAAGGGGCTCCCCGCCCCCATCGAGAAAACCATCAGCAAAACCAAG<br>GGGCAACCGCGAGAGCCCCAGGTGTACACCCTGCCACCGAGCAGGGAAGAGA<br>TGACCAAGAATCAGGTGAGCCTGACCTGCCTGGTGAAAGGCTTCTACCCAAG<br>CGATATCGCCGTGGAGTGGGAGAGCAATGGGCAGCCTGAGAATAACTACAAA<br>ACCACCCCGCCCATGCTGGACTCCGACGGGAGCTTCTTTCTGTATAGCAAGC<br>TGACCGTGGATAAGAGCCGTTGGCAGCAGGGGAACGTGTTCAGCTGTTCAGT |

TABLE 3-continued

Optimized Tremelimumab and Ipilimumab Sequences

| SEQ ID NO | Description | Sequence |
|---|---|---|
| | | GATGCACGAGGCCCTCCATAACCACTACACTCAAAAGTCCCTCAGCCTTAGC CCCGGCAAG |
| 383 | Treme_HC_IgG2-CO25 | ATGGAGACTCCCGCCCAGCTCCTCTTTCTACTCCTCCTCTGGCTCCCCGACA CGACCGGGCAGGTCCAGCTCGTCGAGAGCGGCGGGGGCGTCGTACAGCCCGG CAGGAGCCTCAGGCTTAGCTGCGCCGCCTCCGGGTTCACATTTAGCAGCTAC GGGATGCACTGGGTCAGGCAGGCACCGGGCAAGGGCCTCGAGTGGGTCGCCG TCATCTGGTACGACGGCTCCAACAAGTACTACGCCGATAGCGTCAAGGGCCG GTTCACGATCAGCAGGGACAACAGCAAGAACACGCTTTACCTGCAGATGAAC AGCCTGAGGGCCGAGGATACCGCCGTTTATTACTGCGCCAGGGACCCCCGGG GGGCCACCCTGTACTACTACTACTACGGCATGGACGTGTGGGGACAGGGTAC CACCGTGACCGTGAGCAGCGCCTCCACGAAGGGGCCCAGTGTGTTCCCCCTG GCCCCCTGCAGCAGGTCCACCAGCGAGAGCACCGCGGCCCTGGGCTGCCTAG TGAAGGACTACTTCCCCGAGCCCGTGACCGTGAGCTGGAACTCCGGCGCCCT CACCAGCGGGGTCCACACCTTTCCGGCGGTGCTCCAGAGCAGCGGCCTGTAC TCCCTCAGCAGCGTCGTGACGGTACCCAGCAGCAACTTCGGCACCCAAACCT ACACCTGTAATGTGGACCACAAGCCCAGCAACACCAAGGTCGACAAGACCGT GGAGCGAAAGTGCTGCGTGGAGTGCCCTCCCTGCCCTGCCCCGCCCGTGGCC GGGCCCAGCGTGTTCCTGTTCCCTCCCAAGCCGAAGGACACCCTGATGATTT CCCGGACCCCCGAGGTGACGTGCGTGGTGGTGGACGTGTCCCACGAGGACCC CGAAGTGCAGTTCAACTGGTACGTGGACGGGGTGGAGGTGCACAACGCGAAG ACGAAGCCCCGGGAGGAGCAGTTCAACAGCACCTTCAGAGTCGTGAGCGTGC TGACCGTCGTGCACCAGGATTGGCTGAACGGCAAGGAGTACAAGTGTAAGGT GAGCAACAAGGGGCTGCCCGCCCCCATCGAGAAGACGATCTCAAAGACCAAG GGCCAGCCCAGGGAACCGCAGGTGTACACGCTGCCCCCCAGCAGGGAGGAGA TGACCAAGAACCAGGTGTCCCTGACGTGCCTGGTCAAGGGCTTCTACCCCTC CGATATCGCCGTGGAGTGGGAATCCAACGGTCAGCCCGAGAACAACTACAAA ACCACTCCGCCCATGCTGGACTCCGACGGCAGCTTCTTTCTGTACTCCAAGC TGACCGTGGACAAATCCAGGTGGCAGCAGGGCAACGTGTTTTCCTGCTCCGT GATGCACGAGGCCCTGCACAACCACTACACCCAGAAGTCCCTCTCCCTGTCC CCCGGCAAG |
| 384 | Treme_HC_IgG1 (tremelimumab IgG1 heavy chain) | METPAQLLFLLLLWLPDTTGQVQLVESGGGVVQPGRSLRLSCAASGFTFSSY GMHWVRQAPGKGLEWVAVIWYDGSNKYYADSVKGRFTISRDNSKNTLYLQMN SLRAEDTAVYYCARDPRGATLYYYYYGMDVWGQGTTVTVSSASTKGPSVFPL APSSKSTSGGTAALGCLVKDYFPEPVTVSWNSGALTSGVHTFPAVLQSSGLY SLSSVVTVPSSSLGTQTYICNVNHKPSNTKVDKRVEPKSCDKTHTCPPCPAP ELLGGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIEKTI SKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKS LSLSPGK |
| 385 | Treme_HC_IgG1 (signal peptide) | METPAQLLFLLLLWLPDTTG |
| 386 | Treme_HC_IgG1 (variable region, VH) | QVQLVESGGGVVQPGRSLRLSCAASGFTFSSYGMHWVRQAPGKGLEWVAVIW YDGSNKYYADSVKGRFTISRDNSKNTLYLQMNSLRAEDTAVYYCARDPRGAT LYYYYYGMDVWGQGTTVTVSS |
| 387 | Treme_HC_IgG1 (constant region) | ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKRVEPKSCD KTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSN KALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMH EALHNHYTQKSLSLSPGK |
| 388 | Treme_HC_IgG1-CO01 | ATGGAGACTCCCGCCCAGCTCCTCTTCCTCCTCCTACTCTGGCTTCCCGACA CCACCGGGCAGGTACAGCTCGTCGAATCCGGGGGCGGCGTAGTCCAGCCGGG CAGGTCGCTCCGGCTCAGCTGCGCCGCCTCCGGGTTTACCTTCAGCAGCTAC GGCATGCATTGGGTCAGGCAGGCCCCCGGCAAGGGGCTCGAGTGGGTTGCCG TCATCTGGTACGACGGCTCAAATAAATACTACGCCGACAGCGTCAAGGGCAG GTTCACCATCAGCAGGGACAATAGCAAGAACACGCTCTACCTGCAGATGAAC AGCCTGCGGGCCGAAGACACCGCCGTGTATTACTGCGCCAGGGACCCCCGCG GCGCGACCCTGTACTACTACTACTACGGCATGGACGTGTGGGGCCAGGGCAC GACCGTGACCGTGTCCTCTGCCAGCACTAAGGGCCCCAGCGTTTTCCCCCTG GCCCCGAGCAGCAAGAGCACCTCCGGCGGCACGGCCGCCCTGGGGTGCCTGG TGAAGGACTATTTCCCCGAGCCCGTGACCGTGAGCTGGAACTCCGGCGCCCT GACCTCTGGCGTCCACACCTTCCCCGCCGTGCTGCAGAGTAGCGGCCTGTAC AGCCTGTCCTCCGTGGTCACCGTGCCCAGCAGCTCGCTGGGCACCCAGACCT ACATCTGCAATGTTAACCACAAGCCCTCCAATACCAAGGTGGATAAGAGGGT GGAGCCAAAGAGCTGCGACAAGACACACACCTGCCCCCCGTGTCCCGCCCCC GAGCTGCTGGGCGGCCCCTCCGTGTTCCTGTTCCCACCCAAGCCGAAGGACA CCCTCATGATAAGCCGGACCCCCGAGGTGACCTGCGTGGTGGTGGATGTGAG |

TABLE 3-continued

Optimized Tremelimumab and Ipilimumab Sequences

| SEQ ID NO | Description | Sequence |
|---|---|---|
| | | CCACGAGGACCCCGAAGTGAAGTTCAACTGGTACGTGGACGGCGTGGAGGTG<br>CACAATGCCAAGACCAAACCGCGTGAGGAGCAGTACAACAGCACCTACCGCG<br>TGGTGAGCGTGCTTACCGTCCTTCATCAAGACTGGCTGAACGGCAAGGAGTA<br>CAAGTGCAAGGTGTCCAATAAGGCCCTGCCGGCCCCCATCGAGAAGACCATC<br>TCCAAGGCCAAGGGGCAGCCCCGGGAGCCCCAGGTGTACACGCTGCCCCCCA<br>GCAGGGAGGAGATGACCAAGAACCAGGTGTCCCTCACCTGCCTGGTGAAGGG<br>CTTCTACCCCAGCGACATAGCCGTGGAATGGGAATCCAACGGGCAGCCCGAA<br>AATAACTACAAGACGACCCCTCCCGTGCTGGACTCCGATGGCAGCTTTTTCC<br>TGTACTCAAAGCTGACCGTGGACAAGAGCAGGTGGCAGCAGGGCAACGTGTT<br>TAGCTGTTCCGTGATGCATGAGGCTCTGCACAACCACTACACCCAGAAAAGC<br>CTGAGCCTGAGCCCCGGCAAG |
| 389 | Treme_HC_IgG1-CO02 | ATGGAGACGCCGGCCCAACTCCTTTTCCTCCTTCTCTTGTGGCTCCCCGACA<br>CCACCGGCCAGGTCCAGCTCGTCGAATCCGGAGGCGGGGTCGTCCAGCCCGG<br>CAGGAGCCTCCGGCTCAGCTGCGCGGCCTCCGGGTTCACGTTTAGCAGCTAC<br>GGCATGCACTGGGTACGTCAGGCCCCCGGCAAGGGTCTGGAGTGGGTCGCGG<br>TCATCTGGTACGACGGTAGCAACAAGTATTACGCGGACTCGGTCAAGGGGCG<br>GTTCACCATCAGCAGGGATAACAGCAAGAACACGCTCTACCTGCAGATGAAC<br>AGCCTGAGGGCCGAGGACACGGCCGTGTACTACTGCGCCAGGGACCCCCGAG<br>GCGCCACCCTGTACTACTACTATTACGGCATGGACGTGTGGGGCCAGGGCAC<br>CACAGTGACGGTGAGCAGCGCCTCCACCAAAGGCCCCTCCGTCTTCCCCCTG<br>GCCCCCAGCTCCAAGAGCACAAGCGGCGGCACCGCCGCGCTCGGCTGCCTGG<br>TGAAGGATTACTTCCCCGAGCCCGTGACCGTGAGCTGGAACAGCGGCGCCCT<br>GACCTCCGGCGTGCATACCTTCCCCGCCGTGCTGCAGTCCAGCGGGCTGTAC<br>TCCCTGAGCAGCGTGGTGACCGTGCCCAGCTCCAGCCTCGGCACCCAGACCT<br>ACATCTGCAATGTGAATCACAAGCCGTCCAACACCAAGGTGGACAAGCGTGT<br>GGAACCCAAGTCGTGCGACAAGACCCACACCTGCCCGCCCTGCCCCGCCCCG<br>GAGCTCCTGGGCGGCCCGTCCGTGTTCCTGTTCCCTCCCAAGCCCAAGGATA<br>CACTGATGATCAGCAGGACCCCCGAGGTGACCTGCGTGGTGGTGGACGTGAG<br>CCACGAGGACCCCGAGGTGAAATTTAACTGGTACGTGGACGGGGTGGAGGTC<br>CACAACGCCAAAACGAAGCCGCGAGAAGAACAGTACAACTCCACCTACCGGG<br>TGGTCAGCGTCCTGACCGTCCTGCATCAAGACTGGCTGAACGGAAAAGAGTA<br>CAAGTGCAAGGTCAGCAACAAGGCGCTGCCCGCCCCGATCGAGAAGACGATC<br>AGCAAGGCCAAAGGCCAGCCCCGCGAGCCCCAGGTCTACACCCTGCCCCCCA<br>GCAGAGAGGAGATGACGAAGAACCAGGTGTCCCTCACCTGTCTGGTGAAGGG<br>CTTCTACCCCTCCGACATCGCCGTCGAGTGGGAGAGCAATGGGCAGCCCGAG<br>AACAATTATAAGACCACCCCGCCCGTGCTGGACTCCGACGGCAGCTTCTTTC<br>TGTACAGCAAGCTGACCGTGGACAAGTCGCGGTGGCAGCAGGGCAACGTGTT<br>CAGCTGCTCGGTGATGCACGAAGCCCTGCACAACCACTATACCCAGAAAAGC<br>CTGAGCCTCTCCCCCGGGAAG |
| 390 | Treme_HC_IgG1-CO03 | ATGGAAACCCCCGCCCAACTCCTCTTCCTCCTCCTCCTATGGCTTCCGGACA<br>CCACCGGGCAGGTCCAGCTCGTCGAGTCCGGCGGGGGCGTCGTCCAGCCGGG<br>CAGGAGCCTCAGGCTCTCCTGCGCCGCATCAGGCTTCACCTTTAGCTCGTAC<br>GGGATGCACTGGGTCCGGCAGGCGCCCGGCAAGGGCTTGGAGTGGGTTGCCG<br>TAATCTGGTACGACGGCAGCAACAAGTACTACGCCGACTCCGTCAAGGGCCG<br>GTTCACCATCTCCAGGGACAACAGCAAGAACACCCTCTACCTGCAGATGAAC<br>AGCCTGAGGGCGGAGGACACCGCCGTGTACTATTGCGCCAGGGACCCCAGGG<br>GCGCCACCCTGTATTACTACTACTACGGCATGGACGTGTGGGGCCAGGGCAC<br>AACAGTCACGGTGTCGTCAGCCAGCACCAAAGGCCCGTCCGTCTTCCCCCTG<br>GCCCCCAGCAGCAAGAGCACATCCGGGGGAACCGCCGCCCTGGGCTGTCTGG<br>TGAAGGACTACTTCCCCGAGCCCGTGACCGTGTCGTGGAACAGCGGCGCCCT<br>GACCAGTGGGGTGCATACGTTCCCCGCCGTGCTTCAAAGCAGCGGCCTGTAC<br>AGCCTGAGCTCCGTGGTGACCGTGCCCAGCAGCTCGCTGGGGACCCAGACCT<br>ACATCTGTAATGTGAACCACAAGCCCAGCAATACCAAGGTGGACAAGCGAGT<br>GGAGCCCAAGTCCTGTGATAAGACCCACACCTGCCCGCCCTGCCCCGCGCCC<br>GAACTGCTGGGCGGCCCTAGCGTGTTCCTGTTCCCTCCCAAACCCAAAGACA<br>CTCTTATGATCAGCCGGACCCCCGAGGTGACCTGTGTGGTGGTGGACGTCAG<br>CCATGAGGACCCGGAAGTGAAGTTTAACTGGTACGTGGACGGCGTGGAGGTG<br>CATAACGCCAAAACCAAACCCCGGGAGGAGCAGTACAACAGCACGTACAGGG<br>TCGTGTCCGTGCTCACCGTGCTGCACCAGGATTGGCTTAACGGCAAGGAGTA<br>CAAGTGCAAGGTGAGCAACAAGGCCCTGCCCGCCCCGATCGAGAAGACCATC<br>TCCAAGGCTAAGGGCCAGCCTAGGGAGCCACAGGTGTACACACTGCCCCCCT<br>CCAGGGAGGAAATGACGAAAAATCAGGTGAGCCTGACCTGCCTGGTGAAGGG<br>GTTCTACCCCTCCGACATCGCCGTGGAGTGGGAAAGCAACGGGCAACCCGAG<br>AATAACTACAAAACCACCCCGCCCGTGCTGGATAGCGACGGCAGCTTCTTCC<br>TGTACTCCAAGCTGACCGTGGATAAGAGCCGATGGCAGCAGGGCAACGTGTT<br>CAGCTGCTCAGTGATGCACGAGGCGCTGCATAACCACTACACCCAGAAGAGT<br>CTGTCGCTGAGCCCCGGCAAA |
| 391 | Treme_HC_IgG1-CO04 | ATGGAGACTCCCGCCCAACTCCTATTCCTACTCCTCCTCTGGCTCCCGGACA<br>CCACGGGGCAAGTCCAGCTCGTGGAGTCCGGCGGGGGCGTTGTACAGCCCGG<br>CCGAAGCCTCAGGCTCAGCTGCGCCGCCAGCGGCTTCACCTTCTCCAGCTAC<br>GGCATGCACTGGGTCCGCCAGGCCCCCGGGAAGGGGCTCGAGTGGGTCGCCG<br>TCATCTGGTACGACGGCTCCAACAAGTACTACGCCGACAGCGTCAAGGGCAG |

TABLE 3-continued

Optimized Tremelimumab and Ipilimumab Sequences

| SEQ ID NO | Description | Sequence |
|---|---|---|
| | | GTTCACCATCTCCCGGGATAACTCCAAGAATACCCTCTACCTGCAGATGAAC<br>AGCCTGCGAGCCGAGGATACCGCGGTCTACTACTGCGCCCGCGACCCCAGGG<br>GCGCCACCCTGTACTACTACTATTACGGCATGGACGTGTGGGGCCAGGGTAC<br>CACCGTGACCGTGTCCTCCGCCAGCACGAAAGGGCCCAGCGTCTTCCCGCTG<br>GCCCCCAGCTCCAAGAGCACGTCCGGCGGCACCGCCGCCCTGGGATGTCTGG<br>TGAAAGACTACTTTCCCGAACCCGTGACCGTGTCGTGGAACTCAGGCGCCCT<br>TACCAGCGGAGTGCACACCTTCCCGGCCGTGCTTCAGAGCTCGGGACTCTAT<br>TCCCTGAGCAGCGTGGTCACCGTGCCCAGCAGCAGCCTGGGCACCCAGACCT<br>ACATTTGCAACGTGAACCACAAGCCCTCTAACACGAAGGTGGACAAGAGGGT<br>GGAGCCCAAGAGCTGCGACAAGACCCACACCTGCCCCCCGTGCCCAGCGCCC<br>GAGCTGCTCGGCGGCCCCAGCGTGTTCCTGTTCCCTCCCAAGCCGAAGGACA<br>CGCTGATGATCAGCAGGACGCCAGAGGTAACCTGCGTGGTGGTAGACGTGTC<br>CCACGAGGACCCCGAGGTGAAATTCAACTGGTACGTCGATGGCGTGGAGGTG<br>CACAACGCCAAGACGAAACCCCGGGAGGAGCAATATAATTCCACCTACAGGG<br>TGGTCAGCGTGCTGACCGTGCTCCACCAAGACTGGCTGAACGGGAAAGAATA<br>CAAGTGCAAAGTGTCCAATAAAGCCCTGCCAGCCCCCATTGAGAAGACCATC<br>AGCAAGGCCAAGGGGCAGCCCAGGGAACCCCAGGTGTACACCCTGCCCCCAT<br>CCAGGGAGGAGATGACCAAGAACCAGGTGTCCCTGACGTGCCTGGTCAAGGG<br>CTTCTATCCCAGCGACATCGCCGTCGAGTGGGAAAGCAATGGGCAACCCGAG<br>AACAACTACAAGACCACCCCGCCCGTGCTCGACTCCGACGGCAGCTTCTTCC<br>TCTACTCCAAGCTGACCGTGGATAAGAGCCGCTGGCAGCAGGGCAATGTGTT<br>CAGCTGTAGCGTGATGCACGAGGCCCTGCACAACCACTACACCCAAAAGTCG<br>CTCAGTCTGTCCCCCGGCAAG |
| 392 | Treme_HC_IgG1-CO05 | ATGGAAACGCCCGCCCAGCTCCTCTTCCTCCTCCTCCTCTGGCTCCCCGACA<br>CTACGGGCCAGGTACAGCTCGTCGAGAGCGGGGGCGGCGTTGTACAGCCCGG<br>CCGGTCCCTCAGGCTATCCTGCGCCGCCAGCGGCTTCACCTTCAGCAGCTAC<br>GGCATGCACTGGGTCAGGCAGGCCCCCGGGAAGGGCCTCGAGTGGGTCGCCG<br>TCATCTGGTACGACGGCTCCAATAAGTACTACGCGGACAGCGTTAAGGGGCG<br>CTTCACGATCAGCAGGGACAACTCCAAGAACACGCTCTACCTGCAGATGAAC<br>TCCCTGAGGGCGGAGGACACCGCCGTGTACTACTGCGCCAGAGATCCCAGGG<br>GTGCGACCCTCTATTACTACTACTACGGCATGGACGTGTGGGGCCAGGGAAC<br>GACCGTGACCGTGTCCAGCGCCAGCACCAAAGGGCCCAGCGTGTTCCCCCTG<br>GCCCCCTCCAGCAAGAGCACGAGCGGTGGCACCGCCGCCCTCGGCTGCCTGG<br>TGAAAGACTATTTTCCCGAGCCCGTGACGGTGAGCTGGAACAGCGGGGCCCT<br>GACCAGCGGGGTGCATACGTTCCCCGCCGTGTTGCAGTCGAGCGGCCTGTAC<br>TCCCTGAGCTCCGTGGTGACCGTGCCGTCCTCCTCGCTGGGCACCCAAACCT<br>ACATCTGTAACGTGAACCACAAGCCCAGCAATACCAAGGTGGACAAGCGGGT<br>GGAGCCGAAATCCTGTGACAAGACCCACACCTGCCCGCCCTGCCCCGCCCCC<br>GAGCTGCTGGGCGGGCCCTCCGTGTTCCTGTTCCCTCCCAAGCCGAAGGACA<br>CCCTGATGATCTCGAGGACCCCCGAGGTGACCTGCGTGGTGGTCGACGTGAG<br>CCACGAAGACCCCGAGGTGAAGTTCAACTGGTACGTGGACGGGGTGGAGGTC<br>CACAACGCCAAGACTAAACCCCGCGAGGAACAGTACAACAGCACCTACAGGG<br>TGGTCAGCGTGCTGACCGTGCTGCACCAGGACTGGCTGAATGGCAAGGAATA<br>CAAGTGCAAGGTGTCCAATAAGGCACTGCCAGCGCCCATCGAGAAAACCATC<br>AGCAAGGCGAAGGGGCAGCCGAGGGAGCCCCAGGTGTACACGCTGCCCCCCA<br>GTAGAGAGGAGATGACCAAGAACCAGGTGTCGCTAACTTGCCTGGTGAAGGG<br>GTTCTACCCCTCGGACATCGCCGTGGAGTGGGAGTCCAACGGCCAGCCCGAG<br>AATAACTACAAGACCACCCCTCCCGTGCTGGACTCCGACGGCAGCTTCTTCC<br>TGTACAGCAAGCTGACCGTTGATAAGTCCCGGTGGCAGCAGGGAAACGTGTT<br>TTCCTGCAGCGTCATGCACGAGGCGCTGCACAACCACTACACCCAAAAAAGC<br>CTGAGCCTCAGTCCCGGCAAG |
| 393 | Treme_HC_IgG1-CO06 | ATGGAGACTCCGGCCCAGCTCCTCTTCCTCCTCCTCCTCTGGCTCCCCGACA<br>CCACCGGTCAGGTCCAGCTCGTCGAGAGCGGAGGCGGCGTCGTCCAGCCCGG<br>GCGGTCGCTCAGGCTCAGCTGCGCCGCCAGCGGCTTCACCTTCAGCAGCTAC<br>GGCATGCATTGGGTCAGGCAGGCCCCGGGCAAGGGTCTTGAGTGGGTCGCCG<br>TCATCTGGTACGACGGCTCCAACAAGTACTACGCCGACAGCGTCAAAGGCCG<br>GTTCACCATTTCCCGGGATAACTCCAAGAATACGCTCTACCTGCAGATGAAC<br>AGCCTCCGCGCCGAGGACACCGCCGTCTACTACTGCGCACGGGACCCCCGGG<br>GGGCCACGCTGTACTATTACTACTACGGCATGGACGTGTGGGGCCAGGGGAC<br>CACCGTAACCGTGAGCTCCGCCAGCACCAAGGGCCCCAGCGTGTTTCCGCTC<br>GCCCCTAGCAGCAAGTCCACCTCCGGGGGCACCGCCGCCCTGGGGTGCCTGG<br>TGAAGGACTACTTCCCTGAGCCCGTGACCGTCAGCTGGAACAGTGGCGCCCT<br>GACCAGCGGGGTGCACACGTTCCCCGCCGTGCTGCAGAGCTCCGGCCTCTAT<br>AGCCTCAGCAGCGTCGTGACCGTGCCGAGCAGCTCCCTGGGTACCCAGACCT<br>ACATATGCAACGTAAACCATAAACCCTCCAACACGAAGGTGGACAAAAGGGT<br>GGAACCCAAAAGCTGCGACAAGACTCACACATGCCCGCCCTGCCCCGCCCCA<br>GAGCTGCTGGGGGGCCCCAGCGTGTTCCTGTTCCCGCCCAAGCCCAAGGACA<br>CCCTGATGATCAGCCGCACCCCCGAAGTGACCTGCGTGGTGGTGGACGTGAG<br>CCACGAGGACCCGGAGGTGAAGTTCAACTGGTACGTGGATGGGGTGGAAGTG<br>CACAATGCCAAGACCAAGCCCCGGGAGGAGCAGTACAACTCTACCTACCGGG<br>TGGTGAGCGTGCTCACGGTGCTGCACCAGGACTGGCTCAATGGCAAGGAGTA<br>TAAGTGCAAGGTGAGCAACAAGGCCCTGCCAGCCCCCATCGAAAAAACGATC<br>AGCAAGGCCAAGGGCCAGCCCCGGGAGCCACAGGTGTACACCCTGCCCCCCT |

TABLE 3-continued

Optimized Tremelimumab and Ipilimumab Sequences

| SEQ ID NO | Description | Sequence |
| --- | --- | --- |
| | | CCAGGGAGGAGATGACCAAGAACCAGGTGTCCCTGACCTGCCTGGTGAAGGG CTTCTACCCCTCCGACATCGCCGTCGAGTGGGAGTCCAACGGCCAGCCAGAG AACAACTACAAGACCACGCCCCCCGTGCTCGACAGCGACGGCAGCTTCTTTC TCTACTCCAAGCTGACCGTGGATAAGTCCAGGTGGCAGCAGGGCAACGTCTT TAGCTGTAGCGTCATGCACGAGGCCCTGCACAACCACTACACTCAGAAAAGC CTGAGCCTGTCCCCCGGCAAG |
| 394 | Treme_HC_IgG1-CO07 | ATGGAGACTCCGGCCCAGCTCCTCTTCTTGCTCCTCCTCTGGCTCCCGGACA CCACCGGGCAGGTCCAACTCGTCGAATCCGGCGGCGGCGTCGTACAGCCCGG CAGGAGCCTCAGGCTTTCCTGTGCCGCCAGCGGCTTCACCTTCAGCTCCTAC GGCATGCACTGGGTCAGGCAGGCCCCCGGGAAGGGCCTCGAGTGGGTCGCCG TCATCTGGTACGACGGCAGCAACAAGTACTACGCCGACTCCGTCAAGGGCAG GTTCACCATCAGCAGGGACAATTCCAAAAACACGCTCTACCTGCAAATGAAC AGCCTGCGCGCCGAGGACACAGCCGTGTACTACTGCGCCCGGGATCCCCGGG GCGCCACCCTCTACTACTACTATTACGGGATGGATGTGTGGGGGCAGGGCAC CACGGTGACGGTGAGCAGCGCCTCCACCAAAGGCCCCAGCGTGTTCCCCCTG GCGCCCAGCAGCAAAAGCACCAGCGGGGGAACCGCCGCGCTGGGCTGCCTGG TGAAGGACTACTTTCCCGAGCCCGTGACCGTGTCCTGGAACAGCGGCGCCCT CACGAGCGGGGTGCACACCTTCCCCGCGGTGCTGCAGAGCAGCGGCCTGTAC AGCCTGAGCAGCGTGGTGACCGTCCCCTCCTCCAGCCTGGGCACCCAGACAT ACATCTGCAACGTGAACCATAAGCCCAGCAATACCAAGGTCGACAAGCGAGT GGAGCCCAAGAGCTGCGACAAGACTCATACCTGCCCGCCCTGCCCCGCCCCC GAGCTGCTGGGCGGCCCCAGCGTGTTCCTGTTCCCGCCCAAACCGAAGGATA CCCTGATGATATCCCGCACCCCCGAGGTGACCTGCGTGGTGGTGGACGTGAG CCACGAGGACCCGGAGGTGAAATTCAACTGGTACGTGGATGGAGTGGAAGTG CATAACGCCAAGACCAAGCCCAGGGAGGAGCAGTACAACAGCACCTACCGAG TGGTGAGCGTGCTGACCGTGCTGCACCAAGACTGGCTGAACGGCAAAGAGTA CAAGTGCAAAGTGTCAAATAAAGCCCTCCCCGCCCCCATCGAGAAAACCATC TCGAAGGCCAAGGGCCAGCCACGCGAGCCCCAGGTGTACACCCTCCCGCCCA GCCGGGAGGAGATGACCAAGAACCAAGTGTCCCTGACGTGCCTGGTGAAGGG GTTCTACCCCAGCGACATAGCCGTAGAGTGGGAGAGCAATGGCCAGCCCGAG AATAATTATAAGACGACTCCCCCCGTGCTCGACAGCGACGGCAGCTTCTTCC TCTACAGCAAGCTCACCGTCGACAAGAGCAGGTGGCAGCAGGGCAATGTGTT CTCCTGCTCCGTCATGCATGAGGCCCTGCACAACCACTACACCCAGAAAAGC CTGTCCCTGTCCCCAGGTAAG |
| 395 | Treme_HC_IgG1-CO08 | ATGGAGACTCCCGCCCAGCTCCTATTCCTCCTCCTCCTCTGGCTTCCCGATA CCACCGGTCAGGTCCAGCTCGTCGAGTCCGGCGGCGGCGTGGTACAACCCGG ACGGTCCCTCCGGCTCAGCTGCGCCGCGTCCGGCTTCACCTTCAGCTCCTAC GGGATGCACTGGGTCCGGCAGGCCCCCGGTAAGGGCCTCGAGTGGGTCGCCG TTATCTGGTACGACGGCAGCAACAAGTACTACGCCGACAGCGTCAAGGGCCG GTTCACAATCAGCAGGGACAACTCCAAGAATACCCTCTACCTGCAGATGAAC AGCCTGCGGGCCGAGGATACGGCGGTCTACTACTGCGCCAGGGACCCGAGGG GCGCCACCCTGTATTACTATTACTACGGCATGGACGTGTGGGGCCAGGGCAC CACCGTGACCGTGTCCAGCGCCAGCACCAAGGGGCCCTCGGTGTTTCCCCTG GCCCCCAGCTCAAAGAGCACCAGCGGCGGGACCGCGGCCCTGGGATGCCTGG TGAAGGACTACTTTCCCGAGCCCGTGACCGTGTCCTGGAACTCCGGCGCGCT GACGAGCGGCGTACACACCTTTCCCGCCGTGCTGCAGAGCAGCGGCCTCTAT AGCCTGAGCAGCGTGGTGACCGTGCCCAGCAGCAGCCTGGGCACGCAGACCT ACATCTGCAACGTGAACCACAAGCCGAGCAACACCAAGGTGGATAAGAGGGT CGAGCCCAAGTCGTGTGACAAGACACATACCTGCCCCCCGTGCCCCGCCCCC GAGCTGCTGGGGGGCCCCAGCGTGTTCCTGTTCCCACCCAAGCCGAAAGACA CGCTGATGATTAGCAGGACCCCCGAGGTGACCTGCGTGGTGGTGGACGTCAG CCACGAGGACCCCGAGGTGAAGTTCAACTGGTACGTGGACGGCGTGGAGGTG CATAATGCTAAGACCAAGCCCCGGGAGGAGCAGTACAACTCCACCTACAGAG TGGTAAGCGTACTGACCGTGCTGCACCAGGACTGGCTGAACGGTAAGGAGTA CAAGTGTAAGGTGAGCAACAAGGCCCTGCCCGCCCCCATCGAGAAGACGATC TCGAAGGCCAAGGGCCAGCCCCGGGAGCCCCAGGTCTACACGCTCCCTCCCA GCAGGGAGGAGATGACGAAGAACCAGGTCAGCCTCACGTGCCTCGTGAAGGG CTTCTACCCCAGCGACATAGCCGTGGAGTGGGAGTCCAACGGACAGCCCGAG AACAACTACAAGACCACGCCCCCCGTTCTGGACTCCGACGGATCCTTTTTCC TCTACAGCAAACTGACCGTGGACAAGTCCCGGTGGCAGCAGGGCAACGTGTT CAGCTGCAGCGTGATGCACGAAGCCCTGCACAACCACTATACCCAGAAAAGC CTGTCCCTCAGCCCCGGCAAG |
| 396 | Treme_HC_IgG1-CO09 | ATGGAGACGCCCGCCCAGCTCCTCTTCCTCCTACTCCTTTGGCTCCCCGACA CCACCGGGCAGGTCCAGCTCGTCGAGTCCGGAGGCGGCGTCGTCCAGCCCGG CAGGAGCCTCAGGCTCAGCTGCGCCGCCAGCGGGTTCACCTTCAGCAGCTAC GGCATGCATTGGGTCAGGCAGGCCCCCGGTAAGGGACTCGAGTGGGTTGCCG TCATCTGGTACGACGGCAGCAATAAGTACTACGCCGATAGCGTCAAGGGCCG ATTCACCATCTCCAGGGACAACTCCAAGAACACGTTGTACCTGCAGATGAAC AGCCTGAGGGCGGAGGACACCGCCGTGTACTACTGCGCCCGGGATCCGCGGG GGGCCACGCTGTACTACTACTACTACGGCATGGATGTGTGGGGGCAGGGCAC CACCGTGACGGTGTCCAGTGCCTCTACCAAGGGCCCCTCCGTGTTCCCCCTG GCCCCTAGCAGCAAGAGCACAAGCGGCGGCACCGCCGCCCTGGGATGTCTGG |

TABLE 3-continued

Optimized Tremelimumab and Ipilimumab Sequences

| SEQ ID NO | Description | Sequence |
|---|---|---|
| | | TCAAAGACTACTTCCCCGAGCCCGTGACCGTGAGCTGGAACAGCGGCGCACT<br>CACCAGCGGCGTCCATACCTTCCCGGCGGTGCTGCAGAGCTCCGGTCTGTAC<br>AGCCTGAGCAGCGTCGTGACGGTGCCCTCCTCCTCCCTGGGCACCCAGACCT<br>ACATCTGCAACGTCAACCATAAGCCCAGCAACACCAAGGTGGACAAGAGGGT<br>GGAGCCGAAAAGCTGCGACAAAACCCACACCTGCCCGCCCTGTCCCGCGCCT<br>GAGCTCCTCGGCGGACCTAGCGTGTTCCTGTTCCCACCCAAGCCCAAAGACA<br>CACTCATGATCTCCAGGACCCCCGAGGTCACCTGCGTGGTGGTGGACGTCTC<br>CCACGAGGACCCCGAGGTGAAGTTCAACTGGTATGTGGACGGCGTGGAGGTC<br>CACAACGCCAAGACCAAACCCAGGGAGGAACAGTACAATTCTACCTACCGCG<br>TGGTGAGCGTGCTGACTGTTCTTCACCAGGACTGGCTGAACGGGAAGGAATA<br>CAAATGCAAGGTGAGCAACAAGGCCCTGCCCGCCCCCATCGAGAAGACCATC<br>TCCAAGGCGAAGGGCCAGCCCCGGGAACCCCAGGTGTACACCCTGCCCCCCA<br>GCAGGGAGGAGATGACCAAGAACCAGGTGTCCCTGACCTGCCTCGTGAAGGG<br>GTTCTACCCCAGCGACATCGCCGTGGAGTGGGAAAGCAACGGCCAGCCCGAG<br>AACAACTACAAGACAACCCCACCCGTGCTGGACTCCGACGGCAGCTTTTTCT<br>TATACAGCAAACTGACTGTGGACAAAAGCCGCTGGCAGCAGGGCAACGTGTT<br>CAGCTGCAGCGTGATGCACGAAGCCCTGCACAATCACTACACCCAGAAAAGC<br>CTGAGCCTCAGCCCCGGCAAG |
| 397 | Treme_HC_IgG1-CO10 | ATGGAGACGCCCGCCCAGCTTCTCTTCCTCCTACTCCTCTGGCTCCCCGACA<br>CCACCGGGCAGGTCCAGCTCGTCGAGAGCGGCGGCGGCGTGGTGCAGCCCGG<br>CCGGAGCCTCAGGTTAAGCTGCGCGGCGAGCGGCTTCACCTTCTCCAGCTAC<br>GGCATGCACTGGGTCCGCCAGGCGCCCGGCAAGGGGCTCGAGTGGGTCGCCG<br>TAATCTGGTACGACGGCAGCAACAAGTACTACGCCGACAGCGTCAAGGGCAG<br>ATTCACAATCTCCAGGGACAACTCTAAGAACACCTTGTACCTGCAGATGAAC<br>AGCCTGCGCGCCGAAGACACGGCCGTGTACTACTGCGCCCGGGATCCCCGGG<br>GCGCGACCCTGTACTACTATTACTACGGCATGGACGTGTGGGGCCAAGGGAC<br>CACCGTGACCGTGAGCAGCGCCAGCACCAAGGGCCCCTCCGTGTTCCCGCTG<br>GCCCCCTCCAGCAAGTCCACCAGCGGCGGCACCGCAGCCCTCGGCTGCCTGG<br>TGAAGGACTATTTTCCCGAGCCGGTGACCGTGAGTTGGAATAGCGGCGCCCT<br>GACCAGCGGCGTACACACCTTCCCCGCGGTGCTGCAGAGCTCCGGCCTGTAC<br>TCCCTGAGCAGCGTGGTGACCGTGCCCAGCTCCAGCCTCGGCACCCAGACCT<br>ACATCTGCAATGTGAACCACAAGCCGAGCAACACCAAGGTGGATAAGAGGGT<br>GGAGCCGAAATCGTGCGACAAAACGCACACCTGCCCCCCATGTCCCGCCCCC<br>GAACTCCTGGGCGGTCCCAGCGTGTTTCTGTTCCCACCCAAACCGAAGGACA<br>CCCTGATGATCTCCAGGACACCCGAGGTGACCTGCGTGGTGGTGGATGTGTC<br>CCACGAGGACCCCGAGGTGAAATTCAATTGGTACGTGGACGGCGTGGAGGTC<br>CACAACGCCAAGACCAAGCCCAGGGAGGAACAATACAACTCCACCTACAGGG<br>TGGTGTCAGTGCTGACCGTCCTGCACCAGGATTGGCTGAACGGCAAGGAGTA<br>CAAGTGCAAGGTGTCCAACAAGGCCCTGCCGGCACCCATCGAGAAAACCATC<br>AGCAAAGCCAAGGGCCAGCCCCGGGAACCCCAAGTGTACACCCTGCCCCCCA<br>GCCGGGAGGAAATGACCAAGAACCAGGTGAGCCTCACCTGCCTGGTCAAGGG<br>CTTCTACCCCAGCGACATAGCCGTGGAGTGGGAGAGCAACGGCCAGCCCGAA<br>AACAACTATAAGACCACCCCGCCCGTCCTGGACAGCGACGGCTCTTTTTTCC<br>TGTACAGCAAGCTGACCGTGGACAAGAGCCGATGGCAGCAGGGGAACGTCTT<br>CAGCTGCAGCGTGATGCACGAGGCCCTGCATAACCATTATACCCAGAAAAGC<br>CTCAGCCTGTCGCCCGGCAAG |
| 398 | Treme_HC_IgG1-CO11 | ATGGAGACACCCGCCCAGCTCCTCTTCCTTCTCTTGCTCTGGCTCCCCGACA<br>CGACCGGGCAGGTCCAGCTCGTCGAGTCGGGCGGAGGCGTCGTCCAGCCCGG<br>AAGGAGCCTCAGGCTATCCTGCGCCGCGAGCGGCTTCACCTTCAGCTCCTAC<br>GGTATGCACTGGGTCCGGCAGGCCCCCGGCAAGGGGCTCGAGTGGGTAGCCG<br>TCATCTGGTACGACGGCTCCAACAAGTACTACGCCGACAGCGTCAAGGGCCG<br>GTTCACCATCAGCAGGGACAACAGCAAGAACACCCTCTACCTGCAAATGAAC<br>AGCCTGAGGGCCGAAGATACCGCCGTGTACTATTGCGCCAGGGACCCCCGGG<br>GCGCCACACTATATTACTACTACTACGGCATGGACGTGTGGGGGCAGGGCAC<br>CACCGTGACCGTGTCTAGCGCGAGCACGAAGGGCCCCAGCGTGTTCCCCCTG<br>GCCCCCAGCTCAAAGAGCACTAGCGGCGGAACCGCCGCCCTGGGCTGCCTGG<br>TCAAGGACTATTTTCCGGAGCCCGTCACGGTGTCCTGGAACAGCGGCGCCCT<br>GACCAGCGGGGTGCACACCTTCCCCGCCGTGCTGCAGAGCAGCGGGCTCTAC<br>AGCCTGAGCAGCGTGGTCACCGTGCCTTCCAGCAGCCTGGGTACCCAGACCT<br>ACATCTGCAACGTGAATCACAAACCCAGCAACACCAAGGTGGACAAGAGGGT<br>GGAGCCCAAGAGCTGCGACAAGACGCACACCTGCCCGCCCTGTCCCGCCCCC<br>GAACTGCTGGGAGGCCCCTCCGTGTTCCTGTTCCCGCCCAAGCCAAAGGACA<br>CCCTGATGATAAGCAGGACCCCCGAGGTGACCTGCGTGGTGGTGGACGTGTC<br>CCACGAGGACCCCGAGGTTAAGTTCAACTGGTATGTGGACGGCGTGGAAGTG<br>CACAACGCCAAAACCAAGCCCCGGGAGGAGCAGTACAACAGCACCTATAGGG<br>TGGTGAGCGTGCTCACCGTGCTGCACCAAGACTGGCTGAACGGGAAAGAGTA<br>TAAGTGCAAGGTGAGCAATAAAGCGCTGCCCGCCCCGATCGAGAAGACCATC<br>AGCAAGGCCAAGGGCCAGCCCCGGGAGCCGCAAGTATACACCCTGCCGCCGT<br>CCCGGGAGGAGATGACCAAGAACCAGGTGAGCCTGACCTGCCTCGTGAAAGG<br>GTTTTACCCCAGCGACATCGCGGTGGAGTGGGAGTCCAACGGCCAACCCGAG<br>AACAACTACAAGACCACCCCACCCGTGCTGGACTCCGACGGATCCTTTTTCC<br>TCTACTCCAAGCTGACCGTGGATAAGTCCAGGTGGCAGCAGGGCAACGTGTT |

TABLE 3-continued

Optimized Tremelimumab and Ipilimumab Sequences

| SEQ ID NO | Description | Sequence |
|---|---|---|
| | | CAGCTGCAGCGTAATGCACGAGGCCCTGCACAATCATTACACGCAGAAAAGC<br>CTGTCTCTGAGCCCCGGCAAG |
| 399 | Treme_HC_IgG1-CO12 | ATGGAAACGCCAGCCCAGCTCTTATTCCTCCTCCTCCTCTGGCTCCCGGACA<br>CCACCGGCCAGGTCCAGCTCGTAGAGTCAGGGGGCGGCGTCGTCCAGCCCGG<br>CAGGTCCCTTCGCCTCTCCTGCGCCGCCAGCGGCTTCACCTTCAGCAGCTAC<br>GGCATGCACTGGGTCAGGCAGGCGCCCGGCAAGGGCCTCGAGTGGGTCGCCG<br>TCATCTGGTACGACGGCAGCAACAAATACTACGCCGACAGCGTCAAGGGCCG<br>GTTCACCATCAGCAGGGACAACAGCAAGAACACCCTCTACCTGCAGATGAAT<br>TCCCTGCGGGCTGAGGATACCGCGGTGTACTACTGCGCCCGCGACCCCAGGG<br>GCGCGACGCTGTACTACTACTACTACGGCATGGACGTGTGGGGGCAGGGGAC<br>CACCGTCACCGTGAGCAGCGCCAGCACCAAAGGGCCATCCGTGTTTCCCCTG<br>GCCCCGAGCTCCAAGAGCACCAGCGGCGGCACAGCCGCCCTGGGCTGTCTGG<br>TGAAGGACTATTTCCCGGAGCCCGTGACCGTGTCCTGGAACAGCGGCGCCCT<br>GACCAGCGGCGTGCACACGTTCCCCGCCGTGCTGCAAAGCTCCGGCCTGTAC<br>AGCCTGAGCAGCGTGGTGACCGTGCCCAGCAGCAGCCTGGGAACGCAGACCT<br>ACATCTGTAACGTGAACCATAAGCCCAGCAACACCAAGGTGGACAAACGCGT<br>CGAGCCCAAGAGTTGCGACAAGACCCACACCTGCCCTCCCTGTCCCGCCCCA<br>GAGCTCCTCGGGGGACCCAGCGTGTTCCTCTTTCCCCCTAAGCCCAAGGACA<br>CGCTGATGATTAGCAGGACTCCCGAGGTGACCTGCGTGGTGGTGGACGTGAG<br>CCACGAGGACCCAGAGGTGAAATTCAACTGGTATGTGGATGGCGTGGAGGTC<br>CACAACGCCAAAACCAAGCCCAGGGAGGAACAGTATAACAGCACCTACAGGG<br>TCGTATCCGTCCTGACCGTACTGCACCAGGACTGGCTGAACGGCAAGGAGTA<br>TAAGTGCAAAGTCAGCAATAAGGCCCTGCCCGCACCCATCGAGAAAACCATC<br>TCCAAGGCCAAGGGCCAGCCCAGGGAGCCCCAGGTGTATACCCTGCCCCCCA<br>GCAGGGAGGAGATGACCAAGAATCAGGTGAGCCTAACTTGCCTGGTGAAGGG<br>CTTTTACCCCAGCGACATCGCCGTGGAGTGGGAGTCCAACGGCCAGCCCGAG<br>AACAACTATAAGACCACCCCGCCCGTGCTGGACAGCGATGGCTCCTTCTTCC<br>TCTACAGCAAGCTGACCGTGGACAAGAGCAGGTGGCAGCAGGGCAACGTGTT<br>CTCCTGCAGCGTGATGCACGAGGCCCTGCATAATCATTACACCCAGAAGTCG<br>CTGAGCCTGAGCCCCGGTAAG |
| 400 | Treme_HC_IgG1-CO13 | ATGGAGACTCCAGCCCAACTCCTATTCTTGCTCCTTCTCTGGCTCCCCGACA<br>CCACCGGTCAGGTCCAGCTCGTCGAGAGCGGAGGCGGCGTTGTACAGCCCGG<br>CCGCAGCCTTCGACTAAGCTGCGCCGCCTCGGGCTTTACCTTCAGCAGCTAC<br>GGCATGCACTGGGTCAGGCAGGCCCCAGGCAAGGGGCTCGAGTGGGTAGCCG<br>TCATCTGGTACGACGGAAGCAATAAGTACTACGCGGACAGCGTTAAGGGCCG<br>GTTTACCATCAGCAGGGACAACAGCAAGAACACCCTCTACTTGCAGATGAAC<br>AGCCTGAGGGCGGAGGATACGGCCGTGTACTATTGCGCCAGGGATCCCCGGG<br>GCGCCACCCTGTACTACTACTATTACGGCATGGACGTGTGGGGCCAGGGCAC<br>CACCGTTACCGTGAGCTCGGCCAGCACCAAGGGGCCCAGCGTCTTCCCCCTG<br>GCCCCCAGCTCCAAGAGCACCAGCGGCGGGACCGCCGCCCTGGGCTGCCTGG<br>TGAAGGACTACTTCCCCGAGCCCGTGACGGTAAGCTGGAACAGCGGCGCCCT<br>GACCAGCGGCGTGCACACCTTCCCCGCCGTGCTGCAAAGCAGCGGCCTCTAC<br>TCCCTGAGTAGCGTGGTGACCGTGCCCAGCTCTAGCCTGGGCACGCAGACCT<br>ACATCTGCAACGTGAACCATAAACCCAGCAACACCAAAGTGGATAAGCGGGT<br>GGAGCCCAAGTCCTGCGACAAGACACACACCTGCCCGCCCTGCCCCGCCCCC<br>GAGCTGCTTGGCGGCCCCAGCGTCTTTCTGTTCCCGCCCAAGCCGAAGGACA<br>CACTCATGATCAGCCGTACCCCCGAGGTCACCTGCGTGGTGGTGGACGTGAG<br>CCACGAGGACCCCGAAGTCAAGTTCAACTGGTATGTGGACGGCGTCGAAGTC<br>CACAACGCCAAGACCAAGCCCAGGGAGGAGCAGTACAACAGCACCTACAGGG<br>TCGTCTCTGTGCTGACCGTACTGCACCAGGACTGGCTGAACGGCAAGGAGTA<br>CAAGTGCAAGGTGAGCAACAAGGCCCTGCCCGCCCCCATCGAGAAGACCATC<br>TCCAAGGCCAAGGGCCAGCCGAGGGAACCCCAGGTGTACACCCTGCCCCCCT<br>CCCGCGAGGAAATGACCAAAAACCAGGTGAGCCTGACCTGCCTGGTGAAGGG<br>GTTCTACCCCAGCGACATCGCCGTGGAGTGGGAGAGCAACGGCCAGCCCGAA<br>AACAACTACAAGACGACCCCGCCGGTGCTGGACAGCGACGGCAGCTTCTTCC<br>TGTACAGCAAGCTGACGGTGGACAAGAGCCGTTGGCAGCAAGGCAACGTGTT<br>CAGCTGCTCCGTGATGCACGAGGCGCTCCACAACCACTACACCCAGAAATCC<br>CTGAGCCTGTCGCCGGGGAAG |
| 401 | Treme_HC_IgG1-CO14 | ATGGAGACGCCCGCCCAGCTCCTCTTCCTCCTCCTCCTCTGGCTCCCCGACA<br>CCACGGGCCAGGTCCAGCTCGTCGAAAGCGGGGGCGGCGTCGTCCAACCCGG<br>ACGAAGCCTCCGGCTCTCCTGTGCCGCCTCGGGCTTTACATTCTCCAGCTAC<br>GGGATGCATTGGGTAAGGCAAGCCCCGGGGAAGGGCCTCGAGTGGGTCGCCG<br>TCATCTGGTACGACGGGAGCAATAAGTACTACGCAGACAGCGTCAAGGGCCG<br>GTTCACGATCTCCAGGGACAATTCCAAGAACACCCTCTACCTGCAGATGAAC<br>TCCCTGAGGGCCGAGGATACGGCCGTGTACTACTGCGCCCGGGACCCCAGGG<br>GAGCCACCCTGTATTACTACTACTACGGCATGGATGTGTGGGGCCAGGGGAC<br>CACGGTGACGGTGTCCAGTGCCAGCACAAAGGGCCCCAGCGTGTTCCCCCTG<br>GCCCCCAGCAGCAAGAGCACCAGCGGTGGGACCGCCGCGCTCGGCTGCCTGG<br>TGAAGGATTACTTCCCCGAGCCCGTGACCGTGAGCTGGAACTCCGGCGCCCT<br>CACGAGCGGGGTGCACACGTTCCCCGCGGTGCTGCAGAGCAGTGGCCTGTAC<br>TCCCTCAGCAGCGTGGTGACCGTGCCCAGCAGCTCACTGGGCACCCAGACCT<br>ACATCTGCAACGTGAACCACAAGCCCAGCAACACCAAAGTCGACAAGAGGGT |

TABLE 3-continued

Optimized Tremelimumab and Ipilimumab Sequences

| SEQ ID NO | Description | Sequence |
| --- | --- | --- |
| | | GGAGCCAAAAAGCTGCGATAAGACCCATACCTGTCCTCCCTGCCCCGCCCCC GAGCTGCTCGGCGGACCCAGCGTCTTCCTGTTCCCTCCCAAACCCAAGGACA CCCTGATGATCTCCAGGACCCCCGAGGTGACGTGCGTGGTCGTGGACGTGTC CCACGAGGACCCCGAGGTGAAGTTCAACTGGTATGTGGACGGCGTGGAGGTC CACAACGCCAAGACCAAACCCCGGGAGGAGCAGTATAACAGCACCTACAGGG TCGTGAGCGTGCTGACCGTGCTCCACCAGGACTGGCTGAACGGCAAGGAGTA CAAGTGTAAGGTTTCCAACAAGGCCCTGCCCGCCCCCATCGAGAAGACGATC TCCAAGGCCAAGGGCCAGCCCAGGGAGCCCCAGGTGTATACCCTGCCCCCCT CTAGGGAGGAGATGACCAAGAACCAGGTGAGCCTGACGTGCCTGGTGAAGGG CTTTTACCCCTCCGACATCGCCGTGGAGTGGGAGAGCAATGGTCAGCCCGAG AACAACTACAAGACCACCCCGCCCGTGCTGGACAGCGACGGCTCCTTCTTCC TGTACAGCAAGCTGACCGTGGACAAGTCCCGGTGGCAGCAGGGCAACGTGTT CAGTTGCTCTGTGATGCACGAGGCCCTGCACAACCACTACACCCAGAAAAGC TTATCCCTGAGCCCCGGCAAG |
| 402 | Treme_HC_IgG1-CO15 | ATGGAGACACCCGCCCAACTGCTCTTTTTACTCCTCCTCTGGCTCCCCGACA CCACGGGCCAGGTTCAGTTGGTCGAGTCCGGGGGCGGCGTCGTCCAGCCGGG CCGGAGCCTCCGCCTTTCCTGCGCCGCCTCCGGCTTCACCTTCTCCAGCTAC GGCATGCATTGGGTCCGCCAAGCCCCCGGGAAGGGGCTTGAGTGGGTCGCCG TTATCTGGTACGACGGGAGCAACAAGTATTACGCCGACTCCGTCAAGGGCAG ATTTACGATTAGCAGGGACAACAGCAAGAACACCCTTTACCTGCAGATGAAT TCCCTGCGGGCGGAAGACACCGCCGTGTACTACTGTGCCCGGGACCCCAGGG GCGCGACCCTCTACTATTACTACTATGGGATGGACGTGTGGGGGCAGGGCAC CACGGTGACCGTGAGCTCTGCCTCCACCAAGGGCCCCAGCGTATTCCCTCTG GCCCCCTCCAGCAAAAGCACCAGCGGCGGCACGGCCGCCTTGGGGTGCCTGG TGAAAGATTACTTCCCCGAACCCGTCACCGTGAGCTGGAACTCCGGCGCCCT GACCAGCGGGGTGCACACCTTCCCCGCCGTGCTGCAGTCCTCCGGGCTCTAC TCGCTGAGCAGCGTGGTGACCGTGCCCAGCTCCTCCCTGGGCACCCAGACCT ATATCTGCAACGTCAACCACAAACCCAGCAACACCAAGGTCGATAAGCGGGT GGAACCCAAGAGTTGCGACAAAACCCACACCTGCCCGCCCTGCCCCGCCCCA GAGCTGCTGGGAGGGCCCAGCGTGTTCCTCTTCCCTCCCAAGCCGAAGGACA CCCTCATGATCAGCCGCACCCCCGAAGTGACGTGTGTGGTGGTGGACGTGTC ACACGAGGACCCCGAGGTCAAGTTCAACTGGTATGTCGACGGCGTCGAGGTG CACAACGCCAAGACGAAGCCGAGGGAGGAGCAGTACAACAGCACCTACAGGG TGGTGTCCGTCCTGACCGTGCTGCACCAGGACTGGCTGAACGGCAAGGAGTA TAAGTGCAAGGTGAGCAATAAGGCCCTGCCCGCCCCCATCGAGAAGACCATC AGCAAGGCCAAGGGCCAGCCCCGGGAGCCCCAGGTGTACACACTCCCGCCCA GCAGGGAAGAAATGACCAAGAACCAGGTGAGCCTGACCTGTCTCGTGAAAGG CTTCTACCCCTCCGACATCGCAGTGGAGTGGGAGAGCAACGGGCAGCCGGAA AACAACTATAAGACGACGCCCCCGGTGCTGGATAGCGATGGCAGCTTTTTCC TGTACAGCAAACTGACCGTCGACAAGTCCAGGTGGCAGCAGGGCAACGTGTT CAGCTGCAGCGTGATGCATGAAGCCCTGCATAACCATTACACGCAGAAAAGC CTGAGCCTGAGCCCCGGCAAG |
| 403 | Treme_HC_IgG1-CO16 | ATGGAGACGCCCGCCCAGCTCCTTTTCCTCCTCCTCCTCTGGCTCCCAGATA CCACCGGCCAGGTCCAGCTCGTCGAGAGCGGCGGCGGAGTCGTCCAGCCCGG CCGCTCGCTTCGGCTTTCCTGCGCCGCCTCCGGGTTCACCTTCTCCTCGTAC GGTATGCACTGGGTCAGGCAGGCCCCCGGGAAAGGGCTCGAGTGGGTAGCCG TCATCTGGTACGACGGCAGCAACAAGTACTACGCCGACAGCGTAAAGGGGCG CTTCACCATCTCCAGGGACAACAGCAAGAACACGCTTTACCTGCAGATGAAC AGCCTGAGGGCCGAAGACACCGCCGTCTACTACTGCGCCCGGGACCCCAGGG GTGCCACCTTGTACTATTACTACTACGGGATGGACGTGTGGGGCCAGGGCAC GACCGTGACCGTGTCGAGCGCGTCCACCAAGGGCCCCAGCGTGTTCCCGCTG GCTCCCAGCTCCAAGAGCACCTCCGGGGGCACAGCGGCCCTGGGCTGCCTGG TGAAGGACTACTTCCCCGAGCCCGTGACGGTGAGCTGGAATTCCGGCGCCTT GACCAGCGGCGTCCACACCTTTCCCGCCGTGCTCCAAAGCAGCGGCCTGTAT AGCCTGAGCTCCGTGGTGACAGTCCCCAGCAGCAGCCTCGGCACCCAGACCT ACATATGCAACGTCAATCACAAACCCTCCAACACCAAGGTCGACAAACGGGT GGAGCCCAAAAGCTGCGACAAGACCCATACGTGCCCGCCCTGCCCCGCCCCC GAGCTGCTGGGCGGGCCCAGCGTATTCCTCTTCCCGCCGAAGCCCAAGGACA CCCTGATGATCAGCAGGACCCCGGAGGTGACGTGCGTGGTGGTCGACGTCTC CCACGAAGACCCCGAGGTGAAGTTCAATTGGTACGTGGATGGCGTGGAGGTG CACAACGCCAAGACGAAACCCAGGGAGGAGCAATATAACAGCACATACAGGG TGGTGTCCGTGCTGACCGTGCTGCACCAGGACTGGCTGAACGGCAAGGAGTA CAAGTGCAAGGTGAGCAACAAGGCCCTCCCCGCCCCCATCGAGAAGACCATC AGCAAGGCCAAGGGCCAGCCCAGGGAGCCCCAGGTGTACACCCTGCCACCCA GCAGGGAGGAGATGACGAAGAATCAGGTGAGCCTCACCTGCCTGGTGAAGGG CTTCTACCCCAGCGACATCGCCGTGGAGTGGGAGTCCAACGGCCAGCCCGAG AACAACTACAAGACGACCCCTCCCGTCCTGGACTCCGACGGGAGCTTCTTCC TGTACTCCAAGCTCACCGTGGACAAAAGCCGTTGGCAGCAGGGCAACGTGTT CAGCTGCAGCGTGATGCATGAGGCCCTGCACAATCACTATACCCAAAAGTCC CTCAGCCTGTCCCCCGGCAAG |
| 404 | Treme_HC_IgG1-CO17 | ATGGAGACTCCCGCCCAGCTTCTATTCCTACTCTTGCTCTGGCTCCCGGACA CCACCGGCCAGGTCCAGCTCGTGGAGTCCGGCGGAGGGGTGGTCCAACCCGG |

TABLE 3-continued

Optimized Tremelimumab and Ipilimumab Sequences

| SEQ ID NO | Description | Sequence |
|---|---|---|
| | | GCGGTCGCTCCGGCTCTCCTGCGCCGCCAGCGGTTTCACATTCAGCAGCTAC<br>GGGATGCACTGGGTTAGGCAGGCACCCGGCAAGGGCCTCGAGTGGGTCGCCG<br>TCATCTGGTACGACGGCAGCAACAAATACTACGCCGATAGCGTCAAAGGACG<br>CTTTACGATCAGCCGGGACAACTCCAAGAACACCCTCTACCTGCAGATGAAC<br>AGCCTGAGGGCGGAGGACACCGCCGTGTATTACTGCGCCAGGGATCCCAGGG<br>GCGCCACCCTGTACTACTACTATTACGGCATGGATGTGTGGGGCCAGGGGAC<br>GACGGTGACCGTGAGCTCCGCCTCCACCAAGGGCCCAAGCGTGTTCCCCCTG<br>GCCCCCAGCAGCAAGAGCACCAGCGGCGGGACCGCCGCCCTGGGGTGCCTGG<br>TGAAGGACTACTTCCCCGAGCCCGTGACGGTGTCCTGGAACTCCGGCGCGCT<br>GACCAGCGGGGTGCACACCTTCCCCGCCGTGCTGCAGAGCAGCGGCCTGTAC<br>AGCCTGTCCAGCGTGGTGACCGTGCCCTCCTCAAGCCTGGGCACCCAGACCT<br>ACATCTGCAACGTCAATCACAAACCTAGCAACACCAAAGTGGATAAGCGGGT<br>GGAGCCCAAATCATGCGACAAGACGCACACTTGTCCACCGTGCCCCGCCCCC<br>GAGCTCCTGGGTGGGCCCAGCGTGTTCCTGTTCCCTCCCAAGCCCAAGGACA<br>CGCTCATGATCTCGCGGACCCCTGAGGTGACCTGTGTGGTGGTGGACGTGAG<br>CCACGAGGATCCCGAGGTGAAGTTCAACTGGTACGTGGATGGCGTGGAGGTG<br>CACAACGCCAAGACCAAACCCCGGGAGGAACAGTACAACAGCACGTACCGGG<br>TGGTGAGCGTCCTGACCGTGCTGCACCAGGACTGGCTAAACGGCAAAGAGTA<br>CAAGTGTAAGGTGAGCAATAAGGCCCTGCCGGCCCCCATCGAGAAGACGATC<br>TCCAAGGCCAAGGGCCAGCCCCGGGAGCCGCAGGTGTACACCCTGCCCCCCA<br>GTAGGGAGGAAATGACCAAGAACCAGGTGAGCCTGACGTGTCTGGTGAAGGG<br>CTTCTACCCCTCAGACATCGCCGTGGAGTGGGAGAGCAACGGCCAGCCCGAG<br>AACAATTATAAGACCACCCCGCCCGTGCTGGATTCGGACGGCTCCTTTTTCC<br>TCTACAGCAAGCTGACCGTCGACAAGTCCCGATGGCAGCAGGGCAACGTGTT<br>CAGCTGCAGCGTGATGCACGAGGCGCTGCACAACCACTACACGCAGAAAAGC<br>CTGAGCCTCAGCCCCGGTAAG |
| 405 | Treme_HC_IgG1-CO18 | ATGGAGACACCCGCCCAGTTGCTTTTCCTCCTCCTTCTCTGGCTCCCCGACA<br>CCACCGGGCAGGTCCAGCTCGTCGAGAGCGGCGGCGGCGTCGTTCAGCCCGG<br>ACGGTCCCTCAGGCTCAGCTGCGCCGCCAGCGGTTTCACGTTTAGCAGCTAC<br>GGCATGCATTGGGTCAGGCAAGCGCCCGGCAAGGGGCTGGAGTGGGTCGCCG<br>TCATCTGGTACGACGGGAGCAACAAGTACTACGCCGACAGCGTCAAGGGCAG<br>GTTCACCATCAGCCGCGACAATAGCAAGAACACCTTATATCTGCAGATGAAC<br>AGCCTCAGGGCCGAGGACACGGCCGTCTACTACTGTGCCAGGGACCCCCGGG<br>GCGCCACCCTGTACTACTACTACTACGGCATGGATGTGTGGGGCCAAGGCAC<br>CACCGTGACCGTCAGCAGCGCGTCCACCAAAGGGCCCAGCGTATTCCCCCTG<br>GCCCCTTCCAGCAAGTCCACCTCCGGCGGCACCGCCGCCCTGGGCTGCCTGG<br>TGAAGGACTACTTCCCCGAGCCCGTCACCGTATCTTGGAACAGTGGCGCCCT<br>GACCAGCGGCGTGCATACCTTTCCCGCCGTGCTGCAATCCAGCGGACTGTAC<br>AGCCTGTCCTCCGTGGTTACCGTGCCCAGCAGCTCCCTGGGCACGCAGACCT<br>ACATCTGTAACGTGAACCATAAGCCCTCCAATACCAAGGTGGACAAGCGTGT<br>GGAGCCCAAGAGCTGCGACAAGACCCACACCTGTCCGCCCTGCCCCGCCCCG<br>GAGCTGCTGGGCGGCCCCAGCGTGTTCCTGTTCCCACCCAAGCCCAAGGACA<br>CCCTGATGATCAGCCGGACCCCCGAGGTGACCTGCGTGGTGGTGGACGTGAG<br>CCACGAGGACCCCGAGGTGAAATTCAACTGGTACGTGGACGGCGTGGAGGTG<br>CACAACGCCAAGACCAAGCCGAGGGAGGAGCAGTACAATTCCACCTACAGGG<br>TGGTGAGCGTGCTCACCGTGCTGCATCAGGACTGGCTGAATGGGAAGGAATA<br>CAAATGCAAAGTGAGCAACAAGGCTCTGCCCGCCCCCATTGAGAAAACAATC<br>AGCAAAGCCAAAGGCCAGCCCAGGGAGCCCCAGGTGTACACCCTGCCGCCGA<br>GCCGGGAGGAGATGACCAAGAACCAGGTGAGCCTGACCTGCCTGGTGAAGGG<br>CTTTTATCCCTCTGACATAGCCGTGGAGTGGGAGAGCAACGGGCAGCCCGAG<br>AACAACTACAAGACGACCCCGCCTGTGCTGGACTCCGACGGGTCCTTTTTTC<br>TGTATAGCAAGCTCACGGTGGACAAGTCCAGGTGGCAGCAGGGCAACGTGTT<br>CAGCTGCAGCGTGATGCACGAGGCCCTGCATAACCACTATACCCAGAAAAGC<br>CTGAGCCTGAGCCCCGGCAAG |
| 406 | Treme_HC_IgG1-CO19 | ATGGAGACGCCCGCCCAATTACTCTTTCTCCTCCTCCTTTGGCTCCCCGATA<br>CCACCGGGCAGGTACAACTCGTAGAGTCCGGCGGCGGCGTCGTTCAGCCCGG<br>CCGGTCCCTTCGGCTCAGCTGCGCGGCCTCCGGCTTTACGTTCAGCAGCTAC<br>GGCATGCATTGGGTACGGCAGGCCCCCGGCAAGGGCCTCGAGTGGGTCGCCG<br>TCATCTGGTACGACGGCAGCAATAAGTACTACGCCGATTCCGTCAAGGGAAG<br>ATTTACCATCAGCCGGGACAACTCCAAGAACACCCTCTACCTCCAGATGAAC<br>TCCCTGCGGGCCGAGGACACCGCCGTGTACTACTGCGCCAGGGACCCCCGGG<br>GCGCCACCCTGTACTACTACTACTACGGGATGGACGTGTGGGGCCAGGGCAC<br>CACCGTGACCGTCAGCAGCGCGAGCACGAAAGGGCCCAGCGTGTTCCCGCTG<br>GCCCCGTCCAGCAAGTCCACCAGCGGCGGCACCGCCGCCCTGGGTTGCCTCG<br>TGAAGGACTACTTCCCTGAGCCGGTGACCGTGTCCTGGAACTCCGGCGCCCT<br>GACCAGCGGAGTGCACACCTTCCCCGCGGTGCTGCAGAGCAGCGGGCTGTAC<br>AGCCTAAGCTCCGTAGTGACGGTCCCCTCCAGCAGTCTGGGGACCCAGACCT<br>ACATATGCAACGTGAACCACAAACCCTCGAACACCAAGGTGGATAAGAGGGT<br>CGAGCCCAAATCCTGCGACAAAACCCATACGTGCCCGCCCTGCCCCGCGCCC<br>GAGCTGCTGGGTGGGCCATCGGTGTTCCTGTTCCCCCCGAAGCCCAAGGACA<br>CACTGATGATCAGCCGGACCCCCGAAGTGACCTGCGTGGTGGTGGACGTGAG<br>CCACGAGGACCCGGAGGTGAAGTTCAATTGGTACGTGGATGGCGTGGAGGTT<br>CATAATGCCAAGACCAAGCCGCGGGAAGAACAGTATAACTCCACCTACCGGG |

TABLE 3-continued

| SEQ ID NO | Description | Sequence |
|---|---|---|
| | | TGGTGAGCGTGCTCACCGTCCTGCACCAGGACTGGCTGAATGGGAAGGAGTA CAAGTGCAAAGTGTCCAATAAAGCCCTTCCCGCCCCCATCGAGAAGACGATC AGCAAGGCCAAAGGACAGCCCCGGGAGCCTCAGGTGTACACGCTGCCCCCCA GCAGGGAGGAGATGACCAAGAACCAGGTGAGCCTGACCTGTCTGGTGAAGGG CTTCTACCCAAGCGATATCGCGGTGGAGTGGGAGTCCAACGGCCAGCCCGAG AACAATTACAAGACCACCCCGCCCGTGCTGGATTCCGACGGGAGCTTCTTCC TGTACAGCAAGCTGACCGTGGACAAGTCCCGGTGGCAGCAGGGAAATGTGTT CAGCTGTAGCGTGATGCACGAAGCCCTGCACAACCATTACACCCAGAAAAGC CTGAGCCTGAGCCCCGGCAAG |
| 407 | Treme_HC_IgG1-CO20 | ATGGAGACGCCCGCCCAGCTCCTCTTCCTCCTCCTCCTCTGGCTCCCGGACA CAACCGGGCAGGTACAGCTCGTCGAGTCCGGCGGGGGTGTCGTCCAGCCCGG GCGTTCCCTTAGGCTCAGCTGTGCGGCCTCCGGGTTCACCTTCAGCAGCTAC GGCATGCACTGGGTAAGGCAGGCCCCCGGTAAGGGGCTCGAGTGGGTCGCGG TCATCTGGTACGACGGGTCCAACAAGTACTACGCCGACTCCGTGAAGGGGAG GTTCACCATCTCCCGAGACAACAGCAAGAATACCCTCTACCTGCAAATGAAT TCCCTGCGGGCCGAGGATACCGCCGTCTACTATTGCGCCAGGGACCCCCGAG GCGCCACGCTGTACTACTACTACTACGGGATGGACGTGTGGGGGCAGGGCAC CACCGTGACCGTGAGCTCCGCCAGCACCAAGGGACCCTCCGTGTTCCCGCTC GCGCCCAGCTCCAAAAGCACCAGCGGCGGTACAGCCGCGCTGGGATGCCTCG TGAAGGACTACTTCCCCGAGCCCGTCACCGTGAGCTGGAATAGCGGAGCCCT GACGAGCGGCGTGCACACCTTCCCCGCCGTCCTGCAGAGCAGCGGCCTGTAC TCGCTCTCCTCGGTGGTGACCGTGCCCAGCAGCAGCCTGGGCACCCAGACCT ATATCTGCAATGTGAACCACAAGCCCAGCAACACCAAGGTTGACAAGCGGGT GGAGCCTAAGTCCTGCGACAAAACCCACACCTGCCCGCCCTGCCCCGCCCCC GAGCTGCTCGGCGGGCCCAGCGTGTTCCTGTTCCCGCCCAAGCCCAAGGACA CCCTGATGATCAGCCGCACCCCGGAGGTCACCTGTGTGGTGGTGGACGTGAG CCATGAGGACCCCGAGGTGAAGTTCAACTGGTATGTGGACGGGGTGGAGGTG CACAACGCCAAGACCAAACCGAGGGAGGAGCAGTACAACTCCACCTACAGGG TGGTGTCCGTCCTGACCGTGCTGCACCAGGATTGGCTCAACGGGAAGGAGTA CAAATGCAAGGTGAGCAACAAGGCCCTGCCCGCCCCCATCGAGAAGACCATC AGCAAGGCCAAGGGACAGCCCAGGGAGCCCCAGGTGTATACCCTCCCTCCCA GCCGTGAGGAAATGACCAAGAACCAGGTGAGCCTGACCTGTCTGGTCAAAGG GTTCTACCCCAGCGACATCGCCGTCGAGTGGGAAAGCAACGGCCAGCCCGAG AACAACTACAAGACCACGCCCCCCGTGCTGGACAGCGATGGCAGCTTTTTCC TGTACAGCAAGCTGACGGTGGACAAGTCGAGGTGGCAACAGGGCAACGTGTT CTCGTGCAGCGTGATGCACGAGGCCCTGCACAACCACTATACCCAGAAAAGC CTCAGCCTGTCCCCCGGCAAG |
| 408 | Treme_HC_IgG1-CO21 | ATGGAAACCCCCGCCCAACTCCTCTTCCTCTTGCTCCTCTGGCTCCCCGATA CGACCGGGCAGGTCCAGCTCGTCGAAAGCGGGGGAGGCGTGGTACAGCCCGG GCGTAGCCTCAGGCTCAGCTGCGCCGCCTCCGGGTTCACCTTTTCATCTTAC GGCATGCACTGGGTTCGGCAGGCCCCCGGCAAGGGCCTCGAGTGGGTCGCCG TGATCTGGTACGACGGCTCGAACAAGTACTACGCGGACTCCGTCAAGGGCAG GTTCACCATCAGCCGGGATAACTCCAAAAACACCTTATACCTGCAGATGAAC TCCCTCCGGGCCGAGGACACCGCCGTGTACTATTGCGCGCGCGATCCCAGGG GCGCGACCCTGTACTACTACTACTATGGCATGGACGTGTGGGGGCAAGGTAC CACCGTCACCGTCAGCAGCGCCAGCACCAAAGGCCCCTCGGTGTTCCCCCTG GCGCCCAGCAGCAAAAGCACCAGCGGGGGCACCGCGGCCCTGGGCTGCCTGG TCAAAGACTACTTCCCCGAGCCCGTGACCGTGTCCTGGAACAGCGGGGCCCT GACCAGCGGCGTGCACACCTTCCCGGCCGTGCTGCAGAGCAGCGGGCTGTAC AGCCTGAGCTCCGTGGTGACGGTGCCCTCCAGCAGCCTGGGGACACAGACGT ACATATGTAACGTGAACCATAAGCCCAGCAACACCAAAGTGGACAAACGCGT GGAACCCAAAAGCTGCGACAAGACCCACACTTGTCCCCCCTGCCCCGCCCCC GAGCTCCTGGGCGGGCCCAGCGTGTTCTTGTTCCCCCCGAAACCGAAGGACA CCCTGATGATTTCCCGGACCCCCGAAGTGACCTGCGTAGTCGTGGACGTGAG CCACGAGGACCCCGAGGTGAAGTTCAATTGGTACGTGGACGGCGTGGAGGTC CACAACGCCAAGACCAAGCCCCGGGAGGAGCAGTACAACTCCACCTATAGGG TCGTGAGCGTGCTGACCGTGCTGCACCAGGACTGGCTGAACGGCAAGGAGTA TAAGTGCAAGGTGTCCAATAAGGCCCTCCCCGCCCCCATCGAGAAGACCATA TCCAAGGCCAAGGGCCAGCCAAGGGAGCCGCAGGTGTACACCCTGCCGCCCT CGAGGGAGGAGATGACCAAAAATCAGGTGAGCCTGACCTGCCTGGTCAAGGG GTTCTACCCGAGCGACATCGCCGTGGAGTGGGAGAGCAACGGGCAGCCCGAG AACAACTACAAGACCACCCCTCCCGTCCTGGACTCCGACGGCAGCTTCTTCC TGTATTCCAAGCTGACCGTGGATAAGTCCAGGTGGCAGCAGGGCAACGTGTT CAGCTGTAGCGTGATGCATGAGGCCCTGCATAACCATTACACCCAGAAATCC CTGAGCCTGAGCCCGGGCAAA |
| 409 | Treme_HC_IgG1-CO22 | ATGGAGACGCCCGCCCAGCTCCTCTTCCTCCTCCTCTTATGGCTCCCCGACA CCACCGGCCAGGTCCAGCTCGTCGAGAGCGGGGGCGGGGTAGTCCAGCCCGG CAGGTCCCTCCGGCTTAGCTGTGCCGCCTCGGGGTTCACATTCAGCTCCTAC GGCATGCACTGGGTACGACAGGCACCGGGGAAGGGACTCGAGTGGGTCGCCG TTATCTGGTACGACGGCAGCAACAAGTACTACGCCGACAGCGTCAAAGGCAG GTTCACCATCAGCAGGGACAACAGCAAGAACACCCTATACCTGCAGATGAAT AGCCTGCGAGCCGAGGACACTGCCGTGTATTATTGCGCCAGGGATCCCCGGG |

TABLE 3-continued

| SEQ ID NO | Description | Sequence |
|---|---|---|
| | | GAGCCACGCTCTATTATTACTACTACGGGATGGACGTGTGGGGCCAGGGGAC CACCGTGACGGTGTCATCTGCCTCCACGAAGGGTCCGAGCGTGTTCCCGCTG GCCCCCAGCTCCAAGAGCACGAGCGGCGGCACCGCCGCCCTGGGCTGCCTGG TGAAGGATTACTTCCCCGAGCCCGTGACCGTGTCCTGGAATAGCGGCGCCCT GACCAGCGGCGTGCATACCTTCCCCGCCGTCCTGCAGAGCAGCGGCCTGTAC AGCCTGTCTTCCGTGGTCACCGTGCCCAGCAGCAGCCTCGGCACGCAGACCT ATATCTGCAACGTGAACCACAAACCGAGCAACACGAAGGTGGACAAGCGTGT GGAGCCCAAAAGCTGCGATAAGACCCACACGTGTCCCCCCTGCCCCGCCCCC GAGCTGCTGGGCGGGCCCAGCGTGTTCCTGTTCCCCCCGAAGCCCAAGGACA CCCTGATGATCTCCCGAACCCCCGAGGTGACCTGTGTAGTCGTCGATGTGAG CCACGAGGACCCGGAGGTGAAATTTAACTGGTACGTGGACGGGGTGGAGGTG CACAACGCGAAGACGAAGCCCCGAGAGGAGCAGTACAACAGCACCTACAGGG TGGTGAGCGTCCTGACCGTGCTGCACCAGGACTGGCTGAACGGGAAAGAGTA CAAGTGTAAAGTCAGCAACAAGGCCCTGCCCGCCCCCATCGAGAAGACCATC TCCAAGGCCAAGGGCCAGCCCCGCGAGCCCCAAGTGTACACCCTGCCCCCCA GCAGGGAGGAGATGACCAAGAACCAGGTGAGCCTGACGTGCCTGGTCAAGGG CTTTTACCCCTCCGACATCGCGGTCGAGTGGGAGAGCAATGGCCAGCCCGAG AACAACTACAAGACCACCCCGCCCGTGCTGGACTCCGACGGCAGCTTCTTCC TGTACAGCAAGCTGACCGTGGACAAGTCGCGGTGGCAACAAGGCAACGTGTT CTCCTGCTCGGTGATGCACGAGGCCCTGCACAACCACTACACCCAGAAAAGC CTGAGCCTCAGCCCCGGTAAG |
| 410 | Treme_HC_IgG1-CO23 | ATGGAGACACCCGCGCAGTTGCTATTCCTCCTACTCCTCTGGCTCCCCGATA CCACGGGCCAGGTCCAATTGGTAGAGTCCGGCGGCGGCGTAGTCCAGCCCGG CCGGTCCCTCAGGCTTTCCTGCGCCGCCTCGGGCTTCACCTTCTCCAGCTAC GGGATGCACTGGGTCCGGCAGGCCCCCGGGAAGGGCTTGGAGTGGGTCGCCG TCATCTGGTACGACGGAAGCAACAAGTACTACGCCGACTCCGTCAAGGGTAG GTTCACCATCAGCAGGGACAACTCGAAGAACACCTTGTATCTGCAGATGAAC TCCCTTAGGGCCGAGGACACGGCCGTGTACTACTGCGCCCGGGACCCTCGAG GAGCCACCCTGTACTACTATTACTACGGGATGGACGTGTGGGGGCAAGGGAC GACCGTTACCGTGAGCTCCGCCAGCACGAAGGGGCCCAGCGTCTTCCCACTG GCCCCTAGCAGCAAGAGCACCTCCGGCGGCACCGCCGCCCTGGGCTGCCTGG TGAAGGATTACTTCCCGGAGCCCGTGACCGTGAGCTGGAACTCCGGCGCGCT CACCAGCGGCGTCCACACCTTCCCCGCCGTGCTGCAGAGCAGCGGGCTGTAT TCGCTGAGCTCGGTGGTCACCGTTCCCAGCTCAAGCCTGGGGACCCAGACGT ATATCTGTAACGTGAACCACAAGCCCAGCAACACCAAGGTGGACAAAAGGGT CGAGCCCAAGAGCTGCGACAAGACCCATACATGTCCCCCCTGCCCCGCGCCC GAGCTGCTGGGGGGACCCAGCGTGTTCCTCTTTCCGCCCAAGCCCAAAGACA CCCTCATGATCAGCCGAACCCCCGAGGTCACCTGCGTGGTAGTAGACGTGAG TCACGAGGACCCGGAGGTGAAGTTCAATTGGTACGTGGACGGCGTGGAGGTG CACAACGCCAAGACCAAACCCCGTGAGGAGCAGTACAATAGCACCTACAGGG TCGTGAGCGTGCTCACCGTGCTCCACCAGGACTGGCTGAACGGCAAGGAGTA CAAATGCAAGGTGTCGAACAAGGCGCTCCCCGCCCCCATCGAAAAGACTATC TCCAAGGCTAAGGGCCAGCCCAGAGAGCCCCAGGTGTACACCCTGCCCCCGT CCCGGGAGGAAATGACCAAGAACCAGGTCAGCCTCACCTGCCTGGTGAAGGG CTTTTACCCCAGCGACATCGCAGTGGAGTGGGAGAGCAACGGTCAGCCCGAA AATAACTATAAGACCACCCCGCCCGTCCTGGACAGCGACGGAAGCTTCTTCC TGTACAGCAAGCTCACCGTGGACAAGTCCCGGTGGCAGCAGGGCAACGTATT TAGCTGCTCCGTGATGCACGAAGCCCTGCACAACCACTACACCCAGAAAAGC CTGTCCCTCAGCCCCGGCAAG |
| 411 | Treme_HC_IgG1-CO24 | ATGGAGACGCCCGCCCAGCTCCTCTTCCTCCTCCTCCTATGGCTACCCGACA CAACCGGGCAGGTCCAGCTCGTCGAATCCGGCGGCGGGGTAGTCCAGCCAGG TCGCTCCCTCAGGTTGTCCTGCGCCGCCTCCGGCTTTACGTTCAGCAGCTAC GGCATGCACTGGGTCCGACAGGCCCCCGGCAAGGGGCTCGAGTGGGTCGCCG TAATCTGGTACGACGGCAGCAACAAGTACTACGCCGACAGCGTCAAGGGAAG GTTCACCATCAGCAGGGACAATAGCAAGAACACCCTATACCTCCAGATGAAC AGCCTGAGGGCGGAGGACACCGCCGTGTACTACTGCGCCCGGGACCCCAGGG GAGCCACCCTGTATTATTACTACTATGGGATGGACGTGTGGGGCCAAGGCAC CACCGTGACCGTGTCCTCCGCGAGCACCAAGGGGCCCAGCGTGTTCCCCCTC GCGCCCTCCAGCAAGAGCACCAGCGGGGGGACCGCCGCCCTGGGGTGCCTGG TGAAGGACTACTTCCCCGAGCCCGTGACCGTCTCCTGGAACAGCGGCGCCCT GACGTCCGGCGTGCACACCTTCCCCGCCGTCCTGCAGAGCAGCGGCCTGTAC TCCCTGTCATCGGTCGTGACCGTGCCGTCCTCCTCCCTCGGCACCCAGACCT ACATCTGTAACGTGAACCACAAGCCCTCCAACACAAAGGTGGACAAACGGGT AGAGCCGAAGTCCTGTGACAAGACCCACACCTGCCCTCCCTGCCCCGCTCCC GAGCTGCTCGGCGGGCCCAGCGTCTTCCTCTTCCCTCCCAAGCCCAAGGACA CGCTAATGATCTCCCGCACCCCCGAGGTGACCTGCGTGGTGGTGGACGTGAG CCACGAGGACCCGGAGGTGAAGTTCAACTGGTACGTGGACGGCGTGGAGGTG CACAACGCCAAGACCAAACCCAGGGAGGAGCAGTATAATAGCACCTATAGGG TGGTGTCCGTGCTAACGGTGCTGCACCAGGACTGGCTCAACGGGAAGGAGTA CAAGTGCAAGGTCAGCAACAAGGCGCTGCCGGCCCCGATCGAGAAGACCATC TCGAAGGCCAAGGGGCAGCCTAGGGAGCCCCAGGTCTACACGCTGCCCCCCA GCAGGGAGGAAATGACCAAGAACCAGGTGTCCCTGACGTGCCTGGTGAAGGG TTTCTACCCCAGCGACATCGCCGTGGAGTGGGAGAGCAACGGCCAGCCCGAG |

TABLE 3-continued

| SEQ ID NO | Description | Sequence |
|---|---|---|
| | | AACAACTATAAGACCACCCCGCCCGTGCTGGACAGCGACGGGAGCTTCTTCC TCTATAGCAAGCTGACCGTGGACAAGAGCCGCTGGCAGCAGGGCAACGTGTT CTCCTGCTCCGTGATGCACGAGGCCCTGCACAACCACTACACGCAGAAATCC CTGTCCCTGAGCCCGGGCAAG |
| 412 | Treme_HC_IgG1-CO25 | ATGGAGACACCCGCCCAGCTCCTTTTCCTCCTCCTCCTCTGGCTCCCCGACA CCACCGGGCAGGTACAACTCGTCGAGTCCGGCGGCGGGGTCGTACAGCCCGG CCGGTCCCTCCGGCTCTCCTGCGCCGCCAGCGGCTTCACCTTCTCAAGCTAC GGGATGCATTGGGTCAGACAGGCCCCCGGTAAGGGGCTCGAGTGGGTTGCGG TCATCTGGTACGACGGCAGCAACAAGTACTACGCCGACAGCGTCAAAGGCCG GTTCACGATCAGCCGCGACAACAGCAAGAACACCCTCTACCTGCAAATGAAT TCCCTTAGGGCCGAGGATACGGCCGTCTATTACTGCGCCCGCGACCCGAGGG GCGCCACCCTGTATTATTACTACTACGGCATGGACGTGTGGGGCCAGGGCAC CACGGTGACCGTCTCCAGCGCCTCCACCAAGGGTCCCTCGGTGTTCCCCCTG GCGCCCAGCTCGAAGTCCACCAGCGGCGGGACCGCGGCCCTGGGATGTCTGG TCAAGGACTACTTCCCAGAGCCCGTGACCGTGTCCTGGAACTCAGGGGCCCT GACTTCCGGGGTGCACACCTTCCCGGCCGTGCTGCAAAGCTCGGGGCTGTAC AGCCTGAGCTCCGTGGTGACCGTCCCCAGCAGCAGCCTGGGCACCCAGACCT ACATCTGCAACGTGAACCACAAGCCCAGCAATACCAAGGTGGACAAGAGGGT GGAGCCCAAGTCCTGCGATAAGACGCATACCTGCCCGCCCTGTCCTGCCCCC GAACTGCTGGGAGGGCCCAGCGTGTTCCTCTTCCCACCCAAGCCCAAGGACA CCCTGATGATCTCCCGCACGCCCGAGGTGACCTGCGTGGTGGTGGACGTGAG CCACGAAGACCCCGAGGTGAAGTTCAACTGGTACGTCGATGGTGTGGAGGTA CACAATGCAAAGACGAAGCCCAGGGAGGAGCAGTACAATAGCACCTACAGGG TGGTGAGCGTGCTGACGGTCCTGCATCAGGACTGGCTGAACGGCAAGGAGTA CAAGTGCAAGGTCAGCAACAAGGCCCTGCCGGCCCCCATCGAGAAGACCATC AGCAAGGCCAAGGGCCAGCCGAGGGAGCCCCAGGTGTACACCCTGCCCCCCT CCAGGGAAGAGATGACCAAGAACCAGGTGTCCCTGACCTGCCTGGTGAAGGG GTTCTACCCCTCAGACATAGCTGTGGAGTGGGAGTCTAATGGGCAGCCCGAG AACAATTACAAGACCACCCCGCCCGTGCTGGACTCCGACGGCAGCTTCTTCC TCTACTCCAAACTGACGGTGGATAAGAGCCGATGGCAGCAGGGCAACGTGTT TTCCTGCTCCGTGATGCACGAGGCCCTGCACAACCACTACACCCAGAAGTCC CTCAGCCTGTCCCCCGGCAAG |
| 413 | IPI_LC (ipilimumab light chain) | METPAQLLFLLLLWLPDTTGEIVLTQSPGTLSLSPGERATLSCRASQSVGSS YLAWYQQKPGQAPRLLIYGAFSRATGIPDRFSGSGSGTDFTLTISRLEPEDF AVYYCQQYGSSPWTFGQGTKVEIKRTVAAPSVFIFPPSDEQLKSGTASVVCL LNNFYPREAKVQWKVDNALQSGNSQESVTEQDSKDSTYSLSSTLTLSKADYE KHKVYACEVTHQGLSSPVTKSFNRGEC |
| 414 | IPI_LC (signal peptide) | METPAQLLFLLLLWLPDTTG |
| 415 | IPI_LC (variable region, VL) | EIVLTQSPGTLSLSPGERATLSCRASQSVGSSYLAWYQQKPGQAPRLLIYGA FSRATGIPDRFSGSGSGTDFTLTISRLEPEDFAVYYCQQYGSSPWTFGQGTK VEIK |
| 416 | IPI_LC (constant region, CL) | RTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNR GEC |
| 417 | IPI_LC-CO01 | ATGGAGACTCCCGCCCAGCTCCTCTTCCTACTCCTCCTCTGGCTCCCCGACA CGACCGGCGAGATCGTCCTCACCCAGTCCCCCGGCACCCTCAGCCTCAGCCC CGGCGAGAGGGCCACCCTCTCGTGCAGGGCCAGCCAATCCGTAGGCAGCAGC TACCTAGCCTGGTACCAGCAGAAGCCGGGCCAAGCCCCAAGGCTCCTCATCT ACGGGGCCTTTAGCAGGGCCACCGGGATCCCCGACAGGTTCAGCGGGAGCGG GAGCGGGACGGACTTCACCCTCACCATCTCCCGCCTCGAGCCCGAGGACTTC GCTGTCTACTACTGCCAGCAATACGGCAGCTCCCCCTGGACATTCGGCCAGG GGACCAAGGTGGAGATCAAGAGGACCGTGGCGGCCCCCTCCGTGTTCATCTT CCCGCCCTCAGACGAGCAGCTGAAAAGCGGCACCGCCTCCGTGGTGTGCCTC CTCAACAACTTTTACCCCCGCGAGGCCAAGGTGCAGTGGAAGGTGGACAACG CCCTGCAGAGCGGTAACTCGCAGGAGAGCGTGACCGAGCAGGACAGTAAGGA CAGCACCTACAGCCTGTCCAGCACCCTCACCCTCAGCAAGGCCGACTACGAG AAGCACAAGGTGTACGCCTGCGAGGTGACCCACCAGGGGCTGAGCAGCCCCG TGACCAAGAGCTTCAACAGGGGGGAGTGT |
| 418 | IPI_LC-CO02 | ATGGAAACCCCCGCTCAGCTCCTCTTCTTACTCCTCCTCTGGTTGCCCGACA CCACGGGCGAGATCGTTCTCACCCAGTCCCCCGGGACCCTTAGCCTCAGCCC GGGGGAGAGGGCCACCCTCAGCTGCCGGGCCAGCCAGAGCGTTGGCAGCAGC TACCTCGCCTGGTACCAGCAGAAGCCCGGCCAGGCCCCGAGGCTCCTCATAT ACGGGGCCTTCTCCAGGGCGACCGGGATCCCCGACAGGTTCAGCGGCTCGGG CTCCGGGACCGACTTCACCCTCACCATCTCGAGACTCGAGCCGGAGGACTTC GCCGTGTACTATTGCCAGCAGTATGGCTCCTCCCCCTGGACCTTTGGACAGG GCACCAAGGTGGAGATCAAGAGGACCGTGGCCGCACCCAGCGTGTTCATCTT TCCACCGAGCGACGAGCAGCTGAAGTCCGGCACCGCCAGCGTGGTGTGCCTA |

Optimized Tremelimumab and Ipilimumab Sequences

TABLE 3-continued

| Optimized Tremelimumab and Ipilimumab Sequences | | |
|---|---|---|
| SEQ ID NO | Description | Sequence |
| | | CTCAACAACTTCTACCCCAGGGAAGCCAAGGTGCAGTGGAAAGTGGACAACG<br>CCCTGCAGAGCGGGAACTCCCAGGAGTCCGTGACCGAACAGGACTCCAAGGA<br>CAGCACGTACAGCCTCAGCAGCACCCTCACCCTGAGCAAGGCCGACTACGAA<br>AAACACAAGGTCTACGCCTGCGAGGTGACCCACCAGGGGCTGTCCTCCCCCG<br>TCACCAAAAGCTTTAACAGGGGCGAGTGC |
| 419 | IPI_LC-CO03 | ATGGAGACGCCCGCCCAGCTCCTCTTCCTCCTCCTCCTCTGGCTCCCCGACA<br>CCACCGGAGAGATAGTCCTCACGCAAAGCCCCGGCACTCTCTCCTTGAGCCC<br>CGGCGAGAGGGCCACCCTCTCCTGCCGGGCCAGCCAGAGCGTCGGTAGCAGC<br>TATTTGGCCTGGTACCAACAGAAGCCCGGCCAGGCGCCCCGCCTCTTGATCT<br>ACGGGGCCTTCAGCCGGGCGACGGGCATCCCGGACAGGTTTTCCGGGAGCGG<br>CAGCGGCACCGACTTCACCCTCACAATCAGCCGACTAGAACCAGAGGATTTT<br>GCCGTCTATTATTGCCAGCAGTACGGCTCGAGCCCCTGGACCTTCGGACAGG<br>GCACGAAGGTGGAAATCAAGCGTACCGTCGCCGCCCCCTCCGTGTTCATCTT<br>CCCGCCCAGCGACGAGCAACTCAAGAGCGGCACGGCCAGCGTGGTGTGCCTG<br>CTTAACAACTTCTATCCGCGGGAAGCCAAGGTGCAGTGGAAAGTTGATAACG<br>CCCTGCAATCCGGCAATAGCCAGGAGAGCGTCACCGAGCAGGACTCCAAGGA<br>CAGCACGTATAGCCTGAGCTCGACCCTGACCCTGAGCAAGGCTGACTACGAG<br>AAGCACAAGGTGTACGCCTGTGAGGTGACGCATCAGGGGCTGAGCTCGCCCG<br>TGACGAAGTCCTTCAACAGGGGCGAGTGC |
| 420 | IPI_LC-CO04 | ATGGAGACTCCGGCCCAACTCCTCTTCCTACTCCTCCTCTGGCTTCCCGACA<br>CCACCGGCGAGATAGTCCTCACCCAGAGCCCCGGCACACTCAGCCTCTCCCC<br>CGGCGAGAGGGCCACCCTCTCTTGTCGGGCCTCCCAGAGCGTCGGCTCGAGC<br>TACCTCGCCTGGTACCAGCAAAAGCCGGGCCAGGCGCCGAGGCTACTCATCT<br>ACGGCGCCTTCAGCCGCGCCACCGGCATCCCCGACCGGTTTAGCGGCAGCGG<br>CAGCGGCACCGACTTCACCCTCACCATAAGCAGGCTCGAGCCGGAGGACTTC<br>GCCGTGTACTACTGCCAGCAGTACGGCAGCAGCCCCTGGACCTTCGGCCAGG<br>GCACCAAGGTGGAGATCAAGCGCACCGTGGCCGCCCCCAGCGTGTTCATCTT<br>CCCACCCAGCGATGAGCAGCTCAAGAGCGGGACCGCCAGCGTCGTGTGTCTG<br>CTCAACAACTTCTATCCCCGGGAAGCCAAGGTGCAGTGGAAGGTGGACAACG<br>CCCTGCAGTCCGGGAATAGCCAGGAGTCCGTGACCGAGCAGGATAGCAAGGA<br>CTCCACGTACAGCCTCTCGAGCACCCTGACCCTCTCGAAGGCCGATTACGAA<br>AAGCATAAGGTCTACGCCTGTGAGGTGACCCACCAGGGGCTCTCCAGCCCCG<br>TGACGAAAAGCTTCAATAGGGGGGAGTGC |
| 421 | IPI_LC-CO05 | ATGGAAACCCCGGCCCAGCTCCTCTTCCTCCTCCTCCTCTGGTTGCCCGACA<br>CCACCGGAGAGATCGTTCTCACGCAGAGCCCCGGGACCCTATCGCTCTCGCC<br>CGGGGAGAGGGCCACCTTGTCCTGCCGGGCCAGCCAAAGCGTCGGCTCCAGC<br>TACCTCGCCTGGTATCAGCAGAAGCCCGGCCAGGCCCCGAGGTTGCTTATCT<br>ACGGGGCCTTCAGCCGGGCCACAGGCATACCCGACCGGTTCAGCGGGTCCGG<br>CAGCGGCACCGACTTCACCCTCACCATATCGAGGCTCGAGCCCGAGGACTTC<br>GCCGTGTATTACTGCCAGCAGTACGGCAGCTCGCCCTGGACCTTCGGCCAGG<br>GCACTAAAGTGGAGATCAAGAGGACGGTGGCCGCCCCCTCCGTGTTCATCTT<br>CCCGCCCAGCGATGAGCAGCTGAAAAGCGGCACCGCTAGCGTGGTGTGCCTC<br>CTCAACAACTTCTACCCCAGGGAGGCAAAGGTGCAATGGAAGGTGGATAACG<br>CCCTGCAATCCGGCAACAGCCAGGAGTCCGTGACCGAACAGGATAGCAAGGA<br>TTCGACGTACAGTCTGAGCAGCACCCTGACCCTGTCCAAGGCCGACTACGAG<br>AAGCACAAGGTGTACGCCTGCGAGGTGACCCACCAGGGCCTGTCGTCGCCCG<br>TGACCAAGAGCTTCAACCGGGGCGAGTGC |
| 422 | IPI_LC-CO06 | ATGGAGACGCCCGCCCAGCTCCTCTTCCTCCTCCTCCTCTGGTTGCCCGACA<br>CCACCGGCGAGATCGTCCTCACCCAATCCCCCGGGACCCTCTCCCTCTCCCC<br>AGGCGAGAGGGCCACGCTTTCCTGCAGGGCCTCGCAGAGCGTCGGCAGCTCC<br>TACCTCGCCTGGTATCAGCAGAAGCCCGGCCAGGCCCCGCGGCTATTGATCT<br>ACGGGGCCTTTAGCCGGGCCACCGGCATCCCCGACAGGTTCAGCGGCTCCGG<br>GAGCGGCACCGACTTCACGCTCACGATCAGCAGGCTCGAGCCGGAGGATTTC<br>GCCGTGTACTACTGCCAGCAGTACGGGAGCAGCCCGTGGACCTTCGGGCAAG<br>GCACGAAGGTCGAGATAAAGAGGACCGTGGCCGCCCCCAGCGTGTTCATCTT<br>CCCGCCCAGCGACGAGCAGCTGAAAAGCGGCACTGCCAGCGTGGTGTGTCTG<br>CTGAACAACTTCTACCCCCGGGAGGCCAAGGTCCAGTGGAAGGTGGATAACG<br>CCCTGCAGTCCGGCAACAGCCAGGAGAGCGTGACCGAGCAGGACTCCAAGGA<br>CTCCACCTACAGCCTGTCCAGCACCCTCACCCTCAGCAAGGCCGACTATGAG<br>AAGCATAAGGTCTACGCCTGCGAGGTGACCCACCAGGGCCTGAGCAGCCCAG<br>TGACCAAGTCCTTTAACCGCGGGGAGTGC |
| 423 | IPI_LC-CO07 | ATGGAGACTCCCGCCCAGCTCCTCTTCTTGCTACTCCTCTGGCTCCCGGACA<br>CCACCGGCGAGATCGTTCTAACGCAAAGCCCCGGCACCCTCAGCCTTAGCCC<br>GGGCGAGAGGGCCACCCTCTCCTGTAGGGCCAGCCAGTCCGTAGGGAGCTCC<br>TACCTCGCCTGGTACCAACAGAAGCCCGGCCAGGCCCCCAGGTTGCTTATTT<br>ACGGGGCCTTCAGCCGCGCCACCGGCATACCCGATAGGTTCAGCGGTAGCGG<br>CAGCGGGACCGATTTCACGCTCACCATCAGCAGGCTCGAGCCCGAGGACTTT<br>GCCGTGTATTACTGTCAACAGTACGGCAGCAGCCCCTGGACGTTCGGCCAGG<br>GCACCAAGGTGGAGATCAAGCGGACCGTGGCCGCCCCCAGCGTGTTCATCTT<br>TCCCCCCTCTGACGAGCAGCTGAAAAGCGGCACGGCCAGCGTGGTGTGCCTG |

TABLE 3-continued

Optimized Tremelimumab and Ipilimumab Sequences

| SEQ ID NO | Description | Sequence |
|---|---|---|
| | | CTGAACAATTTCTACCCCAGGGAGGCCAAGGTCCAGTGGAAAGTCGATAACG<br>CCCTGCAGTCCGGCAACAGCCAGGAGAGCGTCACCGAGCAGGATAGCAAGGA<br>CAGCACCTACAGCCTCAGCAGCACCCTGACCCTGAGCAAGGCCGACTACGAG<br>AAGCACAAGGTATACGCCTGCGAGGTGACGCACCAGGGGCTCAGCAGCCCCG<br>TGACCAAGAGCTTCAACCGGGGCGAGTGC |
| 424 | IPI_LC-CO08 | ATGGAGACACCCGCCCAGCTTTTATTCCTTCTCCTCCTATGGCTCCCCGACA<br>CCACCGGGGAGATCGTACTCACCCAGTCCCCGGGCACCCTCAGCCTCAGCCC<br>CGGCGAGAGGGCCACACTCTCCTGTCGGGCCTCTCAGAGCGTCGGAAGCTCC<br>TACCTGGCCTGGTACCAGCAAAAGCCCGGCCAGGCGCCCCGACTTCTCATCT<br>ACGGGGCTTTCTCCAGGGCCACGGGCATCCCCGACAGGTTTTCCGGCAGCGG<br>CAGCGGCACCGACTTCACGCTCACCATCTCGAGGCTAGAGCCCGAGGATTTC<br>GCCGTGTACTACTGCCAGCAGTACGGCAGCAGCCCGTGGACCTTCGGGCAGG<br>GCACCAAGGTGGAGATCAAGCGCACCGTGGCGGCCCCGAGCGTCTTCATCTT<br>CCCACCCAGCGACGAGCAGCTGAAAAGCGGGACCGCCAGCGTGGTGTGTCTG<br>CTCAACAATTTTTACCCCCGGGAGGCCAAGGTGCAGTGGAAGGTGGACAACG<br>CCCTGCAGAGCGGGAACTCGCAGGAGTCGGTCACCGAGCAGGACAGCAAGGA<br>CTCCACGTATTCCCTGTCCTCGACCCTGACCCTGTCAAAGGCCGACTATGAG<br>AAGCACAAGGTCTACGCCTGCGAGGTGACTCACCAGGGGCTGAGCAGCCCCG<br>TTACCAAATCCTTTAACAGGGGGGAGTGC |
| 425 | IPI_LC-CO09 | ATGGAAACCCCCGCCCAGCTACTCTTCCTCCTCCTCCTCTGGCTTCCGGATA<br>CAACCGGCGAGATCGTCCTCACCCAGTCCCCCGGGACCCTCAGCCTCTCCCC<br>CGGGGAAAGGGCGACCCTCAGCTGTCGGGCCAGCCAAAGCGTCGGGAGCAGC<br>TACCTCGCCTGGTACCAGCAGAAGCCCGGACAGGCCCCCCGCCTCCTCATTT<br>ACGGGGCGTTCAGCCGGGCCACCGGCATCCCCGACCGCTTCTCCGGGAGCGG<br>CAGCGGAACGGACTTCACGCTCACGATCAGCAGGCTCGAGCCGGAGGACTTT<br>GCCGTCTATTACTGTCAGCAATACGGTAGCTCCCCCTGGACCTTCGGCCAGG<br>GGACCAAGGTGGAAATCAAGCGGACCGTGGCCGCCCCGAGCGTGTTCATCTT<br>CCCGCCCAGCGACGAGCAGCTGAAAAGCGGTACCGCCTCCGTGGTGTGCCTG<br>CTGAACAACTTCTACCCAAGGGAGGCCAAGGTGCAGTGGAAGGTGGACAACG<br>CCCTCCAGAGCGGGAACTCTCAGGAGAGCGTCACCGAGCAGGATTCGAAGGA<br>CAGCACCTACAGCCTGTCCTCGACCCTGACCCTGTCGAAGGCCGACTACGAG<br>AAGCATAAAGTCTATGCCTGCGAAGTGACCCACCAGGGCCTCAGCAGCCCCG<br>TGACGAAGTCCTTCAACAGGGGGGAGTGC |
| 426 | IPI_LC-CO10 | ATGGAGACTCCCGCCCAGCTCCTCTTCCTCCTCCTCTTGTGGCTCCCGGACA<br>CCACCGGCGAAATAGTCCTCACCCAGAGCCCCGGCACCCTCAGCCTCTCCCC<br>AGGGGAACGGGCCACGCTAAGCTGCAGGGCCTCCCAGTCCGTCGGGAGCAGC<br>TATCTCGCGTGGTACCAGCAGAAGCCGGGGCAGGCCCCCCGGCTCCTCATAT<br>ACGGGGCCTTCAGTAGGGCCACGGGCATACCCGACAGGTTCAGCGGGTCCGG<br>CTCGGGCACGGACTTCACCCTGACCATTAGCCGGTTGGAGCCCGAGGACTTC<br>GCCGTATATTACTGCCAGCAGTACGGCTCCAGCCCCTGGACCTTCGGCCAGG<br>GGACCAAGGTGGAGATAAAGAGGACCGTCGCCGCCCCCAGCGTTTTCATCTT<br>CCCGCCCTCCGACGAGCAGCTGAAGTCCGGGACCGCCTCCGTGGTGTGCCTG<br>CTCAACAACTTCTACCCCAGGGAGGCCAAGGTCCAGTGGAAGGTAGACAACG<br>CCCTCCAGTCCGGGAACAGCCAGGAGAGCGTGACAGAACAGGACAGCAAGGA<br>CTCCACCTATTCCCTGTCTAGCACCCTGACCCTGAGCAAGGCCGATTACGAG<br>AAGCACAAGGTGTACGCCTGCGAAGTGACCCACCAGGGCCTCAGCTCCCCCG<br>TGACCAAGAGCTTCAACCGGGGCGAGTGC |
| 427 | IPI_LC-CO11 | ATGGAGACTCCCGCCCAGCTCCTCTTCCTCCTCCTCCTCTGGCTACCCGACA<br>CCACCGGCGAGATCGTCCTCACGCAGTCCCCCGGCACCCTCAGCTTGAGCCC<br>CGGGGAGCGGGCCACCCTCTCTTGCAGGGCCAGCCAGAGCGTCGGCTCCTCC<br>TACCTCGCCTGGTATCAGCAGAAACCAGGCCAGGCCCCCCGTCTCCTTATCT<br>ACGGCGCCTTCAGCCGCGCTACCGGAATCCCCGACCGGTTCAGCGGCAGCGG<br>TTCCGGCACAGATTTCACGCTCACCATTTCCAGGCTCGAGCCCGAGGACTTC<br>GCCGTGTACTACTGCCAGCAGTACGGCAGCTCGCCCTGGACCTTCGGACAGG<br>GGACCAAGGTGGAAATCAAGAGGACCGTGGCGGCCCCCTCCGTGTTTATCTT<br>CCCGCCCTCGGACGAGCAGCTAAAGAGCGGCACCGCCTCCGTGGTGTGCCTG<br>CTCAACAACTTCTATCCCCGGGAGGCCAAGGTGCAGTGGAAGGTGGACAACG<br>CCCTCCAGAGCGGAAACTCGCAGGAGAGCGTCACCGAGCAGGACTCCAAGGA<br>CTCGACTTACAGCCTGAGCTCCACCCTGACCCTCAGCAAGGCCGATTACGAG<br>AAGCACAAGGTCTACGCCTGCGAGGTGACCCACCAGGGACTGAGCTCCCCCG<br>TGACCAAGAGCTTCAACCGGGGGGAGTGC |
| 428 | IPI_LC-CO12 | ATGGAGACGCCCGCCCAGCTACTCTTCCTCCTCCTCCTCTGGCTCCCCGACA<br>CCACCGGGGAGATAGTCTTGACCCAGTCCCCCGGCACGCTTTCCCTCTCCCC<br>CGGGGAGAGGGCGACCCTCAGCTGTAGGGCCAGCCAGAGCGTTGGCAGCAGC<br>TACCTCGCCTGGTATCAGCAGAAGCCGGGCCAGGCCCCGAGGCTCCTCATCT<br>ACGGAGCTTTCTCCAGGGCCACCGGAATCCCCGACCGGTTCTCCGGCAGCGG<br>CAGCGGGACCGACTTCACCTTGACCATCTCCAGGCTCGAGCCCGAGGACTTC<br>GCCGTGTACTACTGTCAGCAGTACGGCTCATCGCCCTGGACCTTCGGGCAGG<br>GCACCAAGGTGGAAATCAAGAGGACGGTGGCCGCCCCTAGCGTGTTCATCTT<br>TCCCCCCAGCGACGAGCAGCTGAAAAGCGGCACCGCCTCCGTGGTCTGCCTG |

TABLE 3-continued

| Optimized Tremelimumab and Ipilimumab Sequences | | |
|---|---|---|
| SEQ ID NO | Description | Sequence |
| | | CTCAATAATTTCTACCCGCGTGAGGCCAAGGTGCAATGGAAAGTCGACAACG CCCTCCAGAGCGGCAACAGCCAGGAGAGCGTGACAGAGCAGGACAGCAAGGA CTCCACCTACAGCCTGTCCTCCACTCTGACCCTGTCGAAGGCCGACTACGAA AAGCACAAAGTCTACGCCTGCGAGGTCACGCACCAGGGGCTGAGTAGCCCCG TGACCAAATCCTTCAACAGGGGCGAGTGC |
| 429 | IPI_LC-CO13 | ATGGAGACTCCCGCCCAGCTCCTCTTTCTCCTCCTCCTCTGGCTACCCGACA CCACCGGCGAGATCGTCCTCACCCAGAGCCCCGGCACTCTCAGCCTCAGCCC CGGGGAGCGGGCCACCTTATCGTGCAGGGCCTCCCAATCCGTGGGAAGCAGC TACCTCGCGTGGTACCAGCAGAAGCCCGGCCAGGCCCCGCGGCTTCTCATCT ACGGAGCCTTTAGCAGGGCCACCGGCATCCCGGACAGGTTCTCAGGCAGCGG CAGCGGCACCGATTTTACCCTCACCATCAGCCGACTAGAACCGGAGGACTTC GCCGTGTACTACTGCCAGCAGTACGGCAGCTCACCCTGGACCTTCGGCCAGG GCACGAAGGTGGAAATCAAGCGCACCGTGGCCGCGCCCAGCGTGTTCATCTT CCCTCCCAGTGACGAACAGCTGAAGTCCGGGACCGCCTCGGTGGTCTGCCTG CTGAACAACTTTTATCCCAGGGAGGCCAAAGTGCAGTGGAAGGTGGATAACG CGCTGCAAAGCGGCAACAGCCAGGAGAGCGTCACCGAGCAGGACAGCAAGGA CAGCACCTACTCGCTGTCCTCGACCCTGACGCTGAGCAAGGCCGACTACGAG AAGCACAAGGTGTACGCCTGTGAGGTCACGCATCAGGGCCTCAGCAGCCCCG TGACCAAGAGCTTCAACCGGGGCGAGTGC |
| 430 | IPI_LC-CO14 | ATGGAGACGCCCGCACAGCTCCTCTTCCTCCTTCTCCTCTGGCTCCCCGACA CCACCGGCGAGATCGTCTTAACCCAGAGCCCCGGCACCCTCAGCCTTAGCCC CGGGGAGCGCGCCACCCTCTCCTGCCGCGCCAGCCAAAGCGTCGGCTCGTCC TATCTCGCCTGGTATCAACAGAAGCCCGGTCAGGCCCCCAGGCTCCTCATCT ACGGCGCCTTCAGCAGGGCCACCGGCATCCCGGACCGGTTCTCCGGCTCCGG CAGCGGCACCGACTTCACCTTGACGATCAGCAGGCTCGAGCCGGAGGACTTC GCCGTGTACTACTGCCAGCAGTATGGCAGCAGCCCCTGGACCTTCGGCCAGG GGACCAAGGTCGAGATCAAGAGGACCGTGGCGGCCCCCAGCGTGTTCATCTT CCCTCCCAGCGATGAGCAGCTCAAGAGCGGGACCGCCAGCGTGGTGTGCCTG CTGAACAATTTTTACCCCCGGGAGGCCAAGGTGCAGTGGAAAGTAGACAACG CCCTGCAGTCCGGGAACTCCCAGGAGTCGGTGACTGAGCAAGACAGCAAGGA CAGCACCTACAGCCTGTCCAGCACGCTCACCTTGTCCAAGGCGGACTATGAG AAGCACAAGGTGTACGCCTGTGAGGTGACCCATCAGGGCCTCTCCTCTCCCG TGACCAAGTCCTTCAATAGGGGGGAGTGT |
| 431 | IPI_LC-CO15 | ATGGAGACGCCCGCCCAGCTACTCTTCCTACTACTCCTCTGGCTCCCCGACA CCACCGGCGAGATCGTACTCACGCAGTCGCCGGGGACCCTCAGCCTCAGCCC CGGCGAGAGGGCCACCCTCTCCTGCAGGGCATCCCAGAGCGTCGGCTCCAGC TACCTCGCCTGGTACCAGCAGAAGCCCGGCCAGGCCCCCAGGCTCCTCATCT ACGGGGCGTTCAGCAGGGCCACCGGCATACCCGATAGGTTCTCCGGCTCCGG CTCCGGGACCGACTTCACCCTCACAATCAGCCGTCTCGAGCCCGAGGACTTC GCGGTGTACTACTGCCAGCAGTATGGGAGCTCCCCCTGGACGTTCGGCCAGG GGACGAAGGTCGAGATCAAGCGGACCGTCGCGGCTCCCAGCGTGTTTATCTT CCCGCCCAGCGACGAGCAACTGAAAAGCGGCACCGCCAGCGTGGTGTGCCTG CTGAACAACTTCTACCCCCGCGAGGCCAAGGTCCAGTGGAAGGTGGATAACG CCCTGCAGAGCGGGAACAGCCAGGAGAGCGTGACCGAGCAAGACAGCAAAGA CAGCACATACTCCCTGAGCAGCACCCTGACACTGAGCAAGGCCGACTATGAG AAGCACAAGGTGTACGCCTGTGAGGTGACGCACCAGGGCCTGAGCTCCCCCG TGACCAAGAGCTTCAACAGGGGCGAGTGC |
| 432 | IPI_LC-CO16 | ATGGAGACGCCCGCCCAGCTCCTCTTTCTTCTCCTCTTGTGGCTCCCCGACA CCACCGGGGAGATCGTACTCACGCAGTCGCCCGGCACACTCAGCCTCAGCCC AGGCGAGAGGGCCACCCTCTCCTGCAGGGCCAGCCAGTCCGTCGGCAGCAGC TACCTCGCCTGGTATCAACAGAAACCCGGGCAGGCCCCCCGGCTCCTCATAT ACGGGGCCTTCTCCAGGGCCACCGGGATCCCCGATCGTTTCTCCGGCAGCGG ATCGGGCACCGACTTCACGCTCACGATCTCCAGGCTCGAGCCAGAGGACTTC GCCGTGTACTACTGCCAGCAGTACGGCAGCAGCCCCTGGACCTTCGGTCAGG GCACCAAGGTGGAGATCAAGCGCACAGTGGCCGCCCCCTCCGTGTTCATCTT TCCGCCCAGCGATGAGCAGCTGAAGTCCGGGACGGCCAGCGTGGTGTGCCTG CTCAACAACTTCTACCCACGGGAGGCCAAGGTGCAATGGAAGGTGGACAACG CCCTGCAGAGCGGCAACAGCCAGGAATCCGTGACGGAGCAGGACTCCAAAGA CAGCACCTATTCCCTGAGCAGCACCCTGACGCTCTCCAAAGCCGACTATGAG AAGCACAAGGTGTACGCCTGTGAAGTCACCCACCAGGGGCTGTCGAGCCCGG TGACCAAGAGCTTCAACCGGGGCGAATGC |
| 433 | IPI_LC-CO17 | ATGGAGACACCCGCCCAGCTCCTCTTCCTCTTGCTGCTCTGGCTACCCGACA CCACCGGGGAGATCGTCCTCACCCAATCGCCCGGCACGCTCAGCCTCTCCCC CGGCGAGCGGGCCACCTTGAGCTGCCGGGCCAGCCAGAGCGTCGGATCCTCG TACCTTGCCTGGTACCAGCAGAAGCCCGGCCAGGCCCCCCGGTTGCTCATCT ACGGGGCGTTCAGCAGGGCCACCGGCATCCCCGACAGGTTCAGCGGCAGCGG CTCCGGGACCGACTTCACCCTCACCATCAGCCGTCTCGAGCCTGAGGACTTC GCCGTGTACTACTGCCAGCAGTACGGGTCCTCCCCCTGGACCTTCGGCCAGG GCACGAAGGTGGAGATCAAGCGGACCGTCGCCGCCCCCAGCGTGTTCATATT CCCCCCGAGCGATGAACAGCTGAAGTCCGGGACCGCTAGCGTGGTGTGCCTG |

TABLE 3-continued

Optimized Tremelimumab and Ipilimumab Sequences

| SEQ ID NO | Description | Sequence |
|---|---|---|
| | | CTGAATAACTTCTACCCCCGCGAGGCCAAGGTCCAGTGGAAGGTGGACAACG<br>CCCTGCAGAGCGGCAACAGCCAGGAGAGCGTGACCGAACAGGATAGCAAGGA<br>CAGCACCTACAGCCTGAGCAGCACACTGACCCTGTCCAAGGCGGACTACGAG<br>AAGCACAAGGTGTACGCCTGCGAGGTGACCCATCAGGGTCTGTCCAGCCCCG<br>TGACCAAAAGCTTCAATCGAGGCGAATGC |
| 434 | IPI_LC-CO18 | ATGGAGACGCCGGCGCAGCTTCTCTTCCTCCTTCTACTCTGGCTCCCAGACA<br>CCACAGGCGAGATCGTCCTCACCCAGAGCCCGGGAACCCTCAGCCTTTCCCC<br>AGGAGAGCGGGCGACCCTCAGCTGCAGGGCCAGCCAGAGCGTCGGCAGCAGC<br>TACCTCGCCTGGTACCAACAGAAGCCGGGCCAGGCGCCCAGGCTCCTCATCT<br>ACGGGGCCTTTTCCCGGGCCACCGGCATCCCCGATCGCTTCAGCGGCTCGGG<br>GAGCGGGACCGACTTCACCCTCACCATCAGCAGGCTTGAACCCGAGGACTTC<br>GCGGTGTACTATTGCCAGCAGTATGGGAGCAGCCCCTGGACCTTCGGCCAGG<br>GCACCAAAGTCGAGATCAAGAGAACCGTGGCCGCCCCCTCCGTGTTTATCTT<br>CCCGCCCTCGGACGAGCAGCTGAAGAGTGGCACCGCGAGCGTGGTCTGCCTC<br>CTGAACAACTTCTACCCGCGGGAGGCCAAGGTACAGTGGAAGGTGGACAATG<br>CGCTCCAATCCGGGAACTCCCAGGAGAGCGTGACCGAGCAGGACAGCAAGGA<br>TAGCACCTACAGCCTGAGCAGCACCCTGACCCTGAGCAAGGCCGACTACGAG<br>AAGCACAAAGTGTACGCGTGCGAGGTGACCCACCAGGGGCTCTCCAGCCCCG<br>TGACCAAGTCCTTTAACAGGGGGGAGTGC |
| 435 | IPI_LC-CO19 | ATGGAGACGCCCGCCCAGCTCCTTTTCCTCCTCCTCCTCTGGTTGCCCGACA<br>CCACCGGCGAAATCGTGCTCACGCAGAGCCCCGGCACGCTCAGCCTCAGCCC<br>CGGGGAGAGGGCCACGCTTAGCTGCCGCGCCAGCCAGAGCGTCGGCAGCAGC<br>TACTTAGCCTGGTACCAGCAGAAGCCCGGGCAGGCCCCCCGCCTTCTAATCT<br>ACGGCGCCTTTTCCCGCGCCACCGGCATCCCCGACAGGTTCAGCGGCAGCGG<br>CTCCGGCACCGACTTCACCTTGACGATCAGCAGGCTCGAGCCCGAGGATTTC<br>GCCGTGTACTACTGCCAGCAATACGGCAGCAGCCCCTGGACCTTCGGCCAGG<br>GGACCAAGGTGGAGATAAAGAGGACCGTGGCCGCCCCCAGCGTGTTCATCTT<br>CCCGCCCAGCGACGAACAGCTGAAAAGCGGCACGGCCTCGGTGGTGTGCCTC<br>CTGAACAACTTCTACCCCCGCGAGGCCAAGGTGCAGTGGAAGGTGGACAATG<br>CCCTGCAGAGCGGCAATTCGCAGGAGAGCGTGACCGAGCAGGACAGCAAGGA<br>TAGCACCTACAGCCTGTCAAGCACACTGACCCTCTCCAAAGCGGACTACGAG<br>AAGCACAAGGTGTACGCCTGCGAGGTGACCCACCAGGGCCTCAGCTCGCCCG<br>TGACCAAGAGCTTCAACCGCGGCGAGTGT |
| 436 | IPI_LC-CO20 | ATGGAGACTCCCGCCCAACTCCTCTTCCTCCTCCTCTTATGGCTCCCGGACA<br>CCACGGGCGAGATCGTCCTTACACAGAGCCCCGGGACCCTCAGCCTCAGCCC<br>CGGCGAGAGGGCCACGCTCAGCTGCAGGGCCTCCCAGTCCGTCGGGTCCAGC<br>TACCTGGCCTGGTACCAGCAGAAGCCCGGCCAAGCGCCCCGGCTTCTCATCT<br>ACGGAGCTTTCAGCCGGGCGACCGGCATACCGGACCGGTTCAGCGGGTCCGG<br>CTCGGGCACCGACTTCACCCTCACCATCAGCAGGCTCGAGCCCGAGGACTTC<br>GCCGTCTACTACTGCCAGCAGTACGGGTCCTCCCCCTGGACCTTCGGGCAGG<br>GCACCAAGGTGGAGATCAAGAGGACCGTCGCCGCCCCCAGCGTCTTCATCTT<br>TCCCCCCAGCGACGAGCAGCTGAAAAGCGGCACCGCCAGCGTGGTGTGCTTA<br>CTGAACAATTTCTATCCGAGGGAGGCCAAGGTGCAGTGGAAGGTGGACAACG<br>CCCTGCAGTCCGGGAACAGCCAGGAGTCAGTAACGGAACAGGACAGCAAGGA<br>CAGCACCTACAGCCTGAGCAGCACGCTGACGCTGTCGAAGGCCGACTACGAG<br>AAGCACAAGGTGTACGCCTGCGAGGTGACCCACCAGGGCCTGTCCAGCCCCG<br>TGACGAAGTCCTTCAATCGAGGAGAGTGC |
| 437 | IPI_LC-CO21 | ATGGAGACGCCGGCCCAGCTCCTATTCCTCCTCCTCCTCTGGCTCCCGGATA<br>CTACCGGCGAGATCGTCCTCACCCAGAGCCCCGGCACCTTGAGCTTGAGCCC<br>CGGCGAGAGGGCCACCCTCAGCTGCAGGGCCAAGCCAGAGCGTCGGCAGCAGC<br>TACCTCGCCTGGTACCAGCAAAAGCCCGGGCAGGCCCCTCGTCTCCTAATCT<br>ACGGGGCCTTTAGCAGGGCCACCGGGATCCCAGATCGGTTCTCGGGCTCCGG<br>GAGCGGCACCGACTTCACCCTCACCATCAGCCGGCTCGAGCCCGAGGACTTC<br>GCCGTGTACTACTGCCAGCAGTATGGCAGCAGCCCCTGGACCTTCGGGCAGG<br>GCACGAAGGTAGAGATCAAACGGACCGTGGCCGCCCCCTCCGTGTTCATCTT<br>CCCGCCCAGCGATGAGCAGCTGAAAAGCGGCACGGCCTCCGTGGTGTGCCTG<br>CTTAATAACTTTTACCCGAGGGAGGCAAAGGTACAGTGGAAGGTGGACAACG<br>CTCTGCAGTCCGGCAACAGCCAGGAGAGCGTCACCGAGCAGGATAGCAAGGA<br>TAGCACCTACTCACTGTCCAGCACGCTGACCCTGAGCAAGGCCGACTACGAG<br>AAACACAAGGTGTACGCGTGTGAAGTGACCCACCAGGGGCTGAGCAGCCCTG<br>TAACCAAGAGCTTCAACCGGGGCGAATGC |
| 438 | IPI_LC-CO22 | ATGGAGACTCCGGCCCAGCTCCTCTTCCTCCTCCTCCTCTGGCTCCCCGACA<br>CCACGGGCGAGATCGTCCTTACCCAGTCCCCGGAACCCTCAGCCTCAGCCC<br>GGGGGAGAGGGCGACCCTCAGCTGCAGAGCCAGCCAGAGCGTAGGTAGCAGC<br>TACCTCGCCTGGTACCAGCAGAAGCCCGGGCAGGCCCCCCGCCTCTTGATAT<br>ACGGGGCCTTTTCGCGGGCCACGGGGATACCCGACCGCTTCTCCGGATCCGG<br>CAGCGGCACCGACTTCACGCTCACGATCTCGAGACTCGAGCCGGAGGACTTC<br>GCGGTGTACTACTGCCAGCAGTACGGCAGCAGCCCCTGGACCTTTGGCCAAG<br>GCACCAAGGTGGAAATCAAGCGGACCGTGGCGGCCCCCAGCGTCTTTATCTT<br>CCCCCCGAGCGATGAGCAGCTGAAAAGCGGGACCGCCAGCGTGGTGTGCCTG |

TABLE 3-continued

| Optimized Tremelimumab and Ipilimumab Sequences | | |
|---|---|---|
| SEQ ID NO | Description | Sequence |
| | | CTGAATAACTTCTATCCCCGGGAGGCCAAAGTGCAGTGGAAAGTGGACAACG CGCTGCAATCCGGGAACTCCCAGGAGTCTGTGACCGAACAGGACAGCAAGGA CAGCACCTATAGCCTGTCCTCCACCTTAACGCTCAGCAAGGCCGACTACGAG AAACACAAGGTCTACGCCTGCGAGGTGACGCACCAAGGCCTGTCCAGCCCCG TGACCAAGAGCTTTAACAGGGGGGAGTGT |
| 439 | IPI_LC-CO23 | ATGGAGACACCGGCCCAGCTACTATTCCTCCTCCTCCTCTGGCTCCCCGACA CCACCGGCGAGATCGTCCTCACCCAGAGCCCCGGGACTTTATCCTTGTCCCC CGGCGAGCGCGCCACGCTCAGCTGCAGGGCCAGCCAGAGCGTCGGTTCGAGC TACCTCGCCTGGTACCAACAGAAGCCCGGCCAGGCCCCCAGGCTCCTAATCT ACGGGGCCTTTTCCAGGGCCACCGGCATCCCGGACAGGTTCAGCGGCAGCGG ATCCGGGACCGACTTTACCCTCACGATCTCGCGGCTTGAGCCCGAGGACTTC GCCGTGTACTACTGTCAGCAGTACGGCTCGAGTCCCTGGACCTTCGGCCAGG GGACCAAGGTGGAGATCAAGAGGACCGTGGCCGCCCCCAGCGTCTTCATCTT CCCGCCCAGCGACGAGCAACTGAAAAGCGGGACCGCGAGCGTCGTCTGCCTG CTGAACAACTTCTATCCCCGGGAAGCCAAGGTGCAGTGGAAGGTGGACAACG CGCTGCAAAGCGGGAACTCTCAGGAGTCCGTGACCGAGCAGGACAGCAAGGA CAGCACCTACTCCCTGAGCTCGACGCTGACCCTGAGCAAGGCCGACTACGAG AAACATAAGGTGTACGCCTGCGAGGTGACCCACCAAGGGCTGAGCTCGCCGG TGACCAAGAGCTTCAATAGGGGCGAGTGT |
| 440 | IPI_LC-CO24 | ATGGAAACCCCCGCCCAGCTCCTCTTTCTCCTCCTCCTCTGGCTCCCCGACA CCACCGGGGAGATCGTCCTCACCCAGTCCCCCGGCACCCTCAGCCTCAGCCC GGGCGAGCGGGCCACCTTATCCTGCAGGGCCAGCCAGAGCGTCGGCTCCAGC TATCTCGCCTGGTACCAGCAGAAGCCGGGCCAGGCCCCGCGTCTCCTCATCT ACGGGGCCTTCTCGAGGGCCACCGGGATTCCCGACAGGTTCAGCGGCTCGGG AAGCGGGACCGATTTCACCCTAACCATCAGCAGGTTAGAGCCCGAGGACTTC GCGGTGTACTACTGCCAGCAGTACGGCAGCTCCCCCTGGACCTTCGGACAGG GCACCAAAGTGGAGATCAAACGCACCGTGGCCGCCCCGTCCGTGTTCATCTT CCCGCCCTCCGACGAGCAGCTGAAATCTGGCACCGCCAGCGTGGTGTGCCTG CTAAATAACTTCTACCCCCGGGAGGCCAAGGTGCAGTGGAAGGTGGACAATG CCCTGCAGAGCGGGAACAGCCAGGAGAGCGTGACGGAGCAGGACAGCAAGGA CAGCACCTACAGCCTGTCCAGCACCCTGACCCTGTCCAAAGCCGATTACGAG AAGCACAAGGTGTACGCCTGCGAGGTCACCCACCAAGGCCTGAGCAGCCCCG TGACCAAGAGCTTCAACAGGGGCGAATGC |
| 441 | IPI_LC-CO25 | ATGGAGACTCCCGCGCAGCTCCTCTTCCTCCTCCTTCTCTGGCTTCCAGACA CCACGGGCGAGATCGTCCTCACCCAGAGCCCGGGCACCCTCAGCCTCTCCCC CGGCGAGAGGGCAACCCTAAGCTGCCGCGCGAGCCAGAGCGTAGGCAGCTCC TACCTCGCCTGGTACCAGCAGAAACCGGGGCAAGCCCCGCGGCTCCTCATCT ACGGGGCTTTCTCCAGAGCCACCGGCATCCCCGACCGCTTCAGCGGCAGCGG CAGCGGGACAGACTTTACCCTCACCATCAGCAGGCTCGAACCCGAGGACTTC GCCGTGTACTATTGCCAGCAGTACGGCTCCAGCCCCTGGACCTTTGGCCAGG GCACCAAGGTGGAGATCAAGAGGACCGTGGCCGCCCCCAGCGTGTTCATCTT CCCGCCCAGCGACGAACAGCTGAAAAGCGGGACCGCCAGCGTCGTGTGCCTG CTGAATAACTTCTACCCCAGGGAGGCCAAGGTGCAGTGGAAGGTGGACAACG CCCTCCAAAGCGGCAACAGCCAAGAGAGCGTCACCGAACAGGACTCCAAGGA CTCGACCTACTCCCTGTCCAGCACCCTGACCCTCAGCAAGGCGGACTACGAG AAGCACAAGGTGTACGCCTGCGAGGTCACCCACCAGGGCCTGAGCTCGCCCG TGACCAAGAGCTTCAACAGGGGTGAGTGC |
| 442 | IPI_HC (ipilimumab heavy chain) | METPAQLLFLLLLWLPDTTGQVQLVESGGGVVQPGRSLRLSCAASGFTFSSY TMHWVRQAPGKGLEWVTFISYDGNNKYYADSVKGRFTISRDNSKNTLYLQMN SLRAEDTAIYYCARTGWLGPFDYWGQGTLVTVSSASTKGPSVFPLAPSSKST SGGTAALGCLVKDYFPEPVTVSWNSGALTSGVHTFPAVLQSSGLYSLSSVVT VPSSSLGTQTYICNVNHKPSNTKVDKRVEPKSCDKTHTCPPCPAPELLGGPS VFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQP REPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK |
| 443 | IPI_HC (signal peptide) | METPAQLLFLLLLWLPDTTG |
| 444 | IPI_HC (variable region, VH) | QVQLVESGGGVVQPGRSLRLSCAASGFTFSSYTMHWVRQAPGKGLEWVTFIS YDGNNKYYADSVKGRFTISRDNSKNTLYLQMNSLRAEDTAIYYCARTGWLGP FDYWGQGTLVTVSS |
| 445 | IPI_HC (constant region) | ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKRVEPKSCD KTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSN KALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMH EALHNHYTQKSLSLSPGK |

TABLE 3-continued

Optimized Tremelimumab and Ipilimumab Sequences

| SEQ ID NO | Description | Sequence |
|---|---|---|
| 446 | IPI_HC-CO01 | ATGGAGACGCCGGCCCAGCTTCTCTTCCTACTTCTCCTCTGGCTCCCCGACA<br>CCACCGGCCAGGTCCAGCTCGTCGAGTCCGGCGGCGGGGTAGTCCAGCCCGG<br>GCGGTCACTTAGGCTCTCCTGTGCCGCAAGCGGCTTCACCTTCAGCTCCTAC<br>ACCATGCACTGGGTCCGGCAGGCGCCCGGGAAGGGCCTGGAGTGGGTCACCT<br>TTATCAGCTACGACGGGAACAACAAGTACTACGCGGATAGCGTCAAGGGGCG<br>CTTCACCATTAGCCGGGACAACAGCAAGAACACCCTCTACCTGCAGATGAAC<br>AGCCTGAGGGCCGAAGACACCGCGATATACTACTGCGCTAGGACCGGGTGGC<br>TGGGCCCCTTCGACTACTGGGGGCAGGGCACCCTGGTGACCGTCTCCAGCGC<br>CTCCACGAAGGGCCCCTCCGTGTTCCCCCTGGCCCCCTCCAGCAAGAGCACC<br>TCCGGCGGCACCGCCGCCCTGGGGTGTCTCGTCAAGGACTATTTTCCCGAGC<br>CCGTGACGGTCAGCTGGAACAGCGGGGCGCTCACCAGCGGCGTGCATACCTT<br>CCCCGCCGTGCTGCAGAGCAGCGGCCTGTACTCCCTGTCCAGCGTGGTGACC<br>GTCCCCTCGAGCAGCCTGGGCACGCAGACCTACATCTGCAACGTCAACCACA<br>AGCCCAGCAACACCAAAGTGGATAAGCGGGTGGAGCCCAAGAGCTGTGACAA<br>GACCCACACCTGCCCCCCGTGTCCCGCCCCCGAACTGCTCGGCGGGCCGAGC<br>GTGTTCCTGTTCCCTCCCAAGCCCAAGGACACCCTGATGATATCCCGGACGC<br>CCGAGGTCACCTGCGTGGTGGTGGACGTGAGCCACGAGGATCCTGAGGTCAA<br>GTTTAACTGGTACGTGGACGGCGTCGAGGTGCACAATGCCAAGACCAAGCCA<br>CGCGAGGAGCAATACAACAGCACCTACAGGGTGGTCAGCGTGCTGACCGTCC<br>TGCACCAGGACTGGCTGAACGGGAAGGAATACAAGTGCAAGGTGTCCAACAA<br>GGCCCTGCCCGCCCCGATTGAGAAGACCATCAGCAAGGCCAAGGGCCAGCCC<br>AGGGAACCCCAGGTGTATACCCTGCCCCCCAGCCGCGAGGAGATGACGAAGA<br>ACCAGGTAAGCCTCACCTGCCTCGTGAAGGGGTTCTACCCCTCCGATATCGC<br>CGTGGAGTGGGAGAGCAACGGCCAGCCCGAGAATAACTACAAGACTACCCCG<br>CCCGTGCTGGACTCCGACGGGTCCTTTTTCCTGTACTCCAAGCTGACCGTAG<br>ACAAGAGCCGGTGGCAGCAGGGCAACGTCTTCAGCTGCAGCGTGATGCACGA<br>GGCCCTGCATAACCACTATACCCAGAAAAGCCTGAGCCTGAGCCCCGGCAAG |
| 447 | IPI_HC-CO02 | ATGGAGACACCCGCCCAGCTCCTTTTCCTCCTCCTCCTCTGGCTCCCGGACA<br>CCACCGGCCAGGTCCAGCTCGTCGAGAGCGGCGGGGGAGTGGTCCAGCCGGG<br>CCGGAGCCTTCGGTTGTCCTGCGCCGCCAGCGGCTTCACGTTCTCCAGCTAC<br>ACCATGCACTGGGTCCGACAGGCCCCCGGCAAGGGCCTTGAGTGGGTCACCT<br>TCATCAGCTACGACGGCAATAATAAGTACTACGCCGACAGCGTCAAGGGGCG<br>GTTTACCATCAGCCGGGATAACAGCAAAAACACCCTCTACCTGCAGATGAAC<br>AGCCTGAGGGCCGAGGACACCGCCATCTACTACTGTGCCCGAACGGGGTGGC<br>TGGGCCCCTTCGATTACTGGGGCCAGGGGACGCTGGTGACTGTCAGCTCCGC<br>AAGCACCAAGGGCCCCAGCGTGTTCCCCCTGGCCCCCAGTTCAAAGTCCACC<br>AGCGGCGGCACCGCCGCGCTGGGGTGCCTGGTGAAGGACTACTTTCCGGAGC<br>CCGTGACCGTGAGCTGGAACAGCGGCGCCCTGACCAGCGGGGTCCACACCTT<br>CCCGGCCGTGCTGCAGAGCAGCGGCCTGTACAGCCTAAGCAGCGTGGTCACC<br>GTGCCCTCCAGCTCCCTCGGCACCCAGACCTACATCTGCAACGTCAACCACA<br>AGCCCTCAAACACCAAGGTGGACAAGCGGGTGGAGCCAAAGTCCTGCGACAA<br>AACCCACACATGCCCTCCCTGCCCCGCCCCTGAGCTGCTGGGCGGCCCCAGC<br>GTCTTCCTGTTCCCTCCCAAGCCCAAGGACACCCTGATGATCAGCCGGACCC<br>CCGAGGTGACCTGCGTGGTGGTGGACGTGAGCCACGAGGACCCGGAGGTCAA<br>GTTCAACTGGTACGTGGACGGCGTGGAGGTGCACAACGCCAAGACCAAGCCC<br>AGAGAGGAGCAGTACAACAGCACCTACAGGGTGGTGTCCGTCCTGACCGTGC<br>TGCACCAGGACTGGCTGAACGGCAAGGAGTACAAATGCAAGGTGTCGAATAA<br>GGCCCTCCCCGCCCCTATCGAAAAGACCATCTCCAAGGCCAAGGGCCAGCCC<br>AGGGAGCCCCAGGTGTACACCCTGCCCCCCAGCAGGGAGGAGATGACCAAGA<br>ACCAGGTGAGCCTGACCTGCCTGGTGAAGGGCTTCTACCCCTCCGACATCGC<br>CGTGGAATGGGAATCCAACGGCCAGCCCGAGAACAACTACAAGACCACACCC<br>CCCGTCCTGGACAGCGACGGCAGCTTCTTCCTGTATAGCAAGCTGACCGTCG<br>ACAAGAGCAGGTGGCAGCAGGGGAACGTGTTCAGCTGCTCCGTGATGCACGA<br>GGCCCTGCACAATCACTACACCCAGAAAAGCCTGAGCCTCAGCCCGGGCAAG |
| 448 | IPI_HC-CO03 | ATGGAGACGCCCGCCCAGTTGCTTTTCCTCCTCCTCCTCTGGCTTCCGGACA<br>CCACGGGCCAGGTCCAGTTGGTCGAAAGCGGCGGCGGCGTCGTCCAGCCCGG<br>GCGGTCCCTTCGACTCTCCTGCGCCGCCTCCGGCTTCACCTTCAGCTCCTAT<br>ACGATGCATTGGGTACGGCAGGCCCCAGGCAAGGGCCTCGAGTGGGTCACCT<br>TCATCTCATACGACGGCAACAACAAATACTACGCCGACAGCGTCAAGGGGCG<br>CTTCACCATCTCGCGGGACAACAGCAAAAACACCCTATACCTGCAGATGAAC<br>TCCCTGCGGGCCGAGGACACCGCCATCTATTACTGCGCCCGTACCGGATGGC<br>TGGGACCGTTCGACTACTGGGGCCAGGGGACGCTGGTGACCGTCAGCTCCGC<br>CAGCACCAAGGGGCCCAGCGTGTTCCCCCTGGCCCCCAGCTCCAAGAGCACC<br>AGCGGGGGCACCGCGGCCCTCGGTTGCCTGGTGAAGGATTACTTCCCCGAGC<br>CGGTGACCGTCAGCTGGAACTCCGGCGCCCTCACCAGCGGCGTGCACACCTT<br>TCCCGCCGTGCTGCAGAGCAGCGGCCTGTACAGCCTGAGCAGCGTGGTGACA<br>GTGCCCAGCAGCAGCCTGGGCACGCAGACCTACATTTGTAACGTGAACCACA<br>AACCCAGCAACACTAAGGTGGACAAGCGAGTGGAGCCCAAAAGCTGCGACAA<br>GACCCACACCTGCCCGCCCTGCCCGGCGCCCGAGCTGCTGGGGGGTCCCAGC<br>GTGTTCCTGTTCCCTCCCAAGCCCAAGGACACCCTGATGATCAGCAGGACGC<br>CGGAGGTGACCTGCGTGGTGGTGGATGTCAGCCACGAGGACCCCGAGGTCAA<br>GTTCAACTGGTATGTGGACGGGGTGGAGGTCCATAACGCGAAGACCAAGCCC<br>AGGGAGGAGCAATACAATAGCACCTACAGGGTGGTCAGCGTGCTGACCGTGC |

TABLE 3-continued

| SEQ ID NO | Description | Sequence |
|---|---|---|
| Optimized Tremelimumab and Ipilimumab Sequences | | |
| | | TGCACCAGGACTGGCTGAACGGCAAAGAGTACAAGTGCAAGGTGTCGAACAA<br>AGCCCTGCCCGCGCCCATCGAGAAGACCATCTCCAAGGCCAAAGGGCAGCCC<br>AGGGAACCCCAAGTGTACACCCTCCCGCCCTCCAGGGAGGAAATGACCAAGA<br>ACCAGGTCAGCCTGACCTGTCTGGTGAAGGGGTTCTACCCCTCCGACATAGC<br>CGTGGAGTGGGAATCCAACGGGCAGCCCGAAAACAACTACAAGACCACCCCG<br>CCCGTGCTGGATTCCGATGGCAGCTTCTTCCTCTACTCGAAGCTCACCGTCG<br>ACAAGTCCCGGTGGCAGCAGGGCAATGTGTTCAGCTGCAGCGTGATGCACGA<br>GGCCCTGCACAACCACTACACACAGAAAAGCCTCAGCCTGTCCCCCGGCAAG |
| 449 | IPI_HC-CO04 | ATGGAGACTCCCGCCCAGCTCCTATTCCTCCTCCTCCTCTGGCTCCCCGACA<br>CCACCGGGCAGGTCCAGCTCGTAGAGAGCGGAGGCGGGGTCGTTCAGCCCGG<br>CCGGAGCCTCCGGCTCAGCTGCGCCGCCTCCGGGTTTACCTTCTCCTCCTAC<br>ACCATGCATTGGGTCCGGCAGGCCCCCGGCAAGGGCCTAGAGTGGGTCACAT<br>TCATCAGCTACGACGGCAACAACAAGTATTACGCGGATAGCGTAAAGGGGAG<br>GTTCACCATCAGCAGGGATAATAGCAAGAACACCCTCTACCTGCAGATGAAT<br>AGTCTGCGAGCCGAGGACACGGCCATCTACTACTGCGCCAGGACTGGCTGGC<br>TGGGCCCGTTCGACTACTGGGGCCAGGGCACCCTCGTGACCGTGTCCAGCGC<br>CAGCACGAAGGGTCCCTCCGTGTTCCCCCTGGCCCCCTCCAGCAAGTCGACC<br>AGCGGGGGCACCGCCGCCCTGGGGTGCCTGGTGAAGGACTACTTCCCCGAGC<br>CCGTGACCGTGAGCTGGAACAGTGGCGCGCTGACCAGCGGCGTGCACACCTT<br>CCCCGCCGTGCTGCAGAGCAGCGGCCTGTACTCCCTGTCCAGTGTGGTGACC<br>GTGCCCAGCAGCAGCCTGGGCACCCAGACCTATATCTGCAACGTGAACCACA<br>AGCCCTCCAACACCAAGGTGGATAAGAGGGTGGAGCCCAAGTCCTGCGATAA<br>GACCCATACGTGCCCGCCCTGCCCCGCCCCCGAACTGCTGGGGGGCCCCAGC<br>GTCTTCCTGTTTCCCCCCAAACCCAAGGACACCCTGATGATCAGCAGGACCC<br>CCGAGGTGACCTGCGTGGTGGTGGACGTGAGCCACGAGGACCCCGAGGTAAA<br>GTTTAACTGGTACGTGGACGGGGTGGAGGTCCACAACGCCAAGACGAAGCCA<br>AGGGAGGAGCAGTACAACAGCACGTACCGGGTCGTGAGCGTCCTGACCGTCC<br>TCCATCAAGACTGGCTCAACGGCAAGGAGTACAAGTGCAAGGTGTCCAACAA<br>GGCCCTCCCCGCCCCCATCGAGAAGACCATCAGCAAAGCCAAGGGCCAACCC<br>CGGGAACCCCAGGTGTACACGCTCCCGCCCAGCAGGGAGGAGATGACCAAAA<br>ACCAGGTTAGCCTGACCTGCCTGGTGAAGGGGTTTTACCCCTCCGACATCGC<br>CGTTGAGTGGGAGAGCAATGGCCAGCCCGAAAACAACTACAAGACCACCCCG<br>CCCGTGCTCGACTCAGACGGTAGCTTCTTCCTGTACAGCAAACTGACCGTGG<br>ACAAGAGCCGCTGGCAGCAGGGCAACGTGTTTAGCTGCAGCGTGATGCACGA<br>AGCCCTGCACAACCATTACACGCAGAAAAGCCTCAGCCTGTCCCCGGGCAAG |
| 450 | IPI_HC-CO05 | ATGGAAACCCCCGCCCAGCTCCTCTTCCTCCTACTCTTGTGGCTCCCCGACA<br>CCACCGGCCAGGTTCAACTCGTGGAGAGCGGGGGCGGAGTCGTCCAGCCCGG<br>GAGGAGCTTACGGCTCAGCTGCGCCGCCTCGGGGTTCACGTTCTCAAGCTAC<br>ACCATGCACTGGGTCCGCCAGGCCCCCGGGAAGGGGCTCGAGTGGGTCACCT<br>TCATCAGCTACGACGGAAACAACAAGTACTACGCCGACTCCGTAAAGGGGAG<br>GTTCACGATCTCCAGGGACAATTCCAAGAACACCTTGTACCTGCAGATGAAT<br>AGCCTGCGCGCCGAGGACACCGCCATCTATTACTGCGCCAGGACCGGCTGGC<br>TGGGCCCATTCGACTACTGGGGGCAGGGGACCCTGGTGACCGTGTCGAGCGC<br>CAGCACCAAGGGGCCCAGCGTCTTCCCCCTGGCCCCCTCCAGCAAGAGCACC<br>TCCGGCGGCACCGCCGCCCTCGGGTGCCTGGTGAAGGACTACTTCCCCGAGC<br>CCGTCACGGTGTCCTGGAACAGCGGCGCCCTGACGAGCGGCGTGCACACCTT<br>CCCCGCCGTGCTGCAGTCAAGCGGCCTGTACAGCCTGAGCAGCGTGGTGACT<br>GTGCCCAGCTCCAGCCTGGGCACCCAGACCTATATCTGCAACGTGAACCACA<br>AACCCTCCAACACGAAGGTGGACAAAAGGGTGGAGCCCAAAAGCTGCGACAA<br>GACCCACACCTGTCCGCCGTGTCCCGCGCCCGAGCTGCTGGGGGGCCCCTCC<br>GTGTTCCTGTTTCCCCCCAAGCCCAAGGACACCCTGATGATAAGCAGGACGC<br>CCGAGGTGACCTGCGTGGTGGTGGACGTGAGCCACGAGGACCCCGAGGTGAA<br>GTTCAATTGGTACGTGGACGGCGTGGAGGTGCACAACGCCAAGACCAAGCCG<br>CGTGAAGAACAGTATAACTCCACCTACCGGGTGGTCAGCGTCCTGACCGTGC<br>TCCACCAGGACTGGCTCAACGGCAAGGAATACAAGTGCAAAGTAAGCAACAA<br>GGCTCTGCCCGCCCCCATCGAGAAGACGATCTCCAAAGCCAAAGGCCAGCCC<br>AGGGAGCCCCAGGTGTACACCCTCCCTCCCAGCAGGGAGGAGATGACCAAGA<br>ACCAGGTGAGCCTGACTTGCCTGGTCAAGGGTTTCTACCCAAGCGACATCGC<br>TGTGGAGTGGGAAAGCAACGGCCAGCCCGAGAATAACTACAAGACCACCCCG<br>CCCGTGCTGGACTCGGATGGGAGCTTTTTCTGTACTCCAAGCTGACCGTCG<br>ACAAGTCGCGTTGGCAGCAGGGCAACGTGTTCAGCTGCAGCGTGATGCACGA<br>GGCCCTGCACAATCACTACACCCAGAAATCGCTGAGCCTGTCGCCGGGCAAG |
| 451 | IPI_HC-CO06 | ATGGAGACTCCCGCCCAATTACTCTTCCTCCTCCTCCTCTGGTTACCCGACA<br>CCACCGGGCAGGTTCAGCTCGTAGAGAGCGGCGGGGGAGTCGTCCAGCCCGG<br>GCGTAGCCTCAGGCTATCCTGCGCCGCCAGCGGGTTCACCTTCAGCAGCTAC<br>ACCATGCACTGGGTCAGGCAGGCGCCCGGCAAGGGCCTCGAGTGGGTCACCT<br>TCATCAGCTACGACGGCAACAACAAGTACTACGCCGACTCCGTCAAGGGCAG<br>GTTCACCATCAGCCGCGACAACAGCAAGAACACCCTCTACCTGCAGATGAAC<br>TCCCTGAGGGCCGAGGACACCGCGATCTATTACTGCGCCAGGACCGGGTGGC<br>TGGGGCCCTTCGATTACTGGGGACAGGGGACTCTCGTGACCGTGAGCAGCGC<br>CAGCACGAAGGGCCCCAGCGTGTTCCCCCTGGCCCCCTCAAGCAAGAGTACC<br>TCCGGCGGGACCGCCGCGCTGGGGTGCCTCGTGAAGGACTACTTCCCCGAGC |

TABLE 3-continued

Optimized Tremelimumab and Ipilimumab Sequences

| SEQ ID NO | Description | Sequence |
|---|---|---|
| | | CGGTGACCGTGTCCTGGAACTCTGGCGCCCTGACCAGCGGGGTCCATACCTT<br>CCCCGCCGTGCTCCAGAGCAGCGGGCTGTACTCGCTCAGCAGCGTGGTGACC<br>GTGCCCAGCAGCAGCCTGGGGACCCAGACCTACATCTGCAACGTCAACCACA<br>AACCCAGCAACACCAAGGTGGACAAGCGTGTGGAGCCAAAGAGCTGCGACAA<br>GACCCACACCTGCCCGCCCTGCCCCGCCCCCGAGCTGCTGGGCGGCCCCTCG<br>GTGTTCCTCTTCCCACCCAAGCCCAAGGACACCCTGATGATCAGCAGGACCC<br>CCGAGGTGACCTGCGTGGTGGTGGATGTGAGCCACGAGGACCCGGAGGTGAA<br>GTTCAATTGGTACGTGGACGGCGTGGAGGTTCACAACGCCAAAACTAAGCCC<br>CGCGAGGAGCAGTATAACAGCACCTACCGGGTGGTGTCCGTGCTGACCGTCC<br>TCCATCAGGACTGGCTGAACGGGAAGGAGTACAAGTGCAAGGTGAGCAATAA<br>GGCGCTGCCCGCCCCCATCGAGAAGACCATCAGCAAGGCCAAGGGCCAGCCC<br>AGGGAGCCCCAGGTGTACACCCTGCCCCCCAGCCGGGAGGAGATGACAAAGA<br>ACCAGGTGAGCCTCACCTGCCTGGTCAAAGGCTTCTATCCCAGCGACATAGC<br>GGTGGAGTGGGAAAGCAATGGCCAGCCCGAGAACAACTACAAGACCACCCCG<br>CCCGTGCTGGACAGCGACGGCAGCTTCTTCCTGTACAGCAAGCTCACGGTGG<br>ACAAGAGCAGGTGGCAGCAGGGCAACGTGTTTAGCTGCAGCGTGATGCACGA<br>AGCCCTGCACAACCATTACACCCAGAAGAGTCTCAGCCTCTCCCCCGGCAAG |
| 452 | IPI_HC-CO07 | ATGGAGACACCCGCCCAGCTCCTCTTCCTCCTCCTCCTCTGGCTCCCCGACA<br>CGACCGGCCAAGTACAGCTCGTCGAGTCCGGGGGAGGCGTCGTTCAGCCCGG<br>CCGGAGCCTCAGGCTTAGCTGCGCCGCGAGCGGCTTCACCTTCAGCTCCTAC<br>ACCATGCACTGGGTCCGCCAGGCCCCCGGGAAGGGGCTCGAGTGGGTCACGT<br>TCATCAGCTACGACGGCAACAATAAGTACTACGCCGATTCCGTCAAGGGGCG<br>GTTCACCATCAGCCGGGATAACAGCAAGAACACCCTCTATCTGCAGATGAAC<br>AGCCTGAGGGCCGAGGATACCGCAATCTATTACTGCGCCCGCACCGGGTGGC<br>TGGGCCCGTTCGACTACTGGGGGCAGGGGACCCTGGTGACGGTGTCCTCCGC<br>CTCGACCAAGGGCCCCTCCGTGTTCCCGCTGGCCCCCTCGTCCAAGAGCACC<br>AGCGGCGGCACCGCTGCCCTGGGCTGTCTGGTCAAGGACTACTTTCCAGAGC<br>CCGTGACCGTGTCCTGGAATAGCGGGGCCCTGACCAGCGGAGTGCACACCTT<br>CCCCGCCGTCCTGCAATCCTCGGGCCTGTACTCCCTGAGCTCCGTAGTGACC<br>GTCCCCAGCAGCAGCTTAGGGACCCAGACCTATATCTGCAACGTGAACCACA<br>AACCCAGCAACACGAAGGTGGACAAGAGGGTAGAGCCCAAAAGCTGCGACAA<br>GACCCACACCTGCCCACCCTGCCCGGCCCCAGAGCTGCTCGGGGGCCCCAGC<br>GTGTTCCTGTTCCCGCCCAAGCCCAAGGACACACTGATGATCAGCAGGACTC<br>CAGAGGTCACCTGCGTGGTGGTGGATGTGTCCCACGAGGACCCGGAGGTGAA<br>GTTCAATTGGTATGTGGACGGCGTCGAGGTCCACAACGCCAAGACAAAGCCA<br>AGGGAGGAGCAATACAATAGCACCTACCGTGTCGTGAGCGTGCTGACAGTGC<br>TGCATCAGGACTGGCTCAACGGAAAGGAGTACAAGTGTAAGGTGTCCAACAA<br>GGCCCTGCCCGCCCCGATAGAAAAGACCATCAGCAAAGCCAAGGGCCAGCCC<br>AGGGAGCCGCAGGTGTATACCCTCCCGCCCAGCAGGGAGGAGATGACCAAGA<br>ACCAGGTGTCCCTGACCTGCCTGGTCAAGGGATTCTACCCCAGCGACATCGC<br>CGTGGAGTGGGAGAGCAACGGCCAACCCGAGAACAACTACAAGACCACTCCG<br>CCCGTGCTCGACAGCGATGGGAGCTTCTTCCTGTATAGCAAGCTGACCGTCG<br>ACAAGAGCAGGTGGCAGCAGGGCAATGTGTTTAGCTGTAGCGTCATGCACGA<br>AGCCCTGCACAACCACTATACCCAGAAATCCCTGAGCCTGAGCCCCGGGAAG |
| 453 | IPI_HC-CO08 | ATGGAGACGCCCGCCCAGCTCCTCTTCCTCCTCCTCCTCTGGCTACCCGACA<br>CGACCGGCCAGGTCCAGCTGGTGGAGAGCGGCGGCGGCGTAGTCCAGCCCGG<br>ACGGAGCCTCCGCCTCAGCTGCGCCGCCAGCGGCTTTACCTTCAGCAGCTAC<br>ACCATGCATTGGGTCAGGCAGGCCCCCGGGAAGGGCCTTGAGTGGGTAACAT<br>TTATCAGCTACGACGGCAACAACAAGTATTACGCCGACAGCGTCAAGGGCCG<br>CTTCACCATTTCCCGAGACAACAGCAAGAACACCCTCTATCTGCAGATGAAC<br>AGTCTGCGCGCGGAGGACACCGCGATCTACTACTGCGCCCGCACCGGTTGGC<br>TCGGGCCGTTCGATTACTGGGGCCAGGGGACCCTGGTGACCGTGAGTTCCGC<br>CAGCACGAAGGGGCCGAGCGTGTTTCCCCTGGCCCCCAGCAGCAAGAGCACG<br>AGCGGCGGCACCGCCGCCCTGGGGTGCCTGGTGAAGGACTACTTCCCGGAAC<br>CCGTGACCGTGAGCTGGAACAGCGGGGCCCTGACCAGCGGCGTGCACACCTT<br>CCCCGCCGTGCTGCAGAGCAGCGGGCTGTACTCCCTGAGCTCTGTGGTGACG<br>GTCCCCAGCAGCAGCCTGGGCACCCAGACCTACATCTGCAATGTGAACCACA<br>AGCCTAGCAACACCAAGGTGGACAAGCGGGTCGAGCCCAAGAGTTGCGACAA<br>GACCCACACCTGCCCTCCCTGCCCAGCCCCCGAACTGCTGGGGGGCCCCAGC<br>GTGTTCCTCTTCCCACCCAAGCCCAAGGACACGCTGATGATCAGCAGGACGC<br>CCGAGGTGACCTGCGTCGTGGTCGACGTGAGCCACGAGGACCCCGAAGTGAA<br>ATTCAACTGGTACGTGGACGGCGTGGAGGTGCATAACGCCAAAACCAAACCC<br>CGGGAGGAGCAGTACAACTCCACCTATAGGGTCGTGTCGGTGCTCACCGTGC<br>TGCATCAGGATTGGCTGAACGGCAAGGAATATAAGTGCAAAGTGAGCAACAA<br>GGCCCTGCCCGCACCGATCGAGAAAACGATCAGCAAAGCCAAGGGCCAGCCC<br>AGGGAGCCCCAGGTGTATACGCTGCCGCCCAGCCGGGAAGAGATGACTAAGA<br>ACCAGGTGTCCCTGACCTGCCTGGTGAAGGGCTTCTACCCTAGCGACATCGC<br>GGTCGAGTGGGAGAGCAACGGCCAGCCCGAGAACAACTATAAGACGACTCCC<br>CCCGTGCTGGACAGCGACGGCTCCTTTTTCCTGTATAGCAAACTGACCGTGG<br>ACAAGAGCAGGTGGCAGCAGGGGAACGTGTTCTCGTGCAGCGTGATGCATGA<br>GGCCCTGCATAACCACTACACCCAGAAGTCGCTGAGCCTGTCCCCCGGCAAG |

TABLE 3-continued

Optimized Tremelimumab and Ipilimumab Sequences

| SEQ ID NO | Description | Sequence |
|---|---|---|
| 454 | IPI_HC-CO09 | ATGGAGACACCCGCCCAGTTGCTGTTCCTCCTCCTCCTCTGGCTCCCGGATA<br>CCACGGGGCAGGTACAACTAGTCGAGAGCGGGGGCGGCGTCGTCCAGCCCGG<br>CAGGAGCCTCCGGCTCAGCTGCGCCGCCTCCGGGTTCACCTTCAGCTCCTAC<br>ACCATGCACTGGGTCAGGCAGGCCCCCGGGAAAGGGTTGGAGTGGGTCACCT<br>TTATCAGCTACGACGGGAACAACAAGTACTACGCCGACAGCGTCAAGGGCCG<br>GTTCACCATTAGCCGGGACAACTCCAAGAACACCCTTTACCTGCAGATGAAC<br>TCCCTGCGGGCCGAGGACACCGCAATCTACTACTGCGCCAGGACCGGCTGGC<br>TGGGGCCCTTCGATTACTGGGGACAGGGCACCCTCGTGACCGTGTCCAGCGC<br>CAGCACCAAGGGCCCCAGCGTCTTTCCCCTGGCCCCCAGCAGCAAGAGCACC<br>AGCGGCGGCACGGCCGCCCTGGGCTGCCTGGTCAAGGACTACTTCCCCGAGC<br>CCGTGACCGTGTCCTGGAACAGCGGCGCCCTGACCTCCGGCGTGCACACCTT<br>CCCGGCCGTGCTGCAGAGCAGCGGCCTCTACTCCCTCTCCTCCGTGGTGACC<br>GTGCCCAGCAGCAGCCTGGGCACCCAGACCTATATCTGCAACGTGAACCACA<br>AGCCATCGAACACCAAAGTGGATAAAAGGGTGGAGCCCAAAAGCTGCGATAA<br>GACCCACACCTGTCCCCCCTGCCCGGCCCCCGAGCTGCTGGGCGGGCCCTCA<br>GTGTTCCTGTTCCCACCCAAGCCCAAGGACACCCTGATGATCAGCAGGACCC<br>CCGAAGTCACATGCGTGGTGGTCGACGTGTCCCACGAAGACCCCGAGGTGAA<br>ATTCAATTGGTACGTGGACGGCGTGGAGGTCCACAACGCCAAGACCAAGCCC<br>CGTGAAGAACAATATAACTCCACGTATAGGGTGGTGTCCGTGCTGACGGTGC<br>TGCATCAGGACTGGCTGAACGGCAAGGAGTACAAGTGCAAGGTGAGCAACAA<br>GGCCCTGCCGGCCCCCATCGAGAAAACCATCTCCAAAGCCAAGGGGCAGCCC<br>CGCGAGCCCCAGGTCTATACGCTGCCCCCCAGCAGGGAAGAGATGACCAAGA<br>ACCAGGTCAGCCTGACCTGCCTGGTGAAGGGCTTTTACCCCAGCGACATCGC<br>CGTCGAATGGGAGTCGAACGGGCAACCGGAGAACAACTACAAGACCACCCCT<br>CCCGTGCTGGACAGTGACGGGAGCTTCTTTCTCTACTCCAAGCTGACCGTCG<br>ACAAGTCCCGGTGGCAACAGGGAAACGTGTTTTCCTGCAGCGTGATGCATGA<br>GGCCCTCCATAATCACTACACCCAGAAGTCCCTGAGCCTGAGCCCTGGGAAG |
| 455 | IPI_HC-CO10 | ATGGAAACCCCGGCCCAGCTCCTCTTCCTCTTACTCTTGTGGCTCCCCGACA<br>CCACCGGGCAGGTCCAGCTCGTTGAGAGCGGGGGCGGCGTCGTACAGCCGGG<br>GCGAAGCCTCCGGCTCTCCTGTGCCGCGAGCGGCTTCACCTTCAGCAGCTAC<br>ACGATGCACTGGGTCAGGCAGGCCCCCGGGAAGGGTCTGGAGTGGGTAACGT<br>TCATCAGCTACGACGGAAACAATAAGTACTACGCGGATTCCGTGAAGGGCCG<br>CTTCACCATAAGCAGGGATAACTCCAAGAACACCCTCTACCTGCAGATGAAT<br>TCCCTGCGCGCCGAGGACACCGCCATCTACTACTGCGCCAGGACAGGCTGGC<br>TGGGCCCCTTCGACTATTGGGGCCAAGGCACCCTGGTGACGGTGTCCAGCGC<br>GAGCACCAAGGGCCCCTCCGTGTTCCCGCTGGCGCCCAGCTCCAAAAGCACC<br>AGCGGGGGCACCGCCGCCCTGGGCTGCTTGGTGAAGGACTACTTCCCCGAGC<br>CCGTGACCGTAAGCTGGAACAGCGGCGCCCTGACCTCCGGCGTGCACACGTT<br>CCCCGCGGTGCTCCAAAGCTCCGGCCTCTATTCCCTGAGCAGCGTGGTGACC<br>GTGCCCAGCAGCTCGCTGGGCACCCAGACTTACATCTGCAATGTGAACCACA<br>AGCCCAGCAACACGAAGGTGGACAAGAGGGTCGAGCCCAAGAGCTGCGACAA<br>GACCCATACCTGTCCCCCCTGTCCCGCCCCCGAACTGCTCGGCGGCCCCTCC<br>GTGTTCCTGTTCCCTCCTAAACCCAAGGACACCCTGATGATCAGCAGGACGC<br>CCGAAGTGACCTGTGTGGTGGTGGATGTGAGCCACGAGGATCCCGAGGTGAA<br>GTTCAACTGGTACGTCGACGGGGTGGAGGTCCACAACGCCAAGACCAAGCCC<br>CGGGAGGAGCAATACAATAGCACCTACAGGGTGGTCAGCGTGCTGACCGTGC<br>TGCATCAGGACTGGCTGAATGGCAAGGAGTACAAGTGCAAGGTGAGCAACAA<br>GGCCCTGCCCGCCCCCATCGAGAAGACGATCTCAAAGGCCAAGGGCCAACCC<br>AGAGAGCCCCAGGTGTACACCCTGCCGCCCTCCAGAGAGGAGATGACGAAGA<br>ATCAGGTGTCCCTGACCTGCCTGGTGAAGGGATTCTACCCCAGCGACATCGC<br>CGTGGAGTGGGAGAGCAACGGCCAGCCCGAGAACAACTACAAGACCACCCCG<br>CCCGTCCTGGACAGCGACGGCTCCTTCTTCCTGTACAGCAAGCTGACCGTGG<br>ATAAGTCCCGGTGGCAACAGGGCAACGTGTTTAGCTGTAGCGTGATGCATGA<br>GGCCCTGCACAACCACTACACCCAGAAAAGCTTGTCCCTGTCCCCCGGGAAG |
| 456 | IPI_HC-CO11 | ATGGAGACACCCGCCCAGCTCCTCTTCCTCCTCCTCCTCTGGCTTCCGGACA<br>CCACCGGGCAGGTCCAGCTCGTTGAGAGCGGGGGAGGAGTCGTCCAGCCGGG<br>AAGGAGCCTAAGGCTCTCCTGTGCGGCCAGCGGGTTCACCTTCAGCTCCTAT<br>ACCATGCACTGGGTCCGGCAGGCCCCCGGCAAGGGCTTGGAGTGGGTCACGT<br>TCATCTCCTACGACGGCAACAACAAGTACTACGCCGACAGCGTCAAGGGCCG<br>GTTTACCATCAGCCGCGACAATTCCAAGAACACCCTCTACCTGCAAATGAAC<br>TCCCTGCGGGCCGAGGATACAGCCATCTATTATTGTGCGAGAACCGGCTGGC<br>TGGGGCCCTTCGACTACTGGGGCCAGGGAACCCTGGTGACCGTGAGCAGCGC<br>CTCCACCAAGGGCCCATCCGTGTTTCCCCTGGCCCCCAGTAGCAAGAGCACG<br>TCCGGCGGCACCGCCGCCCTGGGCTGCCTGGTAAAGGACTACTTCCCCGAGC<br>CCGTCACCGTGAGCTGGAACAGCGGGGCCCTGACCTCCGGCGTACACACCTT<br>CCCCGCCGTCTTACAGTCCTCGGGCCTGTATAGCCTGAGCTCCGTTGTGACG<br>GTGCCCAGCTCCTCACTGGGCACCCAGACATACATCTGCAATGTGAATCACA<br>AACCCAGCAACACCAAAGTGGACAAGCGGGTGGAGCCCAAGTCCTGCGACAA<br>AACCCACACGTGCCCGCCCTGCCCGGCCCCCGAGCTGCTGGGTGGGCCCAGC<br>GTGTTTCTGTTCCCACCCAAGCCCAAGGATACCCTCATGATAAGCCGCACCC<br>CCGAGGTGACCTGCGTGGTGGTGGACGTGAGCCACGAGGACCCCGAGGTGAA<br>GTTCAACTGGTACGTGGACGGCGTGGAGGTCCACAACGCCAAGACCAAGCCC<br>AGAGAAGAACAGTACAACAGCACGTACCGTGTGGTCAGCGTGCTGACCGTGC |

TABLE 3-continued

Optimized Tremelimumab and Ipilimumab Sequences

| SEQ ID NO | Description | Sequence |
|---|---|---|
| | | TGCACCAGGACTGGCTGAACGGCAAGGAATACAAATGCAAGGTGAGCAATAA<br>GGCCCTGCCCGCCCCCATCGAAAAGACCATCAGCAAAGCCAAGGGACAGCCC<br>CGGGAGCCCCAGGTGTACACCCTGCCTCCCAGCAGGGAGGAGATGACCAAAA<br>ACCAAGTCTCCCTGACCTGCCTGGTGAAAGGGTTTTACCCCAGCGACATCGC<br>CGTAGAGTGGGAGAGCAACGGCCAGCCCGAGAACAATTATAAGACCACCCCG<br>CCCGTGCTGGATAGCGACGGGAGTTTCTTCCTGTACAGCAAGCTGACGGTGG<br>ATAAGAGCCGTTGGCAGCAGGGCAACGTGTTCTCCTGCTCCGTGATGCACGA<br>GGCCCTGCACAACCACTACACCCAGAAAAGCCTGAGCCTTAGCCCCGGAAAG |
| 457 | IPI_HC-CO12 | ATGGAAACCCCCGCCCAGCTCCTCTTCCTCTTGCTCCTATGGCTCCCGGACA<br>CAACCGGGCAGGTCCAGCTCGTCGAGAGCGGGGGCGGGGTCGTCCAGCCCGG<br>GCGGAGCCTCCGTTTGAGTTGCGCCGCCAGCGGCTTCACCTTCAGCAGCTAC<br>ACCATGCACTGGGTCCGTCAGGCCCCGGGGAAGGGCCTCGAGTGGGTTACCT<br>TCATCAGCTACGACGGCAACAACAAGTACTACGCCGATTCCGTCAAGGGGCG<br>TTTCACGATTTCCCGGGACAATTCCAAGAACACCCTCTACCTGCAGATGAAC<br>AGCCTGAGGGCGGAGGACACCGCCATCTACTACTGCGCCCGGACCGGCTGGC<br>TGGGCCCGTTTGACTATTGGGGCCAGGGCACCCTGGTGACCGTTAGCAGCGC<br>CAGCACCAAGGGTCCCAGCGTCTTCCCGCTGGCCCCCAGCTCCAAGAGCACC<br>AGCGGCGGCACCGCCGCGCTGGGCTGCCTGGTCAAGGACTACTTCCCCGAGC<br>CCGTGACCGTCAGCTGGAACAGCGGGGCCCTGACCAGCGGCGTCCACACCTT<br>CCCGGCCGTGCTGCAGAGCAGCGGGCTGTACAGCCTGAGCAGCGTGGTGACC<br>GTGCCAAGCAGCAGCCTGGGTACCCAAACGTACATCTGTAACGTGAACCACA<br>AGCCCAGCAACACCAAGGTGGATAAGAGGGTGGAGCCGAAAAGCTGCGACAA<br>GACCCATACCTGCCCTCCCTGCCCCGCCCCCGAGCTTCTGGGCGGCCCGTCG<br>GTCTTCCTGTTCCCGCCCAAACCCAAGGACACCCTCATGATCTCCCGGACAC<br>CCGAGGTGACCTGCGTCGTCGTGGACGTGTCACATGAGGACCCCGAGGTCAA<br>GTTCAACTGGTACGTGGACGGCGTGGAAGTGCATAACGCCAAGACCAAGCCC<br>CGAGAGGAGCAGTACAACAGCACCTACCGCGTGGTGAGCGTGCTCACCGTGC<br>TGCACCAGGATTGGCTCAACGGAAAGGAGTACAAATGCAAGGTGTCCAATAA<br>GGCCCTCCCCGCGCCCATCGAGAAGACAATCTCAAAGGCAAAGGGACAGCCC<br>CGGGAGCCCCAGGTATACACCCTGCCCCCCTCCCGCGAGGAGATGACAAAGA<br>ACCAAGTGAGCCTGACCTGCCTCGTGAAGGGCTTCTACCCCTCCGACATAGC<br>CGTGGAGTGGGAGAGCAACGGCCAGCCCGAGAACAACTACAAGACCACCCCG<br>CCCGTGCTGGACTCCGACGGCAGCTTCTTCCTGTACAGCAAGCTGACCGTGG<br>ACAAGTCCAGGTGGCAGCAAGGCAACGTGTTCAGCTGCAGCGTGATGCACGA<br>GGCCCTGCACAATCACTACACCCAGAAAAGCCTGTCCCTGAGCCCCGGCAAG |
| 458 | IPI_HC-CO13 | ATGGAGACACCCGCCCAGCTACTCTTCCTCCTCCTTCTCTGGCTTCCGGACA<br>CCACCGGCCAGGTCCAGCTGGTGGAGAGCGGCGGCGGCGTCGTACAGCCCGG<br>GAGGTCCCTCCGGTTGAGCTGTGCCGCCAGCGGCTTCACATTTTCCAGCTAC<br>ACCATGCACTGGGTCAGGCAGGCCCCGGGCAAGGGCCTCGAGTGGGTCACCT<br>TTATCTCCTACGACGGCAACAACAAGTACTACGCCGACAGCGTCAAAGGGCG<br>GTTCACCATCAGCAGGGACAACAGCAAGAACACCCTCTACCTGCAGATGAAC<br>AGCCTGAGGGCCGAGGATACGGCCATCTACTACTGCGCCCGGACCGGCTGGC<br>TGGGCCCCTTCGACTACTGGGGGCAGGGCACCCTCGTCACCGTGAGCAGCGC<br>CAGCACAAAAGGGCCCTCCGTGTTTCCCCTCGCCCCCTCGTCCAAATCCACC<br>AGCGGCGGCACCGCTGCCCTGGGGTGCCTGGTGAAGGACTACTTTCCCGAGC<br>CCGTGACCGTGAGCTGGAATAGCGGCGCCCTGACCTCCGGCGTGCACACATT<br>CCCCGCCGTGCTGCAGAGCAGCGGCCTGTACAGCCTGAGCAGCGTGGTCACC<br>GTGCCCTCCAGTAGCCTGGGGACCCAGACCTACATCTGTAACGTGAACCACA<br>AGCCCAGCAACACCAAGGTGGATAAAAGGGTGGAGCCAAAGTCCTGCGACAA<br>GACCCATACCTGCCCCCCGTGCCCCGCCCCCGAACTCCTGGGCGGGCCCAGC<br>GTGTTCCTCTTCCCACCCAAGCCCAAGGACACGCTGATGATCAGCCGGACCC<br>CCGAGGTGACCTGCGTGGTGGTGGACGTGAGCCACGAGGATCCCGAGGTGAA<br>GTTCAACTGGTACGTGGATGGCGTGGAGGTGCATAACGCCAAGACCAAGCCG<br>AGGGAGGAGCAGTATAACAGCACCTATAGGGTGGTCAGCGTGCTCACGGTCC<br>TGCACCAGGATTGGCTGAACGGCAAAGAGTACAAGTGCAAGGTGTCCAATAA<br>GGCCCTGCCCGCCCCCATAGAGAAGACCATCTCCAAGGCCAAGGGCCAGCCC<br>AGGGAGCCCCAGGTGTACACGCTGCCCCCCTCCAGGGAGGAGATGACCAAAA<br>ATCAGGTGAGCCTGACCTGCCTGGTGAAGGGGTTCTACCCCAGCGATATCGC<br>CGTCGAGTGGGAGTCCAATGGGCAACCGGAAAACAACTACAAGACTACCCCG<br>CCCGTGCTGGACTCGGACGGCAGCTTCTTCCTGTACTCCAAGCTGACCGTCG<br>ACAAGTCAAGGTGGCAGCAGGGCAATGTGTTCAGCTGTAGCGTGATGCATGA<br>GGCCCTCCACAACCACTATACCCAAAAGAGCCTTTCGCTCTCCCCCGGCAAG |
| 459 | IPI_HC-CO14 | ATGGAGACGCCCGCCCAGCTCCTCTTTTTACTCCTCCTCTGGCTCCCCGACA<br>CCACCGGCCAGGTCCAGCTCGTCGAGTCCGGGGGAGGCGTCGTCCAGCCGGG<br>CAGGAGCCTCAGGCTCAGCTGCGCCGCCTCCGGCTTCACGTTCAGCAGCTAC<br>ACAATGCATTGGGTCAGGCAGGCGCCCGGTAAAGGGCTCGAGTGGGTAACCT<br>TCATCAGCTACGACGGCAACAACAAATACTACGCGGACAGCGTCAAGGGCAG<br>ATTTACCATCTCCCGGGATAACTCCAAGAATACCCTCTACCTCCAGATGAAC<br>AGCCTGAGGGCCGAGGACACCGCCATCTACTACTGCGCCAGGACGGGGTGGC<br>TGGGACCCTTTGACTACTGGGGCCAGGGCACCCTGGTCACCGTGAGCAGCGC<br>CAGCACCAAAGGCCCCAGCGTGTTCCCCCTGGCACCCAGCAGCAAGAGCACC<br>AGCGGTGGCACCGCCGCCCTCGGCTGCCTGGTGAAGGACTACTTCCCGGAGC |

TABLE 3-continued

| SEQ ID NO | Description | Sequence |
|---|---|---|
| | | Optimized Tremelimumab and Ipilimumab Sequences |
| | | CCGTGACCGTGAGCTGGAACAGCGGGGCCCTGACGTCCGGCGTCCACACCTT TCCAGCCGTGCTGCAAAGCAGCGGCCTGTACTCCCTGAGCAGCGTGGTGACC GTGCCGAGCAGCAGCCTGGGCACCCAGACCTACATCTGTAACGTGAACCACA AGCCAAGCAATACCAAGGTGGACAAAAGGGTGGAGCCCAAGTCCTGTGACAA AACCCACACCTGCCCGCCCTGCCCCGCCCCCGAACTGCTGGGCGGGCCCTCG GTATTTCTGTTCCCGCCCAAGCCCAAGGATACCCTGATGATCTCCCGGACCC CCGAAGTGACCTGCGTAGTGGTGGACGTGAGCCACGAGGACCCCGAGGTGAA GTTCAACTGGTACGTGGATGGCGTGGAGGTGCACAACGCCAAGACCAAGCCC CGGGAGGAGCAGTATAACAGCACGTACAGGGTGGTGTCCGTGCTCACCGTAC TGCATCAGGACTGGCTCAACGGCAAGGAGTATAAGTGTAAGGTGAGCAACAA GGCCCTGCCCGCCCCCATCGAAAAGACGATCAGCAAGGCAAAAGGCCAGCCC AGGGAACCCCAGGTGTACACCCTGCCCCCCAGCAGGGAGGAGATGACCAAGA ACCAGGTGAGCCTGACCTGCCTGGTGAAGGGCTTTTATCCAAGCGACATCGC GGTCGAGTGGGAGTCGAATGGCCAGCCCGAGAACAACTATAAGACCACCCCA CCCGTGCTCGACTCCGACGGCAGCTTCTTCCTGTATAGCAAGCTGACCGTCG ACAAGAGCAGGTGGCAACAGGGCAACGTGTTCAGCTGCAGCGTGATGCACGA GGCGCTGCATAATCACTATACCCAGAAAAGCCTGAGCCTGAGCCCCGGCAAG |
| 460 | IPI_HC-CO15 | ATGGAGACGCCCGCCCAGCTCCTATTCCTCCTCCTCCTCTGGCTACCCGACA CGACCGGCCAGGTCCAGCTCGTCGAGAGCGGCGGCGGAGTCGTCCAGCCCGG CAGGAGCCTCAGGCTCAGCTGTGCCGCCAGCGGCTTTACCTTCAGCTCGTAC ACCATGCACTGGGTAAGGCAGGCGCCAGGCAAGGGCCTCGAGTGGGTCACCT TCATCTCCTACGACGGGAACAATAAATACTACGCCGACAGCGTCAAGGGCAG GTTCACCATAAGCAGGGACAACAGCAAGAACACCCTCTACCTGCAGATGAAC AGCCTGCGGGCCGAGGACACCGCTATTTATTACTGCGCCAGGACGGGTTGGC TGGGCCCCTTCGACTACTGGGGCCAGGGTACCCTGGTGACAGTGTCCAGCGC GAGCACCAAGGGCCCCAGCGTGTTCCCCCTGGCTCCCAGCTCCAAGAGCACC TCAGGGGGGACCGCCGCCCTGGGGTGCCTGGTGAAAGATTATTTCCCCGAGC CCGTAACGGTGAGCTGGAACAGCGGGGCCCTGACCAGCGGCGTGCACACCTT CCCCGCGGTGCTGCAGAGCAGCGGCCTGTACAGCCTCTCCAGCGTGGTGACG GTGCCCAGCTCCAGCCTGGGCACCCAGACCTATATCTGCAACGTGAACCACA AGCCCTCCAACACCAAGGTGGATAAGCGGGTGGAGCCCAAGAGCTGCGACAA GACGCACACCTGCCCGCCCTGCCCCGCGCCCGAGCTGCTGGGGGGACCGTCC GTGTTTCTGTTCCCCCCGAAACCCAAGGATACCCTGATGATCAGCCGGACCC CCGAAGTGACCTGCGTGGTGGTGGACGTGAGCCACGAGGATCCCGAGGTGAA GTTCAATTGGTACGTGGACGGCGTGGAGGTGCATAACGCGAAAACCAAGCCC CGGGAGGAGCAGTACAACAGTACCTATAGGGTGGTGAGCGTGCTGACCGTCC TGCACCAGGACTGGCTGAACGGCAAGGAGTACAAATGCAAGGTGAGCAACAA GGCGCTGCCCGCCCCCATCGAGAAGACCATCTCGAAGGCCAAGGGCCAACCC CGGGAACCCCAGGTGTATACCCTGCCCCCAAGCAGGGAAGAGATGACCAAAA ACCAGGTCAGCCTGACCTGTCTGGTTAAGGGATTCTACCCCTCCGACATCGC GGTGGAGTGGGAGAGCAACGGCCAGCCCGAGAATAACTACAAGACGACCCCG CCCGTCCTGGACAGCGACGGATCCTTCTTCCTCTACAGCAAGCTGACTGTGG ACAAGAGCAGGTGGCAACAGGGCAACGTCTTTTCGTGCTCCGTGATGCATGA GGCCCTGCACAACCACTACACCCAGAAGTCCCTGAGCCTCTCCCCCGGCAAG |
| 461 | IPI_HC-CO16 | ATGGAGACACCCGCCCAGCTCCTCTTCCTCCTCCTCCTCTGGCTCCCCGACA CCACCGGTCAGGTACAGCTCGTCGAGTCCGGCGGCGGGGTCGTTCAGCCCGG CAGGAGCCTCAGGTTATCCTGCGCCGCCAGCGGGTTTACGTTCAGCTCCTAC ACCATGCACTGGGTCCGGCAGGCGCCCGGCAAGGGCCTCGAGTGGGTCACCT TCATCAGCTACGACGGCAACAACAAGTACTACGCCGATAGCGTTAAGGGCAG GTTCACCATCAGCAGGGACAATTCCAAGAATACCCTCTATCTGCAGATGAAT AGCCTGAGGGCGGAAGACACGGCAATCTATTATTGTGCACGGACCGGCTGGC TGGGGCCCTTCGACTATTGGGGGCAGGGTACCCTGGTGACCGTCAGCAGCGC CTCCACCAAGGGGCCCAGCGTGTTCCCCCTGGCCCCCAGCAGCAAGTCCACC AGCGGCGGCACAGCCGCCCTGGGCTGCCTGGTCAAGGATTACTTTCCCGAGC CCGTCACCGTGAGCTGGAACAGCGGGGCACTGACGAGCGGGGTGCATACCTT TCCCGCCGTGCTGCAAAGCAGCGGCCTCTACAGCCTGTCGAGCGTGGTGACC GTGCCCAGTAGCAGCCTCGGCACCCAGACCTACATCTGCAACGTCAACCATA AGCCCTCCAACACCAAGGTGGACAAGAGGGTGGAGCCCAAGAGCTGCGACAA GACCCACACGTGCCCACCCTGCCCGGCCCCCGAGCTGCTGGGCGGACCCTCC GTGTTCCTGTTTCCCCCGAAGCCGAAAGACACCCTAATGATCTCGAGGACGC CAGAAGTGACCTGTGTGGTGGTCGACGTGAGCCACGAGGACCCGGAGGTGAA GTTCAATTGGTACGTGGACGGCGTGGAGGTGCATAATGCGAAGACCAAGCCC CGGGAGGAGCAGTACAACAGCACCTACCGGGTGGTGTCCGTGCTGACCGTGC TGCACCAGGACTGGCTGAACGGCAAGGAGTACAAGTGCAAGGTGTCCAACAA GGCCCTGCCTGCCCCCATCGAGAAGACCATCTCCAAGGCCAAGGGGCAACCC CGGGAGCCTCAAGTGTACACCCTTCCCCCCAGCAGGGAGGAGATGACCAAGA ACCAGGTGTCCCTTACCTGCCTGGTGAAGGGGTTCTACCCCTCCGACATCGC CGTGGAGTGGGAGAGCAACGGTCAGCCCGAGAACAACTACAAGACCACCCCG CCCGTGCTGGACAGCGACGGCAGCTTTTTCCTGTATAGCAAGCTTACCGTGG ACAAGAGCAGGTGGCAGCAGGGCAACGTGTTCAGCTGCAGCGTCATGCACGA GGCCCTGCACAACCATTATACCCAGAAGTCTCTCAGCCTGTCCCCCGGCAAA |

TABLE 3-continued

Optimized Tremelimumab and Ipilimumab Sequences

| SEQ ID NO | Description | Sequence |
|---|---|---|
| 462 | IPI_HC-CO17 | ATGGAGACGCCCGCCCAGCTCCTATTTCTCCTACTCTTGTGGCTCCCCGACA<br>CGACCGGGCAGGTCCAGCTGGTGGAGTCCGGGGGCGGGGTCGTACAGCCCGG<br>CAGGAGCCTCCGATTAAGCTGCGCCGCCAGCGGATTTACCTTCAGCAGCTAT<br>ACCATGCACTGGGTCAGGCAGGCCCCCGGCAAGGGCCTCGAGTGGGTCACCT<br>TCATCAGCTACGACGGAAACAACAAGTATTACGCCGACTCCGTCAAAGGGAG<br>GTTCACCATCAGCAGGGACAACTCGAAGAACACCCTCTACCTGCAAATGAAC<br>TCCCTGCGCGCCGAAGACACCGCCATATACTACTGCGCCAGGACCGGGTGGC<br>TGGGGCCCTTCGACTACTGGGGCCAGGGCACCCTGGTGACCGTGTCCTCAGC<br>CTCAACTAAGGGCCCCTCCGTGTTCCCGCTGGCCCCCAGCAGCAAGAGCACC<br>AGCGGCGGTACCGCGGCCCTGGGCTGCCTGGTGAAGGACTACTTCCCCGAGC<br>CCGTGACGGTGAGCTGGAACTCTGGCGCCCTGACCAGCGGAGTGCACACCTT<br>CCCCGCGGTGCTGCAGAGCAGCGGGCTGTACTCCCTGAGCAGCGTGGTGACT<br>GTGCCCTCCAGCTCCCTGGGCACCCAGACCTACATCTGCAACGTCAACCACA<br>AGCCGAGCAACACCAAGGTGGACAAACGGGTCGAGCCCAAGAGCTGCGACAA<br>GACCCACACCTGCCCGCCCTGCCCCGCCCCCGAACTCCTGGGTGGCCCATCG<br>GTGTTCCTCTTCCCCCCGAAGCCCAAGGACACCCTGATGATCAGCCGCACCC<br>CCGAGGTCACCTGCGTCGTGGTGGACGTGAGCCACGAGGACCCCGAAGTCAA<br>GTTCAACTGGTACGTTGACGGGGTGGAGGTCCACAACGCCAAGACCAAGCCC<br>AGGGAGGAGCAATACAACAGCACCTACCGGGTGGTGAGCGTGCTGACCGTCC<br>TGCACCAGGACTGGCTGAACGGGAAGGAGTACAAGTGCAAAGTGAGCAATAA<br>GGCCCTGCCCGCCCCCATCGAGAAGACCATCTCCAAGGCCAAGGGCCAGCCC<br>AGGGAGCCCCAAGTGTACACGCTGCCCCCCAGCAGGGAAGAGATGACCAAGA<br>ACCAGGTGTCTCTGACCTGCCTGGTGAAGGGCTTCTACCCCAGCGACATCGC<br>CGTCGAGTGGGAGAGCAACGGCCAGCCCGAGAACAACTACAAGACCACCCCG<br>CCCGTGCTGGACAGCGACGGCAGCTTCTTCCTCTACAGCAAGCTGACCGTGG<br>ACAAGAGCAGGTGGCAGCAGGGCAACGTATTCTCCTGCTCCGTGATGCACGA<br>AGCCCTGCACAACCACTACACGCAGAAGTCACTGAGCCTGAGCCCCGGGAAG |
| 463 | IPI_HC-CO18 | ATGGAGACACCCGCGCAGCTTCTATTCCTCCTCCTCCTCTGGCTACCCGACA<br>CCACGGGTCAGGTCCAGCTCGTCGAGAGCGGGGGCGGAGTGGTCCAGCCCGG<br>CAGGTCACTCCGGCTCTCCTGCGCCGCCTCCGGCTTTACCTTTAGCAGCTAT<br>ACCATGCACTGGGTCAGGCAGGCCCCCGGGAAGGGCCTCGAGTGGGTCACCT<br>TCATCAGCTACGACGGAAACAACAAGTATTACGCGGATTCCGTAAAAGGCAG<br>GTTCACCATCTCCAGGGACAATAGCAAGAACACCCTCTACCTGCAGATGAAC<br>TCCCTGCGAGCCGAAGACACCGCCATATACTACTGCGCCAGGACCGGGTGGC<br>TCGGGCCCTTCGACTATTGGGGCCAGGGGACCCTGGTGACCGTCAGCAGCGC<br>CAGCACCAAGGGGCCCTCCGTGTTCCCCCTGGCCCCCTCATCCAAGAGCACC<br>AGCGGCGGGACCGCAGCCCTGGGGTGCCTCGTGAAGGACTACTTCCCCGAGC<br>CCGTGACCGTGAGCTGGAACAGCGGCGCGCTCACCAGCGGCGTGCACACCTT<br>CCCCGCCGTGCTGCAGTCCAGCGGGCTGTACTCCCTGTCCTCGGTGGTCACC<br>GTCCCCAGCAGCAGCCTGGGCACCCAGACCTACATCTGCAACGTGAACCACA<br>AGCCCAGCAACACCAAGGTGGATAAGAGGGTCGAGCCCAAAAGCTGCGACAA<br>AACCCACACCTGCCCGCCCTGCCCCGCCCCCGAGCTGCTGGGCGGCCCAAGC<br>GTGTTCCTGTTCCCTCCCAAACCCAAGGACACGCTCATGATATCCAGGACCC<br>CCGAGGTCACGTGCGTGGTGGTGGACGTGTCCCACGAGGACCCCGAGGTCAA<br>ATTCAACTGGTACGTGGACGGCGTGGAGGTGCACAACGCCAAGACCAAGCCC<br>AGGGAGGAGCAGTACAACTCCACGTACCGGGTGGTGTCCGTCCTGACGGTGC<br>TCCACCAAGACTGGCTGAACGGGAAGGAGTACAAGTGCAAGGTGTCCAACAA<br>GGCCCTGCCGGCCCCCATCGAGAAGACGATCAGCAAGGCCAAGGGGCAACCC<br>AGGGAGCCCCAGGTTTACACCCTGCCCCCCAGCAGGGAGGAAATGACCAAGA<br>ATCAGGTGAGCCTGACCTGTCTGGTCAAAGGCTTCTACCCGAGCGACATAGC<br>CGTGGAATGGGAGAGCAACGGCCAGCCCGAGAACAACTACAAAACCACCCCT<br>CCCGTTCTCGACAGCGACGGCAGCTTCTTCCTCTACAGCAAGCTCACCGTAG<br>ACAAGAGCCGGTGGCAGCAGGGCAATGTGTTCTCCTGCAGCGTGATGCACGA<br>GGCCCTGCACAATCATTACACTCAGAAAAGCCTGAGCCTCAGCCCCGGCAAG |
| 464 | IPI_HC-CO19 | ATGGAGACTCCCGCCCAGCTCCTCTTCCTCCTCCTCCTTTGGCTCCCCGACA<br>CCACCGGTCAGGTCCAGCTCGTCGAGAGCGGGGGCGGCGTCGTCCAGCCCGG<br>CAGGAGCCTCAGGCTCAGCTGCGCCGCCAGCGGCTTCACCTTCTCCAGCTAC<br>ACGATGCACTGGGTCAGGCAAGCGCCCGGCAAAGGGCTCGAGTGGGTAACCT<br>TCATCTCATACGACGGCAACAACAAGTACTACGCGGACAGCGTCAAGGGCCG<br>GTTCACCATCAGCAGGGATAACAGCAAGAACACCCTTTACCTGCAGATGAAC<br>TCACTGCGCGCCGAGGACACCGCCATATACTATTGCGCAAGGACCGGCTGGC<br>TGGGCCCCTTCGACTACTGGGGCCAGGGAACGCTGGTCACCGTGAGCTCTGC<br>CAGCACCAAGGGCCCCTCCGTCTTCCCCCTGGCCCCCTCCTCCAAGAGCACG<br>TCCGGGGGCACGGCGGCCCTGGGGTGCCTGGTGAAGGACTACTTCCCCGAGC<br>CCGTGACCGTGTCATGGAACAGTGGCGCGCTGACGAGCGGGGTGCATACATT<br>TCCCGCCGTGCTCCAGAGCTCCGGCCTGTACTCGCTGTCCAGCGTGGTGACC<br>GTGCCGTCCAGCAGCCTGGGCACCCAGACATACATATGCAATGTGAATCACA<br>AGCCCTCCAACACCAAGGTGGACAAAAGGGTGGAGCCGAAAAGCTGTGACAA<br>GACGCACACCTGCCCACCCTGCCCCGCCCCCGAGCTGCTGGGTGGCCCGAGC<br>GTGTTCCTGTTCCCGCCAAAACCCAAGGACACCCTGATGATCAGCCGGACCC<br>CCGAGGTGACCTGCGTGGTGGTGGACGTGAGCCACGAAGACCCCGAAGTCAA<br>GTTCAACTGGTATGTGGACGGCGTGGAGGTCCACAACGCCAAGACCAAGCCC<br>CGCGAGGAGCAGTACAACTCGACCTACAGGGTGGTGAGCGTGCTGACAGTGC |

TABLE 3-continued

Optimized Tremelimumab and Ipilimumab Sequences

| SEQ ID NO | Description | Sequence |
|---|---|---|
| | | TCCACCAGGACTGGCTGAATGGCAAGGAGTATAAGTGCAAGGTGAGCAACAA |
| | | AGCGCTGCCCGCCCCCATCGAGAAGACCATCAGCAAGGCCAAGGGCCAACCC |
| | | AGGGAGCCCCAGGTCTATACCCTCCCCCCTAGCAGGGAGGAGATGACCAAAA |
| | | ACCAGGTGAGCCTCACCTGCCTGGTGAAGGGGTTCTATCCCAGCGACATCGC |
| | | CGTGGAGTGGGAAAGCAACGGGCAGCCCGAGAACAATTACAAGACCACCCCA |
| | | CCCGTGCTGGATTCCGACGGCTCGTTTTTCCTGTACAGCAAGCTGACCGTCG |
| | | ACAAGAGCAGGTGGCAACAGGGGAATGTGTTCAGCTGCAGCGTGATGCACGA |
| | | AGCCCTCCACAATCATTATACCCAGAAAAGCCTGAGCCTCAGCCCCGGCAAG |
| 465 | IPI_HC-CO20 | ATGGAGACACCCGCCCAGCTTTTGTTCCTCCTCCTCCTTTGGCTCCCCGACA |
| | | CCACCGGGCAGGTCCAGCTCGTCGAGTCCGGCGGCGGCGTCGTACAGCCCGG |
| | | CCGGAGCCTCAGGCTCAGCTGCGCCGCCTCCGGCTTCACCTTTAGCTCCTAC |
| | | ACCATGCACTGGGTCAGGCAAGCCCCAGGCAAGGGACTCGAGTGGGTCACCT |
| | | TTATTTCCTACGACGGGAATAATAAGTACTACGCAGACAGCGTAAAGGGCAG |
| | | GTTCACCATCTCCAGGGACAACTCGAAGAACACCCTCTACCTCCAGATGAAT |
| | | AGCCTGAGGGCGGAGGACACCGCCATCTATTACTGCGCGCGCACGGGCTGGC |
| | | TGGGCCCCTTCGACTACTGGGGCCAGGGCACACTGGTGACAGTGAGCAGCGC |
| | | CAGCACCAAGGGCCCAAGCGTGTTCCCCCTGGCCCCCAGCAGCAAGTCAACC |
| | | AGCGGCGGCACAGCGGCCCTGGGCTGCCTGGTGAAGGACTACTTCCCCGAGC |
| | | CCGTGACCGTGAGCTGGAACTCTGGCGCCCTGACCAGCGGCGTGCACACGTT |
| | | TCCCGCGGTACTGCAGAGCAGCGGACTCTACAGCCTGAGCTCCGTGGTGACG |
| | | GTGCCCAGCAGCTCCCTGGGCACCCAGACCTACATCTGCAACGTGAACCACA |
| | | AGCCCTCCAACACCAAGGTGGACAAAAGGGTGGAGCCGAAATCCTGTGACAA |
| | | GACCCACACGTGCCCGCCCTGCCCGGCCCCGGAGCTCCTGGGCGGCCCCTCC |
| | | GTGTTTCTGTTCCCGCCCAAGCCCAAGGACACCCTTATGATCAGCCGGACGC |
| | | CCGAGGTGACCTGCGTGGTGGTGGACGTGAGCCACGAAGACCCCGAGGTGAA |
| | | GTTCAACTGGTACGTCGACGGCGTAGAGGTGCACAATGCCAAGACGAAGCCC |
| | | CGGGAGGAGCAATACAACTCCACCTACCGCGTGGTGAGCGTGCTGACGGTCC |
| | | TCCACCAGGACTGGCTCAACGGTAAGGAGTATAAGTGTAAGGTGAGCAACAA |
| | | GGCCCTGCCCGCGCCCATAGAGAAGACCATTTCCAAGGCCAAGGGCCAGCCC |
| | | AGAGAGCCCCAAGTGTACACCCTGCCGCCAAGCCGGGAGGAGATGACAAAGA |
| | | ATCAGGTGTCCCTCACGTGCCTGGTGAAGGGATTCTACCCCTCCGACATCGC |
| | | CGTGGAGTGGGAGAGCAACGGGCAGCCGGAAAACAATTACAAAACCACCCCT |
| | | CCAGTGCTGGACAGTGACGGCAGCTTCTTTCTGTACTCCAAGCTGACCGTCG |
| | | ATAAGAGCCGGTGGCAGCAGGGCAACGTCTTTTCGTGCAGCGTGATGCACGA |
| | | GGCCCTGCACAACCACTACACCCAGAAAAGCCTGAGCCTGAGCCCGGGCAAG |
| 466 | IPI_HC-CO21 | ATGGAGACGCCGGCCCAGCTCCTCTTTCTCCTCCTCCTCTGGCTCCCCGACA |
| | | CCACCGGCCAGGTTCAGCTCGTCGAGAGCGGCGGAGGCGTCGTACAGCCCGG |
| | | GCGGAGCCTCAGGCTCAGCTGTGCCGCGAGCGGCTTCACCTTCAGCAGCTAC |
| | | ACCATGCACTGGGTCCGGCAGGCCCCCGGCAAGGGCCTCGAGTGGGTAACAT |
| | | TCATCTCCTACGACGGTAATAACAAGTACTACGCCGACAGCGTCAAGGGCAG |
| | | GTTCACCATCAGCAGGGATAACTCCAAGAACACCCTCTACCTGCAGATGAAC |
| | | AGCCTGCGGGCCGAAGACACCGCCATCTATTATTGCGCGAGGACCGGCTGGC |
| | | TGGGCCCCTTCGACTATTGGGGCCAGGGCACCCTGGTGACCGTGTCGAGCGC |
| | | CAGCACCAAGGGCCCCAGCGTGTTCCCCCTGGCCCCCAGCAGCAAGTCCACC |
| | | AGCGGCGGGACCGCCGCGCTGGGCTGTCTAGTGAAGGACTACTTCCCCGAGC |
| | | CCGTGACCGTGTCCTGGAACAGCGGTGCCCTGACCTCCGGCGTGCATACCTT |
| | | TCCGGCCGTGCTGCAGAGCAGCGGTCTGTACTCCCTCTCCAGCGTGGTGACC |
| | | GTCCCCAGCAGCAGCCTGGGGACTCAGACCTACATCTGCAACGTGAATCACA |
| | | AACCCTCCAACACCAAGGTGGATAAGAGGGTCGAGCCAAAGAGCTGTGACAA |
| | | GACCCACACCTGCCCGCCCTGCCCCGCCCCCGAGCTGCTGGGGGGCCCCAGC |
| | | GTCTTCCTGTTCCCGCCCAAGCCCAAGGACACGCTGATGATCAGCCGCACCC |
| | | CCGAGGTGACGTGCGTGGTGGTCGACGTGAGCCACGAGGACCCCGAGGTAAA |
| | | GTTCAACTGGTACGTGGACGGGGTGGAGGTGCATAACGCCAAGACCAAACCC |
| | | CGGGAGGAGCAGTACAATTCAACCTACCGGGTGGTGTCGGTCCTGACAGTGC |
| | | TGCACCAGGACTGGCTCAACGGCAAGGAATACAAGTGTAAAGTGAGCAATAA |
| | | GGCCCTCCCCGCGCCCATCGAGAAGACCATCTCCAAGGCCAAAGGCCAGCCC |
| | | AGGGAGCCCCAGGTGTACACCCTGCCCCCCAGCAGGGAGGAGATGACCAAGA |
| | | ACCAGGTGTCCCTGACTTGCCTCGTGAAAGGCTTCTACCCCAGCGATATAGC |
| | | CGTCGAGTGGGAAAGCAACGGCCAGCCCGAGAACAACTATAAGACCACGCCG |
| | | CCCGTGCTCGACTCTGACGGCAGCTTCTTTCTGTATAGCAAGCTGACCGTGG |
| | | ACAAGAGCAGGTGGCAGCAGGGCAACGTGTTCTCGTGCTCCGTGATGCATGA |
| | | GGCCCTGCATAATCATTACACCCAGAAAAGCCTGAGCCTGTCCCCCGGGAAG |
| 467 | IPI_HC-CO22 | ATGGAAACCCCAGCCCAACTCCTCTTCCTCCTCCTCCTATGGCTCCCGGACA |
| | | CCACAGGCCAGGTACAGCTCGTAGAGTCGGGCGGCGGCGTAGTCCAGCCCGG |
| | | AAGGAGCCTCCGGCTTAGCTGCGCCGCCTCCGGCTTCACCTTCTCGAGCTAC |
| | | ACCATGCACTGGGTCCGACAGGCCCCCGGCAAGGGGCTCGAGTGGGTCACCT |
| | | TCATCAGCTACGACGGGAACAACAAGTACTACGCCGACAGCGTCAAGGGCCG |
| | | GTTCACCATCTCGAGAGACAACAGCAAGAACACTCTCTACCTGCAGATGAAC |
| | | AGCCTGCGAGCCGAGGACACCGCCATCTACTACTGTGCCAGGACAGGATGGC |
| | | TGGGCCCCTTCGACTATTGGGGCCAAGGCACCCTCGTGACCGTGTCCAGCGC |
| | | GAGCACCAAGGGCCCCAGCGTGTTCCCCCTTGCCCCCAGCAGTAAATCCACA |
| | | AGCGGGGGCACGGCCGCCCTCGGATGCCTGGTGAAAGACTACTTCCCCGAGC |

TABLE 3-continued

Optimized Tremelimumab and Ipilimumab Sequences

| SEQ ID NO | Description | Sequence |
|---|---|---|
| | | CCGTGACTGTGAGCTGGAACAGCGGGGCCCTTACCAGCGGCGTGCACACCTT<br>CCCCGCCGTGCTGCAGTCCAGCGGCCTGTACAGCCTGAGCAGCGTCGTGACC<br>GTGCCCTCTTCGTCTCTGGGCACCCAGACCTACATCTGCAACGTCAACCACA<br>AACCCAGCAATACTAAGGTGGACAAGCGAGTTGAGCCCAAAAGCTGCGACAA<br>GACCCACACCTGCCCGCCCTGCCCGGCCCCCGAGCTCCTGGGCGGGCCGAGC<br>GTCTTCCTGTTTCCCCCGAAGCCGAAGGATACCCTGATGATTAGCAGGACCC<br>CCGAGGTCACCTGCGTGGTGGTCGACGTGAGCCATGAGGACCCCGAGGTGAA<br>ATTTAACTGGTACGTGGATGGGGTGGAGGTGCATAACGCCAAGACCAAGCCC<br>AGGGAGGAGCAGTACAACAGCACGTATCGCGTGGTGTCGGTGCTGACCGTGC<br>TGCACCAGGACTGGCTGAACGGCAAGGAGTACAAGTGCAAGGTCAGCAACAA<br>GGCCCTGCCGGCCCCCATCGAGAAAACCATCAGCAAGGCCAAGGGGCAGCCC<br>CGGGAGCCCCAGGTCTATACTCTCCCTCCCTCCAGGGAAGAAATGACCAAGA<br>ACCAGGTGTCGCTGACTTGCCTGGTGAAGGGGTTCTACCCCTCCGACATCGC<br>GGTGGAGTGGGAGTCCAACGGTCAGCCCGAAAACAACTACAAGACGACCCCA<br>CCCGTGCTGGACAGCGACGGCTCCTTCTTCCTGTACTCGAAGCTGACTGTGG<br>ACAAGTCCCGCTGGCAGCAGGGGAACGTCTTTTCCTGCAGCGTGATGCACGA<br>GGCCCTACACAACCACTACACCCAGAAAAGCCTGTCGCTGTCCCCCGGGAAG |
| 468 | IPI_HC-CO23 | ATGGAGACACCCGCACAGCTCCTCTTCCTCCTCCTCCTTTGGCTCCCGGACA<br>CCACGGGGCAGGTCCAGCTCGTCGAGAGCGGGGGCGGCGTCGTACAGCCCGG<br>TAGGTCCCTTAGGCTCTCCTGCGCCGCCTCCGGCTTTACGTTTTCGAGCTAC<br>ACCATGCACTGGGTCCGCCAGGCCCCCGGCAAGGGCCTTGAGTGGGTCACCT<br>TCATCAGCTACGACGGCAACAACAAGTACTACGCCGATAGCGTCAAGGGCCG<br>CTTCACCATAAGCAGGGACAACTCCAAGAACACCCTCTACCTGCAGATGAAC<br>AGCCTCAGGGCGGAGGACACCGCCATCTACTACTGTGCCAGGACCGGCTGGC<br>TGGGCCCCTTCGACTACTGGGGCCAGGGGACGCTGGTGACGGTGAGCAGCGC<br>CTCCACCAAGGGCCCCAGCGTCTTCCCGCTGGCACCCAGCTCCAAGTCCACT<br>AGCGGCGGCACCGCCGCCCTGGGCTGCCTAGTGAAAGATTACTTTCCCGAAC<br>CCGTGACGGTGAGCTGGAACAGCGGCGCCCTGACCAGCGGAGTGCACACGTT<br>CCCCGCCGTCCTGCAGTCCTCGGGCCTGTACAGCCTGAGCTCCGTGGTCACC<br>GTGCCCTCCTCGAGCCTGGGCACCCAGACGTATATCTGCAACGTGAACCATA<br>AGCCATCGAATACCAAGGTGGATAAGAGGGTGGAACCGAAAAGCTGCGACAA<br>GACCCACACTTGCCCGCCCTGCCCGGCCCCCGAGCTGCTGGGCGGGCCCTCG<br>GTCTTTCTGTTCCCACCCAAGCCCAAGGACACCCTTATGATCAGCCGGACCC<br>CCGAGGTCACCTGCGTGGTGGTTGACGTGAGCCACGAGGATCCAGAGGTGAA<br>GTTCAATTGGTACGTGGATGGAGTCGAGGTGCACAACGCCAAAACCAAGCCC<br>CGCGAGGAGCAGTATAACAGCACCTATCGAGTGGTGAGCGTGCTTACCGTGC<br>TCCACCAGGACTGGCTGAACGGGAAGGAGTACAAGTGCAAGGTGTCCAACAA<br>GGCCCTGCCCGCCCCCATCGAGAAGACCATTTCCAAGGCCAAGGGGCAACCC<br>AGGGAGCCCCAAGTGTACACCCTGCCCCCCAGCCGCGAGGAGATGACGAAAA<br>ACCAGGTGTCCCTGACCTGCCTGGTCAAGGGCTTCTACCCCTCCGACATCGC<br>CGTGGAGTGGGAATCCAACGGCCAGCCCGAGAACAATTACAAGACAACCCCG<br>CCCGTGCTCGACTCCGACGGCAGCTTTTTCCTGTACAGCAAGCTGACCGTCG<br>ACAAGAGCCGTTGGCAGCAGGGGAACGTGTTCAGCTGCAGCGTCATGCACGA<br>GGCCCTGCACAACCATTATACTCAGAAAAGCCTGAGCCTGAGCCCCGGCAAG |
| 469 | IPI_HC-CO24 | ATGGAGACGCCGGCCCAACTCCTCTTCCTCCTCCTCCTCTGGCTCCCCGACA<br>CCACCGGCCAGGTTCAACTGGTCGAGTCGGGCGGGGGCGTCGTCCAGCCCGG<br>CCGGAGCCTCAGGCTCTCGTGCGCCGCCAGCGGTTTCACCTTCAGCAGCTAC<br>ACCATGCACTGGGTCCGACAGGCCCCCGGCAAGGGCCTCGAGTGGGTCACCT<br>TCATCAGCTACGACGGCAACAACAAATATTACGCCGACAGCGTAAAGGGCCG<br>GTTTACCATCAGCAGGGACAACTCCAAGAACACCCTCTACCTCCAGATGAAC<br>AGCCTGCGCGCCGAAGACACCGCCATCTACTACTGTGCCAGGACCGGCTGGC<br>TCGGCCCCTTCGACTACTGGGGGCAGGGGACCCTGGTGACCGTGTCATCGGC<br>CAGCACGAAGGGCCCCAGCGTCTTCCCCCTGGCGCCCTCCAGCAAGAGCACC<br>TCCGGCGGCACCGCCGCCCTGGGATGCCTGGTGAAGGATTACTTCCCGGAGC<br>CCGTGACAGTGTCCTGGAACTCCGGCGCACTGACCAGCGGCGTGCATACCTT<br>TCCCGCCGTGCTGCAGAGCAGCGGCCTGTATTCCCTGAGTAGCGTGGTGACC<br>GTGCCCTCCAGCAGCCTCGGGACCCAAACCTACATCTGCAATGTGAATCACA<br>AGCCGAGCAACACCAAGGTGGACAAGCGGGTGGAACCCAAGTCCTGCGATAA<br>GACCCACACCTGCCCGCCGTGCCCGGCCCCCGAGCTGCTGGGGGGTCCGAGC<br>GTGTTCCTGTTCCCGCCAAAGCCCAAGGACACGCTGATGATCTCGCGCACGC<br>CAGAGGTGACCTGCGTCGTGGTGGACGTGAGCCACGAGGACCCCGAGGTGAA<br>GTTCAACTGGTATGTCGACGGGGTCGAGGTGCACAACGCCAAGACCAAGCCC<br>CGGGAGGAGCAGTACAATTCCACCTACAGGGTGGTGTCCGTGCTGACCGTGC<br>TGCACCAGGACTGGCTCAATGGCAAGGAGTACAAGTGCAAGGTGAGCAACAA<br>GGCCCTGCCCGCCCCCATTGAGAAGACAATCTCCAAGGCCAAGGGTCAGCCA<br>AGGGAGCCCCAGGTGTACACGCTCCCGCCCAGCAGGGAGGAAATGACCAAGA<br>ACCAGGTGAGCCTGACCTGTCTGGTGAAGGGCTTCTACCCAAGCGACATCGC<br>CGTGGAATGGGAGTCCAACGGGCAGCCGGAGAACAACTACAAGACTACCCCG<br>CCCGTGCTGGACAGCGACGGCTCGTTCTTCCTGTACAGCAAGCTGACCGTGG<br>ACAAGAGCAGGTGGCAGCAGGGGAACGTATTTAGCTGCTCCGTGATGCACGA<br>GGCCCTGCACAACCATTACACCCAGAAGTCACTGAGCCTGAGCCCCGGAAAG |

TABLE 3-continued

Optimized Tremelimumab and Ipilimumab Sequences

| SEQ ID NO | Description | Sequence |
|---|---|---|
| 470 | IPI_HC-CO25 | ATGGAGACTCCCGCCCAGCTACTCTTCCTCCTCCTCCTCTGGCTCCCGGACACCACCGGCCAGGTCCAGCTCGTCGAGAGCGGCGGCGGAGTCGTCCAGCCCGGGCGCAGCCTTAGGCTCAGCTGCGCCGCCTCCGGCTTCACGTTCTCCTCCTACACCATGCACTGGGTCAGGCAGGCCCCCGGCAAGGGCCTCGAGTGGGTTACGTTTATCTCCTACGACGGGAACAACAAATACTACGCCGACTCCGTAAAGGGCAGGTTCACCATCTCCAGGGACAACAGCAAAAACACGCTCTACCTGCAGATGAACAGCCTGCGGGCCGAGGACACGGCCATCTACTACTGCGCCAGGACGGGGTGGCTGGGTCCCTTCGACTACTGGGGCCAGGGCACCCTGGTGACCGTGTCATCCGCCTCCACCAAGGGGCCCTCAGTGTTCCCCCTGGCCCCCAGCAGCAAGAGCACCTCCGGGGGGACCGCCGCCCTGGGCTGCCTCGTGAAAGACTACTTTCCCGAGCCGGTCACCGTGTCCTGGAACAGCGGAGCCCTGACCTCGGGCGTGCACACCTTCCCCGCCGTCCTCCAGTCCTCAGGCCTCTACAGCCTGTCAAGCGTGGTGACCGTGCCCAGCAGCAGCCTGGGGACCCAGACTTACATCTGCAATGTGAACCACAAGCCCAGCAATACCAAAGTGGACAAGAGGGTGGAGCCCAAATCCTGCGACAAGACCCACACGTGTCCCCCTTGCCCCGCCCCTGAGCTGCTGGGCGGGCCCAGCGTGTTCCTGTTTCCCCCCAAGCCGAAGGACACGCTCATGATCTCACGAACCCCCGAAGTGACCTGCGTGGTGGTGGACGTGAGCCACGAGGACCCCGAGGTGAAGTTCAACTGGTACGTGGATGGCGTGGAGGTGCACAACGCCAAGACCAAGCCCCGAGAGGAGCAGTACAATTCCACCTACCGGGTGGTGTCCGTGCTAACCGTGCTGCATCAGGATTGGCTGAATGGCAAGGAGTATAAATGCAAGGTGAGCAACAAGGCCCTCCCCGCCCCCATCGAGAAGACCATCAGTAAGGCCAAAGGACAACCCAGGGAGCCCCAGGTGTACACGCTGCCCCCAAGCAGGGAGGAAATGACCAAAAACCAGGTGAGCCTCACCTGCCTGGTGAAGGGTTTTTACCCCAGCGATATCGCAGTGGAGTGGGAGAGCAACGGCCAGCCCGAGAACAATTACAAGACGACCCCTCCCGTGCTGGACAGCGACGGGAGCTTCTTTCTCTACAGCAAGCTGACCGTGGACAAGAGCAGGTGGCAGCAGGGTAATGTGTTTAGCTGCAGCGTGATGCACGAGGCGCTGCACAACCACTACACCCAGAAAAGCCTGAGCCTGTCCCCCGGGAAG |

Polynucleotide comprising one or more mRNAs encoding an antibody or an antigen binding portion thereof which specifically binds to CTLA-4: In certain embodiments, an anti-CTLA-4 polynucleotide of the present disclosure (e.g., one or more mRNAs encoding an antibody or an antigen binding portion thereof which specifically binds to CTLA-4) comprises (i) a 5' UTR, such as one of the 5' UTR sequences disclosed below, comprising a 5' cap provided below;

(ii) an ORF encoding an antibody or an antigen binding portion thereof which specifically binds to CTLA-4, e.g., an ORF disclosed in TABLE 1, TABLE 2 or TABLE 3 or a polynucleotide sequence encoding any of the protein sequences provided in TABLE 1 or TABLE 2 above or a combination thereof;

(iii) a stop codon, (iv) a 3' UTR, such as one of the 3' UTR sequences disclosed below; and, (v) a poly-A tail provided below.

In some embodiments, the anti-CTLA-4 polynucleotide further comprises a miRNA binding site, e.g., a miRNA binding site that binds to miRNA122. In some embodiments, the 3'UTR comprises the miRNA binding site.

In some embodiments, an anti-CTLA-4 polynucleotide of the present disclosure (e.g., a polynucleotide comprising one or more mRNAs encoding an antibody or an antigen binding portion thereof which specifically binds to CTLA-4) encodes a polypeptide sequence at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to any of the antibody heavy chains (HC) or light chains (LC) of TABLE 1, or to a subsequence thereof comprising, consisting, or consisting essentially of:

(i) one, two or three VH-CDRs;

(ii) one, two or three VL-CDRs;

(iii) a VH;

(iv) a VL;

(v) a HC;

(vi) a LC;

(vii) a fragment thereof; or, (viii) a combination thereof.

B. Cluster of Differentiation 80 (CD80)

In some embodiments, the combination therapies disclosed herein comprise one or more CD80 polynucleotides (e.g., mRNAs), i.e., polynucleotides comprising one or more ORFs encoding a CD80 polypeptide (e.g., a CD80Fc fusion protein).

Cluster of Differentiation 80 (CD80), also known as B7-1, is a cell surface protein present on most antigen-presenting cells and it is involved in the costimulatory signal essential for T-lymphocyte activation. CD80 bind two receptors on the surface of T-cell: cluster of differentiation 28 (CD28) and cytotoxic T-lymphocyte antigen-4 (CTLA-4). CD80 provides critical costimulatory or inhibitory input to T cells via interaction with either CD28 (a T cell-expressed receptor providing a costimulatory response) or CTLA-4 (a T cell-expressed receptor providing an inhibitory response).

Binding of CD80 to CD28 promotes T cell activation and survival, whereas binding of CD80 to CTLA-4 acts to negatively regulate T-cell activation. Because of its important role in regulating T cell activity, the CD80 protein have been considered as drug targets in oncology. See, e.g., Brzostek J et al., *Front. Immunol.* 7(24) (2016). For example, researchers have investigated the antitumor effectiveness of administering a therapeutic comprising a fusion protein combining CD80's extracellular domain with IgG Fc. See Liu A et al., *Clin. Cancer Res.* 11(23):8492-8502 (2005).

CD80 is a member of the immunoglobulin superfamily, and is expressed as a dimer. The structure of CD80 comprises an extracellular domain (208 residues), a single transmembrane domain (21 residues), and an intracellular domain (25 residues). There are at least three isoforms of CD80, isoforms 1, 2, and 3.

The coding sequence (CDS) for wild type human CD80 canonical mRNA sequence, is described at the NCBI Reference Sequence database (RefSeq) under accession number NM_005191.3 ("*Homo sapiens* CD80 molecule (CD80), mRNA"). The wild type CD80 canonical protein sequence, isoform 1, is described at the RefSeq database under accession number NP_005182.1 ("T-lymphocyte activation antigen CD80 precursor [*Homo sapiens*]"). The CD80 isoform 2 (UniProtKB identifier P33681-2) comprises a substitution of a single Ser residue in place of amino acid residues 234-266 of the full length CD80 isoform 1, resulting in a soluble isoform of CD80. The CD80 isoform 3 (UniProtKB identifier P33681-3) comprises an A140G substitution and a deletion of amino acids 141-266, resulting in a soluble isoform of CD80. It is noted that the specific nucleic acid sequences encoding the reference protein sequence in the RefSeq sequences are the coding sequence (CDS) as indicated in the respective RefSeq database entry. The precursor form of CD80, isoform 1, is 288 amino acids in length, while its mature form (processed by removal of it signal peptide) is 254 amino acids long. See TABLE 4.

TABLE 4

| SEQ ID NO | Description | Sequence | Comments |
|---|---|---|---|
| 471 | Human CD80, isoform 1. Protein sequence. Signal peptide from position 1 to 34 (underlined). EC from position 35 to 242. Cytoplasmic domain from position 264 to 288. TM helix from position 243 to 263. | MGHTRRQGTSPSKCPYLNFFQLLVLAGLSHFCSGVIH<br>VTKEVKEVATLSCGHNVSVEELAQTRIYWQKEKKMVL<br>TMMSGDMNIWPEYKNRTIFDITNNLSIVILALRPSDE<br>GTYECVVLKYEKDAFKREHLAEVTLSVKADFPTPSIS<br>DFEIPTSNIRRIICSTSGGFPEPHLSWLENGEELNAI<br>NTTVSQDPETELYAVSSKLDFNMTTNHSFMCLIKYGH<br>LRVNQTFNWNTTKQEHFPDNLLPSWAITLISVNGIFV<br>ICCLTYCFAPRCRERRRNERLRRESVRPV | Isoform 1 has been chosen as the 'canonical' sequence. All positional information refers to the positions in the canonical sequence. |
| 472 | Human CD80, isoform 1. Nucleic acid sequence. Underlined nucleobases indicate region encoding the signal peptide; Bold nucleobases indicate region encoding the extracellular domain. | ATGGGCCACACACGGAGGCAGGGAACATCACCATCCA<br>AGTGTCCATACCTCAATTTCTTTCAGCTCTTGGTGCT<br>GGCTGGTCTTTCTCACTTCTGTTCAGGTGTTATCCAC<br>GTGACCAAGGAAGTGAAAGAAGTGGCAACGCTGTCCT<br>GTGGTCACAATGTTTCTGTTGAAGAGCTGGCACAAAC<br>TCGCATCTACTGGCAAAAGGAGAAGAAAATGGTGCTG<br>ACTATGATGTCTGGGGACATGAATATATGGCCCGAGT<br>ACAAGAACCGGACCATCTTTGATATCACTAATAACCT<br>CTCCATTGTGATCCTGGCTCTGCGCCCATCTGACGAG<br>GGCACATACGAGTGTGTTGTTCTGAAGTATGAAAAAG<br>ACGCTTTCAAGCGGGAACACCTGGCTGAAGTGACGTT<br>ATCAGTCAAAGCTGACTTCCCTACACCTAGTATATCT<br>GACTTTGAAATTCCAACTTCTAATATTAGAAGGATAA<br>TTTGCTCAACCTCTGGAGGTTTTCCAGAGCCTCACCT<br>CTCCTGGTTGGAAAATGGAGAAGAATTAAATGCCATC<br>AACACAACAGTTTCCCAAGATCCTGAAACTGAGCTCT<br>ATGCTGTTAGCAGCAAACTGGATTTCAATATGACAAC<br>CAACCACAGCTTCATGTGTCTCATCAAGTATGGACAT<br>TTAAGAGTGAATCAGACCTTCAACTGGAATACAACCA<br>AGCAAGAGCATTTTCCTGATAACCTGCTCCCATCCTG<br>GGCCATTACCTTAATCTCAGTAAATGGAATTTTTGTG<br>ATATGCTGCCTGACCTACTGCTTTGCCCCAAGATGCA<br>GAGAGAGAAGGAGGAATGAGAGATTGAGAAGGGAAAG<br>TGTACGCCCTGTATAACAGTGTCCGCAGAAGCAAGGG<br>GCTGAAAAGATCTGAAGGTCCCACCTCCATTTGCAAT<br>TGACCTCTTCTGGGAACTTCCTCAGATGGACAAGATT<br>ACCCCACCTTGCCCTTTACGTATCTGCTCTTAGGTGC<br>TTCTTCACTTCAGTTGCTTTGCAGGAAGTGTCTAGAG<br>GAATATGGTGGGCACAGAAG | |
| 473 | CD80Fc construct, protein sequence. Signal peptide in italics, EC domain of CD80 is underlined, Fc region in bold | *MGHTRRQGTSPSKCPYLNFFQLLVLAGLSHFCSG*VIH<br>VTKEVKEVATLSCGHNVSVEELAQTRIYWQKEKKMVL<br>TMMSGDMNIWPEYKNRTIFDITNNLSIVILALRPSDE<br>GTYECVVLKYEKDAFKREHLAEVTLSVKADFPTPSIS<br>DFEIPTSNIRRIICSTSGGFPEPHLSWLENGEELNAI<br>NTTVSQDPETELYAVSSKLDFNMTTNHSFMCLIKYGH<br>LRVNQTFNWNTTKQEHFPD**DKTHTCPPCPAPELLGGP**<br>**SVFLFPPKPKDTLMISRTPEVTCVVVDVSHEDPEVKF**<br>**NWYVDGVEVHNAKTKPREEQYNSTYRVVSVLTVLHQD**<br>**WLNGKEYKCKVSNKALPAPIEKTISKAKGQPREPQVY**<br>**TLPPSRDELTKNQVSLTCLVKGFYPSDIAVEWESNGQ**<br>**PENNYKTTPPVLDSDGSFFLYSKLTVDKSRWQQGNVF**<br>**SCSVMHEALHNHYTQKSLSLSPGK** | |

TABLE 4-continued

| SEQ ID NO | Description | Sequence | Comments |
|---|---|---|---|
| 474 | CD80Fc, nucleic acid sequence. Region encoding the signal peptide in italics. | *ATGGGCCACACACGGAGGCAGGGAACATCACCATCCA*<br>*AGTGTCCATACCTCAATTTCTTTCAGCTCTTGGTGCT*<br>*GGCTGGTCTTTCTCACTTCTGTTCAGGT*GTTATCCAC<br>GTGACCAAGGAAGTGAAAGAAGTGGCAACGCTGTCCT<br>GTGGTCACAATGTTTCTGTTGAAGAGCTGGCACAAAC<br>TCGCATCTACTGGCAAAAGGAGAAGAAAATGGTGCTG<br>ACTATGATGTCTGGGGACATGAATATATGGCCCGAGT<br>ACAAGAACCGGACCATCTTTGATATCACTAATAACCT<br>CTCCATTGTGATCCTGGCTCTGCGCCCATCTGACGAG<br>GGCACATACGAGTGTGTTGTTCTGAAGTATGAAAAAG<br>ACGCTTTCAAGCGGGAACACCTGGCTGAAGTGACGTT<br>ATCAGTCAAAGCTGACTTCCCTACACCTAGTATATCT<br>GACTTTGAAATTCCAACTTCTAATATTAGAAGGATAA<br>TTTGCTCAACCTCTGGAGGTTTTCCAGAGCCTCACCT<br>CTCCTGGTTGGAAAATGGAGAAGAATTAAATGCCATC<br>AACACAACAGTTTCCCAAGATCCTGAAACTGAGCTCT<br>ATGCTGTTAGCAGCAAACTGGATTTCAATATGACAAC<br>CAACCACAGCTTCATGTGTCTCATCAAGTATGGACAT<br>TTAAGAGTGAATCAGACCTTCAACTGGAATACAACCA<br>AGCAAGAGCATTTTCCTGATGACAAAACTCACACATG<br>CCCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGGT<br>GGTGGACGTGAGCCACGAAGACCCTGAGGTCAAGTTC<br>AACTGGTACGTGGACGGCGTGGAGGTGCATAATGCCA<br>AGACAAAGCCGCGGGAGGAGCAGTACAACAGCACGTA<br>CCGGGTGGTCAGCGTCCTCACCGTCCTGCACCAGGAC<br>TGGCTGAATGGCAAGGAGTACAAGTGCAAGGTCTCCA<br>ACAAAGCCCTCCCAGCCCCCATCGAGAAAACCATCTC<br>CAAAGCCAAAGGGCAGCCCCGAGAACCACAGGTGTAC<br>ACCCTGCCCCCATCCCGGGATGAGCTGACCAAGAACC<br>AGGTCAGCCTGACCTGCCTGGTCAAAGGCTTCTATCC<br>CAGCGACATCGCCGTGGAGTGGGAGAGCAATGGGCAG<br>CCGGAGAACAACTACAAGACCACGCCTCCCGTGCTGG<br>ACTCCGACGGCTCCTTCTTCCTCTACAGCAAGCTCAC<br>CGTGGACAAGAGCAGGTGGCAGCAGGGGAACGTCTTC<br>TCATGCTCCGTGATGCATGAGGCTCTGCACAACCACT<br>ACACGCAGAAGAGCCTCTCCCTGTCTCCGGGTAAA | |

In certain embodiments, the combination therapies disclosed herein comprise a CD80 polynucleotide comprising a nucleic acid sequence encoding a CD80 polypeptide. In some embodiments, the CD80 polypeptide functions as an immune response co-stimulatory signal polypeptide. The CD80 polypeptide can be a full sequence CD80, a mature CD80 (i.e., without signal peptide), a fragment thereof having a CD80 activity, or a fusion protein thereof.

In some embodiments, the CD80 polypeptide comprises the extracellular domain (EC) of CD80 or a fragment thereof having a CD80 activity. In some embodiments, the CD80 polypeptide is a variant, i.e., a peptide or a polypeptide containing a substitution, and insertion and/or an addition, a deletion and/or a covalent modification with respect to the corresponding wild-type CD80 sequence.

As used herein, the term "CD80 polypeptide" refers to a polypeptide having CD80 activity, e.g., a polypeptide capable of interacting with CD28 and/or CTLA-4 and eliciting an immune response, e.g., activation of T cells on binding of CD28 or attenuation of T cell activation on binding of CTLA-4. As used herein the term "CD80 polynucleotide" refers to a polynucleotide comprising an ORF encoding a CD80 polypeptide disclosed herein.

In some embodiments, the CD80 polypeptide is a truncated variant of wild type CD80. In some embodiments, the CD80 polypeptide is the CD80, wherein the CD80 does not comprise a signaling peptide. In some embodiments, the CD80 polypeptide comprises the EC domain or a portion thereof having CD80 activity. In other embodiments, the CD80 polypeptide comprises the EC domain or a portion thereof having CD80 activity and all or part of the transmembrane domain. In other embodiments, the CD80 polypeptide comprises the EC domain and all or part of the cytoplasmic domain.

In certain embodiments, the CD80 polypeptide comprises amino acids 35-230, 35-231, 35-232, 35-233, 35-234, 35-235, 35-236, 35-237, 35-238, 35-239, 35-240, 35-241, or 35-242 of wild type CD80 isoform 1 (SEQ ID NO:471). In other embodiments, the CD80 polypeptide comprises amino acids 35-243, 35-244, 35-245, 35-246, 35-247, 35-248, 35-249, 35-250 of wild type CD80 isoform 1 (SEQ ID NO:471). In one embodiment, the CD80 polypeptide comprises amino acids 35-241 of wild type CD80 isoform 1 (SEQ ID NO:471). In another embodiment, the CD80 polypeptide comprises amino acids 35-242 of wild type CD80 isoform 1 (SEQ ID NO:471). In one particular embodiment, the CD80 polypeptide comprises amino acids 35-241 of SEQ ID NO:473 (CD80 Fc construct). In certain embodiments, the CD80 polypeptide comprises or consists or consists essentially of the EC domain or a portion thereof having CD80 activity, the TM domain, and the CP domain.

In some embodiments, the CD80 polypeptide comprises one or more amino acids of the TM domain of a full-length or mature CD80 polypeptide. In certain embodiments, the one or more amino acids of the TM domain comprises, consists of, or consists essentially of D, DK, DKT, DKTH (SEQ ID NO: 475), DKTHT (SEQ ID NO: 476), DKTHTC (SEQ ID NO: 477), or DKTHTCP (SEQ ID NO: 478).

In other embodiments, the CD80 polypeptide comprises one or more amino acids of the CP domain of a full-length or mature CD80 polypeptide. In certain embodiments, the one or more amino acids of the CP domain comprises, consists of, or consists essentially of F, FA, FAP, FAPR (SEQ ID NO: 479), FAPRC (SEQ ID NO: 480), FAPRCR (SEQ ID NO: 481), FAPRCRE (SEQ ID NO: 482), FAPRCRER (SEQ ID NO: 483), FAPRCRERR (SEQ ID NO: 484), FAPRCRERRR (SEQ ID NO: 485), FAPRCRERRRN (SEQ ID NO: 486), FAPRCRERRRNE (SEQ ID NO: 487), FAPRCRERRRNER (SEQ ID NO: 488), FAPRCRERRRNERL (SEQ ID NO: 489), FAPRCRERRRNERLR (SEQ ID NO: 490), FAPRCRERRRNERLRR (SEQ ID NO: 491), FAPRCRERRRNERLRRE (SEQ ID NO: 492), FAPRCRERRRNERLRRES (SEQ ID NO: 493), FAPRCRERRRNERLRRESV (SEQ ID NO: 494), FAPRCRERRRNERLRRESVR (SEQ ID NO: 495), FAPRCRERRRNERLRRESVRP (SEQ ID NO: 496), or FAPRCRERRRNERLRRESVRPV (SEQ ID NO: 497). In another embodiment, the CD80 polypeptide comprises a CP fragment consisting or consisting essentially of one, two, three, four, five, six, seven, eight, nine, ten, 11, 12, 13, 14, 15, 16, 17, 18, 19, 20, 21, 22, 23, 24, or 25 amino acids of a CP domain of a full-length or mature CD80 polypeptide.

In some embodiments, sequence tags or amino acids, can be added to the sequences encoded by the CD80 polynucleotides of the present disclosure (e.g., at the N-terminal or C-terminal ends), e.g., for localization. In some embodiments, amino acid residues located at the carboxy, amino terminal, or internal regions of a CD80 polypeptide disclosed herein (e.g., a CD80Fc) can optionally be deleted providing for fragments.

In some embodiments, the CD80 polynucleotide (e.g., a RNA, e.g., a mRNA) comprising a nucleotide sequence (e.g., an ORF) encoding a CD80 polypeptide encodes a substitutional variant of a CD80 sequence, which can comprise one, two, three or more than three substitutions. In some embodiments, the CD80 substitutional variant can comprise one or more conservative amino acids substitutions. In other embodiments, the CD80 variant is an insertional variant. In other embodiments, the CD80 variant is a deletional variant.

Certain compositions and methods presented in this disclosure refer to the protein or polynucleotide sequences of CD80. A person skilled in the art will understand that such disclosures are equally applicable to any other isoforms of CD80 known in the art.

In some embodiments, the CD80 polypeptide comprises an amino acid sequence at least about 80%, at least about 85%, at least about 90%, at least about 95%, at least about 95%, about 96%, at least about 97%, at least about 98%, at least about 99%, or about 100% identical to amino acids 35 to 241 of SEQ ID NO: 473 (i.e., the CD80Fc fusion polypeptide disclosed herein).

In other embodiments, the CD80 polypeptide comprises a CP domain of a full-length or mature CD80 polypeptide or an isoform thereof, a TM domain of a full-length or mature CD80 polypeptide, and an EC domain of a full-length or mature CD80 polypeptide or a portion thereof having a CD80 activity, wherein the CP domain has an amino acid sequence having at least about 80%, at least about 85%, at least about 90%, at least about 95%, at least about 95%, about 96%, at least about 97%, at least about 98%, at least about 99%, or about 100% identical to amino acids 264-288 of SEQ ID NO: 471, wherein the TM domain has an amino acid sequence having at least about 80%, at least about 85%, at least about 90%, at least about 95%, at least about 95%, about 96%, at least about 97%, at least about 98%, at least about 99%, or about 100% identical to amino acids 243-263 of SEQ ID NO: 471, and/or wherein the EC domain or the portion thereof has an amino acid sequence consisting at least about 80%, at least about 85%, at least about 90%, at least about 95%, at least about 95%, about 96%, at least about 97%, at least about 98%, at least about 99%, or about 100% identical to amino acids 35 to 241 of SEQ ID NO: 473 (i.e., the CD80Fc fusion polypeptide disclosed herein) or a corresponding portion thereof.

In certain embodiments, the CD80 polypeptide can be fused to a signal peptide. In one embodiment, the signal peptide is a naturally occurring CD80 signal peptide. In another embodiment, the signal peptide is a heterologous signal peptide. In other embodiments, the signal peptide comprises an amino acid sequence having at least about 80%, at least about 85%, at least about 90%, at least about 95%, at least about 95%, about 96%, at least about 97%, at least about 98%, at least about 99%, or about 100% identical to amino acids 1-34 of SEQ ID NO: 473.

In other embodiments, the CD80 polypeptide can be a fusion protein, which is fused to one or more heterologous polypeptide. In one embodiment, the CD80 polypeptide is fused to one or more Fc regions.

In some embodiments, the combination therapies disclosed herein comprise a polynucleotide comprising an ORF encoding any of the CD80 polypeptides, e.g., a CD80Fc polypeptide, disclosed herein, including the CD80 polypeptides encoding by the sequence-optimized polynucleotides disclosed herein.

CD80 Fusions Comprising Fragment Crystallizable (Fc) Regions:

In some embodiments, the CD80 polynucleotides used in the combination therapies disclosed herein comprise an ORF encoding a CD80 polypeptide genetically fused to a fragment crystallizable region (Fc) (see, e.g., SEQ ID NOs: 473 and 474 in TABLE 4). A fragment crystallizable (Fc) Region is portion of an immunoglobulin polypeptide that interacts with Fc receptors on the surface of cells, activating the immune response. Fc regions can further interact with other Fc regions to form homodimers through disulfide bonds. Engineered Fc regions can be fused to heterologous polypeptides for various purposes, including but not limited to in vivo half-life extension, immunohistochemistry, flow cytometry, binding assays, as Fc-fusion baits in microarray technologies, and to increase in vivo and in vitro solubility and/or stability.

As used herein, the terms "Fc region" or "Fc" refer to a polypeptide having an Fc activity, e.g., a polypeptide capable of interacting with an Fc receptor. In some embodiments, the Fc region is an IgG Fc region, e.g., IgG1 Fc, IgG2 Fc, IgG3 Fc, or IgG4 Fc, or a fragment thereof having an Fc activity.

In one particular embodiment, the Fc region is an IgG1 Fc region. In some embodiments, the Fc region comprises an amino acid sequence at least about 80%, at least about 85%, at least about 90%, at least about 95%, at least about 95%, about 96%, at least about 97%, at least about 98%, at least about 99%, or about 100% identical to the wild type amino acid sequence of IgG1 Fc (GenBank: AAC82527.1; "immunoglobulin gamma-1 heavy chain constant region, partial [*Homo sapiens*]").

In other embodiments, the Fc region comprises an amino acid sequence having at least about 80%, at least about 85%, at least about 90%, at least about 95%, at least about 95%, about 96%, at least about 97%, at least about 98%, at least about 99%, or about 100% identical to amino acids 242-468 of SEQ ID NO: 473. In some embodiments, the Fc region or the fragment thereof is a variant, a peptide or a polypeptide containing a substitution, and insertion and/or an addition, a deletion and/or a covalent modification with respect to the corresponding wild-type Fc sequence.

In some embodiments, sequence tags or amino acids, can be added to the sequences encoded by the polynucleotides (e.g., at the N-terminal or C-terminal ends), e.g., for localization. In some embodiments, amino acid residues located at the carboxy, amino terminal, or internal regions of a polypeptide can optionally be deleted providing for fragments.

In some embodiments, the CD80 polynucleotide (e.g., a RNA, e.g., a mRNA) comprising a nucleotide sequence (e.g., an ORF) encoding a CD80 polypeptide, encodes a substitutional variant of an Fc sequence, which can comprise one, two, three or more than three substitutions. In some embodiments, the Fc substitutional variant can comprise one or more conservative amino acids substitutions. In other embodiments, the Fc variant is an insertional variant. In other embodiments, the Fc variant is a deletional variant.

Certain compositions and methods presented in this disclosure refer to the protein or polynucleotide sequences of Fc. A person skilled in the art will understand that such disclosures are equally applicable to any other Fc regions known in the art, e.g., Fc regions from other immunoglobulin proteins, or Fc regions comprising specific mutations to confer desirable characteristic to the Fc or Fc fusion protein, such as mutations to extend plasma half life.

In some embodiments, the Fc region is fused to a CD80 polypeptide or a portion thereof having a CD80 activity. In some embodiments, the CD80 polynucleotides used in the combination therapies disclosed herein comprise ORFs encoding any CD80Fc polypeptides encoded by the sequence-optimized polynucleotides disclosed herein.

CD80 Polynucleotides and Open Reading Frames (ORFs):

The CD80 polynucleotides disclosed herein includes any polynucleotides (e.g., DNA or RNA, e.g., mRNA) that comprise a nucleotide sequence (e.g., an ORF) encoding one or more CD80 polypeptides; one or more Fc regions; and/or one or more CD80Fc fusion polypeptides.

In some embodiments, the CD80 polynucleotide encodes a CD80 polypeptide selected from:

(i) a CD80 polypeptide comprising an EC domain of CD80 with or without a signal peptide;

(ii) a CD80 polypeptide comprising an EC fragment comprising, consisting essentially of, or consisting of amino acids 35-230, 35-231, 35-232, 35-233, 35-234, 35-235, 35-236, 35-237, 35-238, 35-239, 35-240, 35-241, or 35-242 of wild type CD80 isoform 1 (SEQ ID NO: 471) with or without a signal peptide;

(iii) a CD80 comprising an EC domain of CD80 and one or more amino acids of the TM domain comprising, consisting of, or consisting essentially of D, DK, DKT, DKTH (SEQ ID NO: 475), DKTHT (SEQ ID NO: 476), DKTHTC (SEQ ID NO: 477), or DKTHTCP (SEQ ID NO: 478);

(iv) a CD80 comprising an EC domain of CD80 and one or more amino acids of the CP domain comprising, consisting of, or consisting essentially of F, FA, FAP, FAPR (SEQ ID NO: 479), FAPRC (SEQ ID NO: 480), FAPRCR (SEQ ID NO: 481), FAPRCRE (SEQ ID NO: 482), FAPRCRER (SEQ ID NO: 483), FAPRCRERR (SEQ ID NO: 484), FAPRCRERRR (SEQ ID NO: 485), FAPRCRERRRN (SEQ ID NO: 486), FAPRCRERRRNE (SEQ ID NO: 487), FAPRCRERRRNER (SEQ ID NO: 488), FAPRCRERRRNERL (SEQ ID NO: 489), FAPRCRERRRNERLR (SEQ ID NO: 490), FAPRCRERRRNERLRR (SEQ ID NO: 491), FAPRCRERRRNERLRRE (SEQ ID NO: 492), FAPRCRERRRNERLRRES (SEQ ID NO: 493), FAPRCRERRRNERLRRESV (SEQ ID NO: 494), FAPRCRERRRNERLRRESVR (SEQ ID NO: 495), FAPRCRERRRNERLRRESVRP (SEQ ID NO: 496), or FAPRCRERRRNERLRRESVRPV (SEQ ID NO: 497); and (v) a fusion protein comprising (i) a CD80 polypeptide, a functional fragment or a variant thereof, and (ii) an Fc region.

In some embodiments, the CD80 polynucleotide can also encode:

(i) a CD80 polypeptide (e.g., having the same or essentially the same length as wild-type CD80 isoform 1, 2, or 3) with or without a signal peptide;

(ii) a CD80 functional fragment of any of the CD80 isoforms described herein (e.g., a truncated (e.g., deletion of carboxy, amino terminal, or internal regions) sequence shorter than one of wild-type isoforms 1, 2, or 3; but still retaining CD80 activity);

(iii) a CD80 variant thereof (e.g., full-length, mature, or truncated CD80 isoform 1, 2, or 3 proteins in which one or more amino acids have been replaced, e.g., variants that retain all or most of the CD80 activity of the polypeptide with respect to a reference isoform); or, (iv) a CD80 fusion protein comprising (i) the CD80 polypeptide, a functional fragment, or a variant thereof, with or without a signal peptide and (ii) a heterologous protein, e.g., an Fc region.

In other embodiments, the CD80 polynucleotide can also encode:

(i) a wild-type Fc region (e.g., having the same or essentially the same length as wild-type Fc, e.g., IgG1 Fc);

(ii) an Fc functional fragment of an Fc regions known in the art (e.g., a truncated (e.g., deletion of carboxy, amino terminal, or internal regions) sequence);

(iii) an Fc variant thereof (e.g., full-length, mature, or truncated Fc regions in which one or more amino acids have been replaced, e.g., variants that retain all or most of the Fc activity of the polypeptide with respect to a reference Fc); or (iv) an Fc fusion protein comprising (i) an Fc region, a functional fragment, or a variant thereof, and (ii) a heterologous protein, e.g., a CD80 polypeptide disclosed herein.

In certain embodiments, the encoded CD80 polypeptide, e.g., a CD80 polypeptide comprising the EC domain of CD80 or a functional portion thereof, is a mammalian CD80 polypeptide, such as a human CD80 polypeptide, a functional fragment or a variant thereof.

In some embodiments, the CD80 polynucleotide (e.g., a RNA, e.g., a mRNA) increases CD80 or Fc, protein expression levels and/or detectable CD80, e.g., a CD80 polypeptide comprising the EC domain of CD80 or a functional portion thereof, activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to CD80 protein expression levels and/or detectable CD80 activity levels in the cells prior to the administration of the CD80 polynucleotide.

The CD80 protein expression levels and/or CD80 activity can be measured according to methods know in the art. In some embodiments, the CD80 polynucleotide is introduced to the cells in vitro. In some embodiments, the CD80 polynucleotide is introduced to the cells in vivo.

In some embodiments, the CD80 polynucleotide (e.g., a RNA, e.g., a mRNA) comprises a codon optimized nucleic acid sequence, wherein the open reading frame (ORF) of the codon optimized nucleic sequence is derived from a wild-type CD80 sequence. For example, for CD80 polynucleotides comprising a sequence optimized ORF encoding CD80, the corresponding wild type sequence is the native CD80, isoform 1.

In some embodiments, the CD80 polynucleotide (e.g., a RNA, e.g., a mRNA) comprises a nucleotide sequence (e.g., an ORF) that encodes a CD80 polypeptide, e.g., a CD80 polypeptide comprising the EC domain of CD80 or a functional portion thereof, with mutations that do not alter CD80 activity. Such mutant CD80 polypeptides can be referred to as function-neutral. In some embodiments, the CD80 polynucleotide comprises an ORF that encodes a mutant CD80 polypeptide, e.g., a CD80 polypeptide comprising the EC domain of CD80 or a functional portion thereof, comprising one or more function-neutral point mutations.

In some embodiments, the mutant CD80 polypeptide has higher CD80 activity than the corresponding wild-type CD80. In some embodiments, the mutant CD80 polypeptide has a CD80 activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type CD80.

In some embodiments, the CD80 polynucleotide (e.g., a RNA, e.g., a mRNA) comprises a nucleotide sequence (e.g., an ORF) encoding a CD80 fragment that has higher CD80 activity than the corresponding full-length or mature CD80. Thus, in some embodiments the CD80 fragment, e.g., a CD80 polypeptide comprising the EC domain of CD80 or a functional portion thereof, has a CD80 activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the CD80 activity of the corresponding full-length or mature CD80.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, or 25% shorter than the amino acid sequence as set forth in amino acids 35 to 241 of SEQ ID NO: 473.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the CD80 polypeptide comprises an amino acid sequence at least 70%, at least 75%, at least 80%, at least 85%, at least 90%, at least 95%, at least 96%, at least 97%, at least 98%, at least 99%, or 100% identical to amino acids 35 to 241 of SEQ ID NO: 473.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the CD80 polypeptide comprises a nucleotide sequence at least 60%, at least 65%, at least 70%, at least 75%, at least 80%, at least 85%, at least 90%, at least 95%, at least 96%, at least 97%, at least 98%, at least 99%, or 100% identical to nucleotides 103 to 723 of SEQ ID NO: 474.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 85% to 100%, 90% to 100%, 95% to 100%, 80% to 95%, 85% to 95%, 85% to 90%, 90% to 95%, or 95% to 100% sequence identity to nucleotides 103 to 723 of SEQ ID NO: 474.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to SEQ ID NO: 474.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 103 to 723 of SEQ ID NOs: 498 or 508. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NOs: 498 or 508. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 86% to 100%, 90% to 100%, 86% to 95%, 86% to 90%, 90% to 95%, or 95% to 100% sequence identity to nucleotides 103 to 723 of SEQ ID NOs: 498 or 508. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NOs: 498 or 508. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 103 to 723 of a sequence selected from the group consisting of SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 87% to 100%, 90% to 100%, 87% to 95%, 87% to 90%, 90% to 95%, or 95% to 100% sequence identity to nucleotides 103 to 723 of a sequence selected from the group consisting of SEQ ID NO: 511, 513, and 515. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 87% to 100%, 90% to 100%, 87% to 95%, 87% to 90%, 90% to 95%, or 95% to 100% sequence identity to SEQ ID NO: 511, 513, and 515. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 88%, at least 89%, at least 90%, at least 91%, at least 92%, at least 93%, at least 94%, at least 95%, at least 96%, at least 97%, at least 98%, at least 99%, or 100% sequence identity to nucleotides 103 to 723 of a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 88% to 100%, 90% to 100%, 88% to 95%, 88% to 90%, 90% to 95%, or 95% to 100% sequence identity to nucleotides 103 to 723 of a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 88% to 100%, 90% to 100%, 88% to 95%, 88% to 90%, 90% to 95%, or 95% to 100% sequence identity to a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to nucleotides 103 to 723 of a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 89% to 100%, 95% to 100%, or 89% to 95% sequence identity to nucleotides 103 to 723 of a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 89% to 100%, 95% to 100%, or 89% to 95% sequence identity to a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 90%, at least 91%, at least 92%, at least 93%, at least 94%, at least 95%, at least 96%, at least 97%, at least 98%, at least 99%, or 100% sequence identity to nucleotides 103 to 723 of a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 90% to 100%, 90% to 95%, or 95% to 100% sequence identity to nucleotides 103 to 723 of a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 90% to 100%, 90% to 95%, or 95% to 100% sequence identity to a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 91%, at least 92%, at least 93%, at least 94%, at least 95%, at least 96%, at least 97%, at least 98%, at least 99%, or 100% sequence to nucleotides 103 to 723 of SEQ ID NO: 504 or 519. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 91%, at least 92%, at least 93%, at least 94%, at least 95%, at least 96%, at least 97%, at least 98%, at least 99%, or 100% sequence identity to SEQ ID NO: 504 or 519. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 91% to 100%, 91% to 95%, or 95% to 100% sequence identity to nucleotides 103 to 723 of SEQ ID NO: 504 or 519. See TABLE 5.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 90% to 100%, 91% to 100%, 91% to 95%, or 95% to 100% sequence identity to SEQ ID NO: 504 or 519. See TABLE 5.

In other embodiments, the CD80 polynucleotide (e.g., a RNA, e.g., a mRNA) comprises a nucleotide sequence (e.g., an ORF) encoding an Fc region, wherein the Fc region comprises an amino acid sequence at least 70%, at least 75%, at least 80%, at least 85%, at least 90%, at least 95%, at least 96%, at least 97%, at least 98%, at least 99%, or 100% identical to amino acids 242 to 468 of SEQ ID NO: 473.

In some embodiments, the CD80 polynucleotide (e.g., a RNA, e.g., a mRNA) comprises a nucleotide sequence (e.g., an ORF) encoding an Fc region, wherein the Fc region comprises a nucleotide sequence at least 60%, at least 65%, at least 70%, at least 75%, at least 80%, at least 85%, at least 90%, at least 95%, at least 96%, at least 97%, at least 98%, at least 99%, or 100% identical to nucleotides 724 to 1404 of SEQ ID NO: 474.

In some embodiments, the CD80 polynucleotide (e.g., a RNA, e.g., a mRNA) comprises a nucleotide sequence (e.g., an ORF) encoding an Fc region, wherein the nucleotide sequence has 85% to 100%, 90% to 100%, 95% to 100%, 80% to 95%, 85% to 95%, 85% to 90%, 90% to 95%, or 95% to 100% sequence identity to nucleotides 724 to 1404 of SEQ ID NO: 474.

In some embodiments, the CD80 polynucleotide (e.g., a RNA, e.g., a mRNA) comprises a nucleotide sequence (e.g., an ORF) encoding an Fc region, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to SEQ ID NO: 474.

In some embodiments, the CD80 polynucleotide (e.g., a RNA, e.g., a mRNA) comprises a nucleotide sequence (e.g., an ORF) encoding an Fc region, wherein the nucleotide sequence has at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 724 to 1404 of SEQ ID NO: 498 or 508. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 498 or 508. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 86% to 100%, 90% to 100%, 86% to 95%, 86% to 90%, 90% to 95%, or 95% to 100% sequence identity to nucleotides 724 to 1404 of SEQ ID NO: 498 or 508. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 498 or 508. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 87% to 100%, 90% to 100%, 87% to 95%, 87% to 90%, 90% to 95%, or 95% to 100% sequence identity to nucleotides 724 to 1404 of a sequence selected from the group consisting of SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 87% to 100%, 90% to 100%, 87% to 95%, 87% to 90%, 90% to 95%, or 95% to 100% sequence identity to SEQ ID NOs: 511, 513, and 515. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 88%, at least 89%, at least 90%, at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 88% to 100%, 90% to 100%, 88% to 95%, 88% to 90%, 90% to 95%, or 95% to 100% sequence identity to nucleotides 724 to 1404 of a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 88% to 100%, 90% to 100%, 88% to 95%, 88% to 90%, 90% to 95%, or 95% to 100% sequence identity to a sequence selected from the group consisting of SEQ ID NOs: 501, 502, 514, 516, 518, and 522. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 89% to 100%, 95% to 100%, or 89% to 95% sequence identity to nucleotides 724 to 1404 of a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 89% to 100%, 95% to 100%, or 89% to 95% sequence identity to a sequence selected from the group consisting of SEQ ID NOs: 505, 509, 510, 512, 520, and 521. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 90%, at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 90% to 100%, 90% to 95%, or 95% to 100% sequence identity to nucleotides 724 to 1404 of a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 90% to 100%, 90% to 95%, or 95% to 100% sequence identity to a sequence selected from the group consisting of SEQ ID NOs: 499, 503, 506, 507, and 517. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 91%, at least 92%, at least 93%, at least 94%, at least 95%, at least 96%, at least 97%, at least 98%, at least 99%, or 100% sequence to nucleotides 724 to 1404 of SEQ ID NO: 504 or 519. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has at least 80%, at least 85%, at least 91%, at least 92%, at least 93%, at least 94%, at least 95%, at least 96%, at least 97%, at least 98%, at least 99%, or 100% sequence identity to SEQ ID NO: 504 or 519. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 91% to 100%, 91% to 95%, or 95% to 100% sequence identity to nucleotides 724 to 1404 of SEQ ID NO: 504 or 519. See TABLE 5.

In some embodiments, the CD80 polynucleotide (e.g., a RNA, e.g., a mRNA) comprises a nucleotide sequence (e.g., an ORF) encoding an Fc region, wherein the nucleotide sequence has 80% to 100%, 85% to 100%, 90% to 100%, 91% to 100%, 91% to 95%, or 95% to 100% sequence identity to SEQ ID NO: 504 or 519. See TABLE 5.

In some embodiments, the CD80 polynucleotide (e.g., a RNA, e.g., a mRNA) comprises from about 600 to about 100,000 nucleotides (e.g., from 600 to 650, from 600 to 675, from 600 to 700, from 600 to 725, from 600 to 750, from 600 to 775, from 600 to 800, from 600 to 900, from 600 to 1000, from 600 to 1100, from 600 to 1200, from 600 to 1300, from 600 to 1400, from 600 to 1500, from 700 to 800, from 700 to 900, from 700 to 1000, from 700 to 1100, from 700 to 1200, from 700 to 1300, from 700 to 1400, from 700 to 1500, from 753 to 800, from 753 to 900, from 753 to 1000, from 753 to 1200, from 753 to 1400, from 753 to 1600, from 753 to 1800, from 753 to 2000, from 753 to 3000, from 753 to 5000, from 753 to 7000, from 753 to 10,000, from 753 to 25,000, from 753 to 50,000, from 753 to 70,000, or from 753 to 100,000.).

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the length of the nucleotide sequence (e.g., an ORF) is at least 300 nucleotides in length (e.g., at least or greater than about 300, 400, 500, 600, 700, 750, 753, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 7000, 8000, 9000, 10,000, 20,000, 30,000, 40,000, 50,000, 60,000, 70,000, 80,000, 90,000 or up to and including 100,000 nucleotides).

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, that further comprises at least one nucleic acid sequence that is noncoding, e.g., a miRNA binding site.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, that is single stranded or double stranded.

In some embodiments, the CD80 polynucleotide comprising a nucleotide sequence (e.g., an ORF) encoding a CD80 polypeptide, e.g., a CD80 polypeptide comprising the EC domain of CD80 or a functional portion thereof, is DNA or RNA. In some embodiments, the CD80 polynucleotide is RNA. In some embodiments, the CD80 polynucleotide is, or functions as, a messenger RNA (mRNA). In some embodiments, the mRNA comprises a nucleotide sequence (e.g., an ORF) that encodes at least one CD80 polypeptide, e.g., a CD80 polypeptide comprising the EC domain of CD80 or a functional portion thereof, and is capable of being translated to produce the encoded CD80 polypeptide, e.g., a CD80 polypeptide comprising the EC domain of CD80 or a functional portion thereof, in vitro, in vivo, in situ or ex vivo.

In some embodiments, the CD80 polynucleotide (e.g., a RNA, e.g., a mRNA) comprises a sequence-optimized nucleotide sequence (e.g., an ORF) encoding a CD80 polypeptide, e.g., the wild-type sequence, functional fragment, or variant thereof, wherein the CD80 polynucleotide comprises at least one chemically modified nucleobase, e.g., 5-methoxyuracil. In some embodiments, the CD80 polynucleotide further comprises a miRNA binding site, e.g., a miRNA binding site that binds to miR-122 In some embodiments, the CD80 polynucleotide disclosed herein is formulated with a delivery agent, e.g., a compound having Formula (I), e.g., any of Compounds 1-147.

CD80 Signal Sequences:

The CD80 polynucleotides (e.g., a RNA, e.g., a mRNA) used in the combination therapies disclosed herein can comprise nucleotide sequences that encode additional features that facilitate trafficking of the encoded polypeptides to therapeutically relevant sites. One such feature that aids in protein trafficking is the signal sequence, or targeting sequence. In some embodiments, the CD80 polynucleotide (e.g., a RNA, e.g., a mRNA) comprises a nucleotide sequence (e.g., an ORF) that encodes a signal peptide operably linked a nucleotide sequence that encodes a CD80 polypeptide, e.g., a CD80 polypeptide comprising the EC domain of CD80 or a functional portion thereof, described herein.

In some embodiments, such signal sequence or signal peptide is a polynucleotide or polypeptide, respectively, which is from about 9 to 200 nucleotides (3-70 amino acids) in length that, optionally, is incorporated at the 5' (or N-terminus) of the coding region or the CD80 polypeptide, respectively. Addition of these sequences results in trafficking the encoded CD80 polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the CD80 polynucleotide comprises a nucleotide sequence encoding a CD80 polypeptide, e.g., a CD80 polypeptide comprising the EC domain of CD80 or a functional portion thereof, wherein the nucleotide sequence further comprises a 5' nucleic acid sequence encoding a signal peptide.

In one embodiment, a signal peptide is a naturally occurring CD80 signal peptide, e.g., the signal peptide corresponding to amino acids 1-34 of wild-type CD80. In other embodiments, the signal peptide is a heterologous signal peptide. In some embodiments, the signal peptide comprises an amino acid sequence having at least about 80%, at least about 85%, at least about 90%, at least about 95%, at least about 95%, about 96%, at least about 97%, at least about 98%, at least about 99%, or about 100% identical to amino acids 1 to 34 of SEQ ID NO: 473.

CD80 Fusion Proteins:

In some embodiments, the CD80 polynucleotide (e.g., a RNA, e.g., a mRNA) can comprise more than one nucleic acid sequence (e.g., an ORF) encoding a polypeptide of interest. In some embodiments, CD80 polynucleotides comprise a single ORF encoding a CD80 polypeptide, e.g., a CD80 polypeptide comprising the EC domain of CD80, a functional fragment, or a variant thereof. However, in some embodiments, the CD80 polynucleotide can comprise more than one ORF, for example, a first ORF encoding a CD80 polypeptide (a first polypeptide of interest), a functional fragment, or a variant thereof, and a second ORF expressing a second polypeptide of interest.

In some embodiments, two or more polypeptides of interest can be genetically fused, i.e., two or more polypeptides can be encoded by the same ORF. In some embodiments, the CD80 polynucleotide can comprise a nucleic acid sequence encoding a linker (e.g., a $G_4S$ peptide linker or another linker known in the art) between two or more polypeptides of interest.

In some embodiments, the CD80 polynucleotide (e.g., a RNA, e.g., a mRNA) can comprise two, three, four, or more ORFs, each expressing a polypeptide of interest. In some embodiments, the CD80 polynucleotide (e.g., a RNA, e.g., a mRNA) can comprise a first nucleic acid sequence (e.g., a first ORF) encoding a CD80 polypeptide, e.g., a CD80 polypeptide comprising the EC domain of CD80 or a functional portion thereof, and a second nucleic acid sequence (e.g., a second ORF) encoding a second polypeptide of interest.

In some embodiments, the CD80 polynucleotide (e.g., a RNA, e.g., a mRNA) can comprise a first nucleic acid sequence (e.g., a first ORF) encoding a CD80 polypeptide, e.g., a CD80 polypeptide comprising the EC domain of CD80 or a functional portion thereof, and a second nucleic acid sequence (e.g., a second ORF) encoding an Fc region.

Sequence-Optimized Nucleotide Sequences Encoding CD80 Polypeptides:

In some embodiments, the CD80 polynucleotide comprises a sequence-optimized nucleotide sequence encoding a CD80 polypeptide, e.g., a CD80 polypeptide comprising the EC domain of CD80 or a functional portion thereof, e.g., a CD80Fc fusion polypeptide comprising the EC domain of CD80 or a functional portion thereof fused to an Fc region. In some embodiments, the CD80 polynucleotide comprises an open reading frame (ORF) encoding a CD80 polypeptide, e.g., CD80Fc, wherein the ORF has been sequence optimized Exemplary sequence-optimized polynucleotide sequences encoding CD80Fc are shown in TABLE 5. In some embodiments, the sequence optimized CD80Fc polynucleotides in TABLE 5, fragments, and variants thereof are used to practice the methods disclosed herein.

TABLE 5

Sequence optimized sequences for CD80Fc

| SEQ ID NO | Name | Sequence |
|---|---|---|
| 498 | CD80_Fc-CO01 | ATGGGCCACACGAGGCGCCAGGGCACCAGCCCCAGCAAGTGCCCGTACCTTAATTTCTTCCA<br>ACTTCTCGTCCTCGCCGGCCTCAGCCACTTTTGCTCCGGCGTCATCCACGTCACCAAGGAGG<br>TCAAGGAGGTTGCCACCCTCTCGTGCGGGCACAACGTGTCCGTCGAGGAGCTCGCCCAGACC<br>AGGATCTACTGGCAGAAAGAGAAGAAGATGGTCCTCACCATGATGAGCGGCGACATGAATAT<br>CTGGCCCGAGTACAAAAATAGGACCATCTTCGACATCACGAATAATCTTTCCATCGTGATCC<br>TGGCGCTGAGGCCGAGCGATGAGGGCACCTACGAATGCGTGGTGCTGAAATACGAGAAGGAC<br>GCCTTCAAGCGGGAGCACCTTGCGGAAGTGACCCTGTCCGTGAAGGCGGATTTTCCGACCCC<br>CAGCATCAGCGATTTCGAGATCCCTACCAGCAACATCCGGAGGATCATCTGCTCCACCTCCG<br>GCGGCTTCCCCGAGCCCCACCTGTCCTGGCTGGAAAATGGGGAGGAGCTCAACGCCATCAAC<br>ACCACCGTGTCCCAGGACCCCGAGACGGAGCTGTACGCCGTGAGCTCCAAACTGGATTTCAA<br>CATGACCACCAACCACTCCTTCATGTGTCTGATCAAATACGGCCACCTGCGCGTGAACCAAA<br>CCTTCAATTGGAACACCACCAAGCAGGAGCACTTCCCCGACGACAAGACCCACACCTGCCCG<br>CCGTGCCCCGCCCCCGAGCTGCTTGGAGGGCCGAGCGTGTTCCTGTTCCCGCCCAAGCCCAA<br>GGACACCCTGATGATCTCCCGAACCCCCGAGGTCACCTGCGTGGTGGTGGATGTGAGCCACG<br>AGGACCCCGAGGTGAAGTTCAACTGGTACGTGGACGGCGTGGAGGTCCACAATGCCAAGACG<br>AAGCCCAGGGAGGAGCAATACAACTCCACTTACAGGGTCGTCAGCGTGCTGACCGTGCTCCA<br>CCAGGACTGGCTCAACGGCAAGGAGTACAAGTGTAAGGTCAGCAACAAGGCCCTGCCCGCAC<br>CCATCGAGAAGACCATCAGCAAGGCCAAAGGCCAACCCCGCGAGCCCCAGGTGTACACCCTG<br>CCCCCTAGCAGGGACGAACTGACCAAGAACCAGGTGAGCCTGACCTGCCTGGTGAAGGGGTT<br>CTACCCCAGCGATATCGCCGTGGAGTGGGAGTCCAATGGCCAGCCCGAAAACAATTACAAGA<br>CCACGCCGCCCGTCCTGGACAGCGATGGCAGCTTCTTCCTGTACAGCAAGCTGACCGTCGAC<br>AAGTCCAGGTGGCAGCAGGGCAACGTGTTTTCCTGCAGCGTGATGCACGAGGCCCTGCACAA<br>CCACTACACCCAAAAATCCCTCAGCCTGTCCCCGGGCAAG |
| 499 | CD80_Fc-CO02 | ATGGGCCACACCCGCAGGCAGGGGACCTCCCCCTCCAAGTGCCCCTACCTCAACTTTTTCCA<br>GCTACTCGTACTCGCAGGGCTCAGCCACTTTTGCTCCGGAGTGATCCACGTCACCAAGGAGG<br>TTAAAGAGGTCGCCACTCTCAGCTGTGGACACAACGTCTCCGTCGAGGAACTAGCCCAGACA<br>AGGATCTACTGGCAGAAGGAGAAGAAGATGGTTCTCACCATGATGAGCGGAGACATGAACAT<br>CTGGCCCGAGTACAAGAACCGTACCATCTTCGACATCACCAACAATCTCAGCATCGTGATCC<br>TGGCCCTCAGGCCCTCCGATGAGGGCACCTACGAGTGCGTCGTGCTGAAGTACGAGAAAGAC<br>GCCTTCAAGAGGGAACACCTGGCCGAGGTGACCCTGTCCGTGAAGGCCGACTTCCCTACCCC<br>CAGCATTAGCGACTTCGAGATCCCAACCTCCAACATACGGCGTATTATCTGCAGCACTAGCG<br>GGGGCTTCCCCGAGCCCCACCTGTCCTGGCTGGAAAACGGCGAGGAGCTGAACGCCATCAAC<br>ACCACCGTCAGCCAGGATCCCGAGACAGAGCTGTACGCCGTGAGCTCGAAGCTGGACTTCAA<br>CATGACGACCAACCACTCCTTCATGTGCCTGATCAAGTATGGCCACCTGAGGGTCAACCAGA<br>CCTTCAACTGGAACACCACCAAGCAAGAGCACTTCCCGGACGATAAGACCCACACCTGCCCC<br>CCGTGCCCGGCCCCCGAGCTGCTCGGCGGGCCCAGCGTGTTCCTGTTCCCTCCCAAACCCAA<br>GGACACGCTGATGATCAGCCGGACCCCCGAGGTGACGTGTGTTGTCGTGGACGTGAGCCACG<br>AGGACCCCGAAGTGAAGTTTAACTGGTACGTGGATGGGGTGGAGGTGCACAACGCCAAAACC<br>AAGCCCAGGGAGGAGCAGTACAATAGCACCTATAGGGTGGTATCGGTGCTGACCGTGCTGCA<br>CCAGGACTGGCTGAACGGCAAGGAGTACAAGTGCAAGGTGAGCAATAAGGCCCTCCCGGCCC<br>CCATCGAGAAGACCATCAGCAAGGCCAAGGGGCAGCCCAGGGAACCCCAGGTGTACACCCTG<br>CCCCCATCCCGGGACGAGCTCACCAAGAACCAGGTGAGCCTGACCTGCCTGGTGAAGGGATT<br>CTACCCAAGCGATATCGCCGTGGAGTGGGAGTCCAACGGGCAGCCGGAGAACAACTACAAGA<br>CCACCCCACCCGTGCTGGACTCCGACGGCAGCTTCTTCCTGTACTCCAAGCTGACCGTGGAC<br>AAGAGCCGCTGGCAGCAGGGAAATGTGTTCAGCTGCAGCGTGATGCACGAGGCCCTGCACAA<br>TCACTACACCCAGAAAAGCCTCAGCCTGAGCCCGGGCAAG |
| 500 | CD80_Fc-CO03 | ATGGGCCACACCAGGAGGCAGGGCACCAGCCCGAGCAAGTGCCCATATCTCAACTTTTTCCA<br>GCTCCTCGTACTCGCCGGACTAAGCCATTTCTGCAGCGGGGTCATCCACGTCACCAAGGAGG<br>TCAAGGAGGTCGCCACGCTCAGCTGCGGGCACAACGTCAGCGTCGAGGAGCTCGCCCAGACC<br>AGAATCTACTGGCAGAAAGAGAAGAAGATGGTCCTCACTATGATGAGCGGCGACATGAACAT<br>CTGGCCAGAATACAAGAACCGGACCATCTTCGACATCACCAACAACCTCAGCATCGTGATCC<br>TTGCGCTGCGGCCCTCCGACGAAGGGACCTACGAGTGCGTGGTGCTGAAGTATGAGAAGGAC<br>GCCTTTAAACGCGAGCACCTGGCCGAGGTGACGCTGTCCGTGAAGGCCGACTTTCCCACCCC<br>GTCCATCAGCGACTTCGAGATCCCCACCAGCAATATCCGCCGGATCATCTGCTCCACCTCCG<br>GGGGCTTTCCCGAGCCACACCTGTCCTGGCTGGAGAACGGCGAGGAGCTGAATGCCATCAAC<br>ACCACGGTGAGCCAGGACCCCGAGACGGAGCTCTACGCCGTGAGCAGCAAGCTGGACTTCAA<br>CATGACCACCAACCACAGCTTCATGTGCCTGATCAAGTATGGCCACCTGCGTGTGAACCAAA<br>CCTTTAATTGGAACACCACCAAGCAGGAGCACTTCCCCGACGACAAAACGCACACCTGCCCG<br>CCCTGCCCCGCCCCCGAGCTGCTGGGCGGGCCGAGCGTGTTCCTGTTCCCTCCCAAGCCCAA<br>AGACACCCTGATGATCAGCAGGACGCCGGAGGTGACCTGTGTCGTGGTGGACGTGAGCCACG<br>AGGACCCCGAGGTGAAGTTCAACTGGTACGTCGACGGGGTGGAGGTGCACAACGCCAAGACG<br>AAGCCCAGGGAGGAGCAGTATAACAGCACCTACAGGGTGGTGAGCGTGCTGACCGTGCTGCA<br>CCAGGATTGGCTGAACGGCAAAGAGTACAAGTGTAAGGTGAGCAACAAGGCCCTGCCCGCAC<br>CCATCGAGAAGACCATCAGCAAGGCCAAGGGGCAGCCCAGGGAACCCCAAGTGTATACCCTG<br>CCGCCGTCCCGGGATGAGCTGACCAAGAACCAGGTGTCCCTCACCTGCCTGGTGAAGGGATT<br>CTACCCCAGCGATATCGCTGTTGAGTGGGAGAGCAATGGCCAGCCCGAGAACAACTACAAGA<br>CGACGCCCCCGGTGCTGGATAGTGACGGGAGCTTCTTTCTGTACAGCAAACTGACCGTGGAT<br>AAGTCCAGGTGGCAGCAGGGCAACGTGTTCAGCTGCTCCGTGATGCACGAGGCCCTGCACAA<br>TCATTACACCCAGAAGTCCCTGAGCCTGAGCCCGGGCAAA |
| 501 | CD80_Fc-CO04 | ATGGGGCATACCAGGCGACAAGGCACGAGCCCCTCAAAGTGTCCCTACCTCAACTTCTTCCA<br>GCTTCTCGTCCTCGCCGGCCTCAGCCACTTCTGCAGCGGCGTAATCCACGTCACCAAGGAGG<br>TCAAGGAGGTCGCCACTCTTAGCTGCGGCCACAACGTCAGCGTCGAAGAACTTGCCCAGACG |

TABLE 5-continued

Sequence optimized sequences for CD80Fc

| SEQ ID NO | Name | Sequence |
|---|---|---|
| | | AGGATCTATTGGCAGAAGGAGAAGAAGATGGTACTCACCATGATGAGCGGCGACATGAACAT<br>CTGGCCCGAGTACAAGAACAGGACGATCTTCGACATAACCAACAACCTCAGCATCGTCATCC<br>TGGCCCTGAGGCCAAGCGACGAGGGAACCTACGAATGCGTGGTGCTCAAATACGAGAAAGAT<br>GCCTTCAAGCGGGAGCACCTGGCCGAGGTGACCCTGTCCGTGAAGGCCGACTTCCCTACCCC<br>CAGCATCTCGGACTTCGAGATCCCCACGAGCAACATCCGCAGGATCATTTGCAGCACCAGCG<br>GGGGGTTCCCCGAGCCCCACCTCAGCTGGCTGGAGAACGGCGAAGAACTCAACGCCATCAAC<br>ACCACCGTGAGCCAGGACCCCGAGACGGAGCTGTACGCGGTGTCCTCGAAGCTCGATTTCAA<br>CATGACGACGAACCATAGCTTCATGTGCCTCATCAAGTACGGTCACCTCAGGGTGAACCAGA<br>CCTTCAACTGGAACACGACCAAGCAGGAGCACTTCCCCGACGACAAGACCCACACCTGCCCG<br>CCCTGCCCCGCCCCCGAGCTGCTGGGTGGCCCCAGCGTGTTTCTGTTCCCGCCCAAGCCCAA<br>GGACACCCTGATGATCTCCAGGACCCCCGAGGTAACCTGCGTGGTGGTGGACGTGAGCCACG<br>AGGACCCCGAGGTGAAGTTCAACTGGTACGTGGACGGCGTGGAGGTGCACAACGCCAAAACC<br>AAGCCCAGGGAGGAGCAGTACAACAGCACCTACCGCGTGGTATCCGTGCTGACTGTGCTGCA<br>CCAAGACTGGCTGAACGGAAAGGAGTACAAGTGCAAGGTGTCCAACAAGGCTCTGCCCGCCC<br>CCATCGAGAAGACAATCAGCAAGGCCAAGGGCCAGCCCCGGGAGCCCCAGGTGTACACCCTC<br>CCTCCCTCCAGGGACGAGCTCACCAAGAACCAGGTGTCCCTGACCTGTCTGGTGAAGGGCTT<br>CTACCCGAGCGACATAGCCGTGGAGTGGGAGAGCAATGGCCAGCCGGAGAACAACTACAAGA<br>CCACCCCACCCGTGCTGGACAGCGACGGGAGCTTCTTCCTGTACTCCAAGCTCACGGTGGAC<br>AAGAGCAGGTGGCAGCAGGGCAACGTGTTCAGCTGCAGCGTGATGCACGAGGCCCTGCATAA<br>CCACTACACCCAGAAGTCGCTGAGCCTGTCCCCGGGCAAG |
| 502 | CD80_Fc-CO05 | ATGGGCCACACCAGGCGACAGGGCACCAGCCCCAGCAAGTGCCCCTATCTCAACTTCTTCCA<br>GCTCCTAGTCCTCGCCGGCCTTTCACACTTCTGTAGCGGGGTCATCCACGTCACCAAAGAGG<br>TCAAGGAGGTCGCCACACTCAGCTGTGGCCATAACGTATCCGTCGAGGAGCTCGCCCAGACC<br>AGGATCTACTGGCAGAAGGAAAAGAAGATGGTCCTCACCATGATGAGCGGCGACATGAACAT<br>CTGGCCCGAGTATAAAAACCGGACCATCTTCGACATCACCAACAACCTCAGCATCGTGATCC<br>TGGCCCTCAGGCCCAGCGATGAGGGGACCTACGAGTGCGTGGTGCTGAAGTACGAGAAGGAC<br>GCCTTCAAGCGGGAACACCTGGCCGAGGTGACCCTGAGCGTGAAGGCCGATTTCCCCACCCC<br>GAGCATCAGCGACTTCGAGATCCCCACCTCCAACATCCGGCGAATCATCTGCAGCACCTCAG<br>GAGGCTTTCCCGAGCCCCACCTGAGCTGGCTGGAGAATGGGGAGGAGCTGAACGCCATCAAC<br>ACCACCGTCAGCCAGGACCCCGAGACGGAGCTGTACGCCGTGTCATCCAAACTGGACTTCAA<br>CATGACCACGAACCACTCATTCATGTGCCTGATCAAGTACGGGCACCTGCGCGTGAACCAGA<br>CGTTCAACTGGAACACCACGAAACAGGAGCACTTCCCCGACGACAAGACACACACCTGCCCG<br>CCCTGCCCCGCCCCCGAGCTGCTGGGCGGCCCTAGCGTGTTCCTCTTCCCCCCAAAGCCCAA<br>GGACACCCTGATGATCTCCAGGACACCGGAAGTGACCTGCGTCGTCGTAGACGTCAGTCACG<br>AGGACCCCGAGGTGAAGTTCAACTGGTACGTGGACGGCGTGGAGGTCCACAACGCGAAGACC<br>AAGCCCCGGGAGGAACAGTACAACAGCACGTACCGGGTGGTGAGCGTGCTGACCGTGCTGCA<br>TCAGGATTGGCTGAACGGCAAGGAGTACAAGTGCAAGGTGAGCAACAAGGCCCTGCCGGCCC<br>CGATCGAGAAGACCATCAGCAAGGCCAAGGGCCAGCCCCGCGAGCCCCAGGTGTACACCCTG<br>CCCCCTTCCCGCGACGAGCTCACCAAGAATCAGGTGTCCCTGACATGCCTGGTGAAGGGCTT<br>CTACCCGAGCGACATCGCGGTGGAATGGGAAAGCAACGGCCAACCCGAGAACAACTACAAGA<br>CCACCCCTCCCGTGCTGGACTCCGACGGCAGCTTCTTCCTGTACTCCAAGCTCACCGTGGAC<br>AAGTCCAGGTGGCAGCAGGGGAATGTGTTCTCCTGCAGCGTGATGCACGAGGCCCTGCACAA<br>CCACTACACACAGAAAAGCCTGAGCCTGAGCCCCGGCAAG |
| 503 | CD80_Fc-CO06 | ATGGGCCACACCAGGAGGCAGGGCACCAGCCCCTCCAAGTGCCCGTACCTCAATTTCTTCCA<br>GCTCCTCGTCCTCGCGGGGTTAAGCCACTTTTGCTCAGGCGTCATCCACGTCACCAAGGAGG<br>TCAAAGAGGTCGCCACCCTCAGCTGCGGCCACAACGTCAGCGTAGAGGAGCTTGCCCAGACC<br>AGGATATACTGGCAGAAAGAGAAGAAGATGGTACTCACCATGATGAGCGGCGACATGAACAT<br>CTGGCCCGAATACAAAAACCGGACCATCTTCGACATTACCAACAATCTCTCCATCGTGATCC<br>TGGCCCTCAGGCCCTCCGACGAGGGGACCTACGAGTGTGTGGTACTGAAGTACGAGAAGGAC<br>GCCTTCAAGCGGGAGCACCTGGCCGAAGTCACCCTGTCCGTGAAGGCCGACTTCCCGACACC<br>CAGCATCAGCGACTTTGAAATCCCCACCAGCAATATCAGGAGGATCATCTGCTCGACCAGCG<br>GCGGCTTCCCCGAGCCCCACCTGTCATGGCTGGAGAACGGCGAGGAGCTGAACGCCATCAAC<br>ACCACCGTCTCGCAGGACCCGGAGACAGAGCTGTACGCCGTGTCCAGCAAGCTGGACTTCAA<br>CATGACCACAAATCACAGCTTCATGTGCCTGATCAAGTACGGCCACCTGAGGGTCAACCAAA<br>CCTTCAACTGGAACACGACCAAACAAGAGCACTTTCCGGATGACAAGACACACACCTGCCCG<br>CCCTGCCCCGCCCCCGAGCTGCTGGGCGGGCCCAGCGTGTTCCTCTTCCCGCCCAAGCCCAA<br>GGACACCCTGATGATCTCCCGCACCCCCGAGGTGACCTGCGTGGTGGTGGACGTGTCCCATG<br>AGGATCCCGAGGTGAAGTTTAACTGGTACGTGGACGGCGTGGAAGTGCATAACGCCAAGACC<br>AAGCCCAGGGAGGAGCAATATAACAGCACCTACAGGGTGGTGAGCGTGCTGACCGTGCTGCA<br>TCAAGATTGGCTCAACGGCAAGGAGTACAAGTGCAAGGTCAGCAACAAGGCCCTGCCCGCGC<br>CGATCGAGAAGACCATCAGCAAAGCCAAGGGGCAGCCCAGGGAGCCCCAAGTGTACACGCTC<br>CCGCCCAGCAGGGACGAGCTGACCAAAAACCAGGTTAGCCTGACCTGCCTGGTGAAGGGCTT<br>CTACCCCTCCGACATTGCCGTGGAGTGGGAGTCAAACGGGCAGCCGGAGAACAATTACAAGA<br>CGACCCCTCCCGTGCTGGACAGCGACGGGTCCTTCTTCCTGTATAGCAAGCTCACCGTGGAT<br>AAGAGCAGGTGGCAGCAGGGCAACGTCTTCTCGTGCAGCGTGATGCACGAGGCCCTGCACAA<br>CCATTACACCCAGAAAAGCCTGTCGCTGTCCCCCGGGAAG |
| 504 | CD80_Fc-CO07 | ATGGGCCACACCAGGCGCCAGGGCACAAGCCCCAGCAAGTGCCCCTACCTCAACTTCTTCCA<br>GCTCCTCGTCCTCGCCGGGCTAAGCCACTTCTGCTCAGGCGTAATTCACGTCACCAAGGAGG<br>TCAAGGAGGTCGCCACCCTCAGCTGCGGCCACAACGTCTCCGTCGAGGAGTTGGCCCAGACC<br>AGGATCTACTGGCAGAAGGAAAAGAAAATGGTCCTCACCATGATGAGCGGGGACATGAACAT<br>CTGGCCCGAATACAAAAACCGCACCATCTTCGACATCACCAACAACCTCAGCATCGTGATCC<br>TGGCCCTTCGGCCGTCCGACGAGGGCACCTACGAGTGCGTGGTGCTGAAGTACGAGAAGGAC |

TABLE 5-continued

Sequence optimized sequences for CD80Fc

| SEQ ID NO | Name | Sequence |
|---|---|---|
| | | GCCTTCAAGAGGGAGCACCTGGCCGAGGTGACCCTGAGCGTGAAGGCCGATTTCCCCACTCC<br>CAGCATCAGCGACTTCGAGATCCCCACCAGCAACATCCGGAGGATAATCTGCAGCACCAGCG<br>GGGGCTTTCCCGAGCCCCACCTCAGCTGGCTCGAGAACGGCGAGGAGCTGAACGCCATAAAC<br>ACGACCGTGAGCCAGGACCCCGAGACTGAGCTGTACGCCGTCAGCAGCAAGCTGGACTTCAA<br>CATGACGACCAATCACTCGTTCATGTGTCTGATTAAGTATGGACATCTGAGGGTGAACCAGA<br>CCTTCAATTGGAACACCACCAAGCAGGAGCACTTCCCCGACGATAAGACCCACACCTGCCCG<br>CCCTGCCCCGCCCCGGAACTGCTGGGGGGCCCCAGCGTGTTCCTGTTCCCGCCCAAGCCCAA<br>GGACACCCTGATGATCAGCAGGACACCCGAGGTGACCTGCGTGGTTGTGGACGTGTCCCATG<br>AGGATCCCGAGGTGAAGTTCAACTGGTACGTAGACGGGGTGGAGGTGCACAATGCCAAGACC<br>AAGCCCCGCGAGGAGCAGTACAACAGCACCTACCGGGTGGTGTCCGTGCTGACCGTCCTGCA<br>CCAGGACTGGCTGAACGGCAAGGAGTACAAATGCAAGGTGAGCAACAAGGCCCTGCCCGCGC<br>CCATCGAAAAGACGATCAGCAAGGCCAAAGGGCAGCCCCGGGAGCCCCAGGTGTACACGCTG<br>CCGCCCAGCCGCGATGAGCTGACGAAAAACCAAGTGAGCCTCACGTGCCTGGTCAAGGGCTT<br>CTACCCCTCCGATATCGCAGTGGAGTGGGAGAGCAACGGCCAGCCCGAGAACAACTACAAGA<br>CCACGCCCCCGGTGCTGGACTCCGACGGCTCGTTCTTCCTGTACAGCAAGCTGACGGTTGAC<br>AAGTCCAGGTGGCAGCAGGGGAACGTGTTTAGCTGCAGCGTGATGCACGAGGCCCTCCATAA<br>CCACTACACGCAGAAGTCCCTGTCCCTGAGCCCCGGCAAG |
| 505 | CD80_Fc-CO08 | ATGGGCCACACCAGGCGGCAGGGCACCAGCCCCAGCAAGTGCCCCTACCTCAACTTTTTCA<br>GCTTTTGGTCCTCGCCGGCCTAAGCCATTTTTGCTCCGGGGTCATCCACGTGACCAAGGAGG<br>TAAAGGAGGTCGCCACCCTCAGCTGCGGACACAACGTCAGCGTAGAGGAGCTCGCCCAGACC<br>CGAATCTACTGGCAAAAGGAGAAGAAGATGGTCCTCACCATGATGTCCGGCGATATGAACAT<br>CTGGCCGGAGTACAAAAATAGGACAATCTTCGATATCACCAACAACCTAAGCATCGTGATCC<br>TGGCGCTGCGGCCCAGCGATGAAGGCACGTACGAATGCGTGGTGCTGAAGTACGAAAAGGAC<br>GCCTTTAAGAGGGAGCACCTGGCCGAGGTGACCCTCAGCGTGAAGGCCGACTTCCCCACCCC<br>CTCCATCAGCGACTTCGAGATACCCACCAGCAACATCCGACGGATTATCTGCAGCACCAGCG<br>GGGGCTTCCCCGAACCCCACCTGTCCTGGCTGGAGAACGGCGAGGAGCTGAACGCCATCAAC<br>ACCACCGTGAGCCAGGATCCCGAGACAGAGCTCTACGCGGTGAGCAGCAAGCTGGACTTCAA<br>CATGACCACAAACCACAGCTTCATGTGCCTCATCAAGTATGGCCATCTGAGGGTGAACCAGA<br>CCTTCAACTGGAACACCACCAAACAGGAGCACTTCCCGGACGACAAGACCCACACCTGCCCA<br>CCCTGCCCCGCCCCCGAGCTGCTGGGTGGCCCCAGCGTGTTTCTGTTCCCCCCGAAGCCCAA<br>AGATACACTGATGATCAGCCGAACCCCAGAGGTGACGTGTGTGGTGGTCGACGTGAGCCACG<br>AGGACCCGGAGGTCAAATTCAACTGGTACGTGGACGGCGTGGAGGTGCACAACGCCAAGACC<br>AAACCCAGAGAGGAGCAGTACAACAGCACGTACCGTGTGGTCAGCGTGCTGACCGTGCTGCA<br>CCAGGACTGGCTGAACGGCAAGGAGTACAAGTGCAAGGTGAGCAATAAGGCGCTGCCCGCCC<br>CCATCGAGAAAACCATCTCCAAAGCCAAGGGCCAACCCCGGGAGCCTCAGGTGTACACCCTG<br>CCGCCCAGCAGGGACGAGCTGACCAAGAACCAGGTGTCCCTGACCTGCCTGGTGAAAGGCTT<br>CTATCCCAGCGACATCGCTGTGGAGTGGGAGTCCAACGGGCAACCCGAGAACAACTACAAGA<br>CCACCCCGCCCGTACTGGACTCGGATGGCAGCTTCTTCCTGTACTCGAAGCTGACCGTGGAC<br>AAAAGCAGGTGGCAGCAGGGAAACGTGTTCTCATGCAGCGTCATGCACGAGGCCCTCCACAA<br>CCACTACACCCAGAAATCCCTGAGCCTGAGCCCCGGCAAA |
| 506 | CD80_Fc-CO09 | ATGGGCCACACCAGGCGCCAAGGCACCAGCCCCTCAAAGTGCCCCTACCTCAACTTCTTCCA<br>GCTCCTCGTACTCGCGGGGCTCAGCCACTTCTGCTCGGGCGTGATCCACGTTACCAAGGAGG<br>TCAAAGAGGTCGCGACCCTCTCCTGTGGCCACAACGTCTCCGTCGAGGAGCTTGCCCAGACC<br>CGAATCTACTGGCAGAAGGAGAAAAAGATGGTCCTCACGATGATGAGCGGAGACATGAACAT<br>CTGGCCGGAGTATAAGAACCGGACCATCTTCGACATCACCAACAACCTCAGCATCGTCATCC<br>TGGCCCTGCGTCCATCCGATGAGGGGACCTACGAGTGCGTGGTCCTCAAGTATGAAAAGGAC<br>GCCTTCAAGCGGGAGCACCTGGCCGAGGTCACCCTGAGTGTCAAGGCCGACTTCCCTACCCC<br>CAGCATCAGTGACTTCGAGATCCCCACTTCCAACATAAGGAGGATCATCTGCTCCACCAGCG<br>GAGGCTTCCCCGAGCCCCACCTGAGCTGGCTGGAGAACGGCGAGGAGCTGAACGCCATCAAT<br>ACCACCGTTAGCCAGGACCCCGAGACGGAGCTGTACGCCGTGAGCAGCAAGCTGGACTTCAA<br>CATGACCACCAATCACTCATTCATGTGCCTCATTAAGTACGGCCACCTGAGGGTCAACCAGA<br>CCTTCAACTGGAACACCACCAAGCAGGAGCACTTCCCGGATGATAAGACCCACACCTGCCCG<br>CCCTGCCCCGCCCCAGAGCTGCTGGGCGGCCCCAGCGTCTTCCTGTTCCCGCCCAAGCCTAA<br>GGACACCCTCATGATCAGCCGGACCCCCGAGGTAACCTGCGTGGTGGTGGACGTAAGCCACG<br>AGGATCCCGAGGTGAAGTTCAACTGGTACGTCGACGGGGTGGAGGTGCATAACGCGAAGACC<br>AAACCCCGCGAAGAACAGTACAACAGCACCTACAGGGTCGTTAGTGTGCTCACCGTGCTCCA<br>CCAGGATTGGCTGAACGGGAAAGAGTACAAGTGCAAGGTGTCCAACAAAGCACTCCCCGCCC<br>CCATCGAGAAGACCATCTCCAAGGCCAAGGGCCAGCCGAGGGAACCTCAGGTCTACACCCTG<br>CCCCCCAGCAGGGACGAGCTGACCAAGAACCAGGTGAGCCTGACCTGCCTGGTGAAGGGCTT<br>CTACCCGAGCGACATCGCGGTGGAATGGGAGTCCAACGGCCAGCCCGAGAACAACTATAAGA<br>CCACGCCCCCCGTGCTCGACTCCGACGGCAGCTTCTTCCTGTATTCCAAGCTGACCGTGGAC<br>AAGTCGAGGTGGCAGCAAGGTAACGTGTTCTCCTGCAGCGTGATGCACGAGGCCCTCCACAA<br>TCATTACACCCAGAAGTCGCTGAGCCTGAGTCCGGGTAAA |
| 507 | CD80_Fc-CO10 | ATGGGGCACACCCGGCGACAGGGCACGAGCCCCAGCAAGTGCCCCTACCTCAACTTCTTCCA<br>ACTCCTCGTTCTCGCCGGCCTCTCGCACTTTTGCTCGGGCGTCATCCACGTCACCAAGGAAG<br>TTAAGGAGGTCGCCACCCTCTCCTGCGGCCACAACGTCTCCGTCGAGGAACTCGCGCAGACC<br>CGCATATACTGGCAAAAGGAAAAGAAGATGGTCCTCACGATGATGAGCGGAGACATGAACAT<br>TTGGCCCGAGTACAAGAACCGCACCATCTTCGACATCACCAACAACCTCTCCATAGTGATCC<br>TGGCCCTGCGGCCCAGCGACGAGGGGACCTATGAGTGCGTGGTGCTGAAGTACGAAAAGGAC<br>GCCTTCAAGAGGGAGCACCTGGCCGAGGTGACCCTGAGCGTGAAGGCCGATTTCCCCACCCC<br>CAGCATCAGCGACTTCGAAATCCCCACCAGCAACATCAGGCGGATAATCTGCAGCACCAGCG<br>GCGGCTTCCCCGAGCCCCACCTGAGCTGGCTGGAGAATGGGGAGGAACTGAACGCCATTAAC |

TABLE 5-continued

Sequence optimized sequences for CD80Fc

| SEQ ID NO | Name | Sequence |
|---|---|---|
| | | ACCACAGTCAGCCAAGATCCCGAGACAGAGCTCTACGCCGTGTCCTCGAAGCTGGACTTCAA<br>CATGACCACCAACCACAGCTTCATGTGCCTGATCAAATACGGGCACCTGCGGGTGAACCAAA<br>CCTTCAACTGGAACACCACCAAGCAGGAGCACTTCCCCGACGACAAGACGCATACGTGCCCA<br>CCCTGCCCCGCCCCCGAGCTCCTCGGCGGCCCCAGCGTGTTCTTATTCCCGCCCAAGCCCAA<br>GGACACCCTGATGATCTCCCGGACGCCGGAGGTGACGTGTGTGGTCGTGGACGTGAGCCACG<br>AGGACCCGGAGGTGAAGTTTAATTGGTACGTGGACGGGGTGGAGGTGCACAACGCGAAGACC<br>AAGCCCAGGGAGGAGCAGTACAACAGCACCTACCGCGTGGTGAGCGTGCTGACCGTACTGCA<br>CCAGGACTGGCTCAATGGCAAGGAGTACAAGTGCAAGGTGTCCAACAAGGCCCTGCCCGCTC<br>CGATCGAAAAAACGATCAGCAAGGCGAAAGGGCAGCCCAGGGAACCCCAGGTCTACACCCTG<br>CCGCCCAGCCGCGACGAACTGACCAAGAACCAGGTGTCACTGACCTGCCTGGTGAAGGGGTT<br>CTATCCGTCGGACATCGCGGTGGAGTGGGAGTCCAACGGCCAACCCGAGAACAATTACAAAA<br>CCACCCCGCCCGTGCTGGACAGCGACGGGAGCTTCTTTCTGTATTCCAAGTTAACAGTCGAC<br>AAGAGCAGGTGGCAGCAGGGCAACGTGTTCTCCTGCAGCGTCATGCACGAGGCCCTCCACAA<br>CCACTACACCCAGAAAAGCTTGAGCCTGTCCCCCGGCAAG |
| 508 | CD80_Fc-CO11 | ATGGGGCACACAAGGAGGCAAGGCACCAGCCCCAGCAAGTGCCCGTACCTAAACTTTTTCCA<br>GCTCCTCGTCCTCGCAGGCCTAAGCCACTTTTGCTCCGGCGTCATACACGTCACCAAGGAGG<br>TAAAGGAGGTCGCAACCCTAAGCTGCGGCCACAACGTGTCCGTCGAGGAGTTAGCCCAGACC<br>AGAATCTACTGGCAAAAAGAGAAGAAGATGGTCCTTACGATGATGTCAGGCGACATGAACAT<br>CTGGCCGGAGTACAAGAACCGGACTATCTTCGACATCACCAATAACCTTAGCATCGTGATCC<br>TGGCCCTCAGGCCCTCCGACGAGGGCACCTACGAGTGCGTCGTGCTGAAATACGAGAAGGAT<br>GCCTTCAAGAGGGAGCACCTGGCCGAGGTGACCCTGAGCGTGAAGGCCGACTTCCCGACCCC<br>GAGCATCTCCGATTTCGAGATCCCGACCAGCAACATAAGGAGGATCATTTGCAGCACCTCCG<br>GCGGCTTCCCCGAGCCGCACCTGAGCTGGCTCGAGAATGGCGAGGAGCTGAATGCCATCAAC<br>ACCACCGTGAGCCAGGACCCGGAGACGGAACTCTATGCGGTGAGCAGCAAGCTCGACTTCAA<br>CATGACGACGAACCACTCCTTCATGTGCCTGATCAAGTACGGCCATCTGCGGGTGAACCAGA<br>CCTTCAACTGGAACACCACCAAGCAGGAGCACTTCCCCGATGACAAGACGCACACCTGCCCG<br>CCGTGCCCCGCCCCGGAGCTGCTGGGGGGCCCCAGCGTCTTCCTGTTCCCGCCCAAGCCCAA<br>GGATACCCTGATGATCTCCAGGACGCCCGAGGTGACCTGCGTCGTGGTTGACGTATCCCACG<br>AGGACCCCGAAGTGAAATTCAACTGGTATGTGGACGGGGTAGAGGTGCACAACGCTAAAACT<br>AAGCCGCGGGAGGAGCAGTACAATAGCACCTATCGAGTGGTGAGCGTGCTGACCGTGCTGCA<br>CCAGGACTGGCTGAACGGGAAGGAGTATAAGTGCAAGGTGTCGAACAAAGCCCTGCCCGCCC<br>CCATCGAGAAGACCATCTCGAAAGCCAAGGGCCAGCCCAGGGAGCCCCAGGTCTACACGCTG<br>CCCCCCTCCCGGGACGAGCTCACCAAGAATCAGGTGAGCCTGACCTGTCTGGTCAAGGGGTT<br>CTACCCCTCCGACATCGCGGTGGAGTGGGAGAGCAACGGCCAACCCGAGAACAACTATAAGA<br>CCACGCCGCCCGTGCTGGACTCCGACGGGTCCTTCTTTCTGTACTCCAAGCTCACCGTGGAT<br>AAGTCCCGCTGGCAGCAGGGCAACGTGTTCAGCTGCAGCGTGATGCACGAGGCCCTCCACAA<br>CCACTACACCCAGAAAAGCCTGAGCCTGAGCCCGGGCAAG |
| 509 | CD80_Fc-CO12 | ATGGGCCACACCAGGAGACAGGGCACCAGCCCCAGCAAGTGCCCCTATCTCAACTTCTTCCA<br>GCTCCTCGTACTTGCCGGCCTTTCGCACTTCTGCTCCGGAGTCATCCACGTAACCAAGGAGG<br>TTAAGGAGGTCGCCACCCTCAGCTGTGGGCACAACGTCAGCGTCGAGGAGCTAGCCCAGACC<br>AGGATCTACTGGCAAAAGGAGAAGAAGATGGTACTCACCATGATGTCCGGAGACATGAACAT<br>TTGGCCCGAGTACAAGAATAGGACCATCTTCGATATCACGAACAACCTCTCCATCGTGATCC<br>TGGCCCTCAGGCCCAGCGACGAAGGCACCTACGAGTGCGTGGTGCTGAAGTACGAAAAGGAC<br>GCCTTCAAGAGGGAGCACCTGGCCGAGGTGACCCTGAGCGTGAAGGCCGACTTCCCCACCCC<br>AAGCATCAGCGACTTCGAGATTCCGACCAGCAACATCAGGCGCATCATCTGCAGCACCAGCG<br>GCGGCTTTCCCGAGCCGCATCTGAGCTGGCTGGAGAACGGCGAGGAGCTGAACGCCATCAAC<br>ACGACCGTGAGCCAGGATCCCGAGACGGAGCTGTACGCCGTCAGCTCCAAGCTGGACTTCAA<br>CATGACCACCAACCACAGCTTTATGTGCCTGATCAAGTACGGGCATCTGCGGGTGAACCAGA<br>CCTTTAACTGGAACACCACCAAGCAGGAGCATTTTCCGGACGACAAGACCCACACGTGTCCC<br>CCCTGCCCCGCTCCCGAGCTGCTCGGCGGCCCCTCCGTCTTCCTGTTCCCTCCCAAGCCCAA<br>GGACACCCTGATGATCTCCAGGACCCCCGAGGTCACCTGTGTGGTGGTGGATGTGTCCCACG<br>AGGACCCCGAGGTGAAGTTCAATTGGTACGTGGACGGCGTGGAGGTGCACAACGCCAAAACC<br>AAGCCCCGGGAGGAGCAGTACAATTCCACCTACAGGGTTGTGAGCGTCCTCACCGTGCTGCA<br>CCAGGACTGGCTCAATGGGAAGGAGTACAAGTGCAAGGTCAGCAACAAGGCCCTGCCCGCCC<br>CCATCGAGAAGACGATCAGCAAGGCCAAAGGGCAGCCCCGCGAGCCCCAGGTCTATACCCTG<br>CCCCCCAGCCGGGATGAGCTGACCAAGAACCAGGTGTCTCTGACATGCCTGGTGAAGGGGTT<br>CTATCCCAGCGACATCGCCGTGGAGTGGGAGAGCAACGGGCAACCCGAGAACAACTATAAGA<br>CGACTCCCCCCGTCCTGGACTCCGACGGCAGCTTCTTCCTGTACTCCAAGCTGACCGTGGAC<br>AAGTCCAGGTGGCAGCAGGGGAACGTGTTTAGCTGCAGCGTCATGCACGAGGCCCTGCACAA<br>CCACTATACACAGAAAAGCCTGAGCCTGTCACCCGGGAAG |
| 510 | CD80_Fc-CO13 | ATGGGCCACACCAGGCGCCAAGGAACCAGCCCCTCGAAGTGCCCCTACCTCAACTTCTTTCA<br>GCTTCTAGTCCTCGCCGGCTTATCCCATTTCTGCAGCGGCGTAATACACGTTACCAAGGAGG<br>TCAAGGAGGTCGCGACCCTCAGCTGCGGACATAACGTGTCCGTAGAGGAGCTCGCTCAGACC<br>CGGATCTATTGGCAGAAGGAGAAGAAGATGGTCCTCACCATGATGAGCGGCGACATGAACAT<br>CTGGCCCGAGTACAAGAACAGGACCATCTTCGACATCACCAACAACCTAAGTATCGTGATCC<br>TGGCCCTGCGGCCCAGCGACGAGGGCACCTACGAGTGCGTGGTGCTGAAGTACGAGAAGGAC<br>GCCTTCAAGAGGGAGCACCTGGCCGAGGTGACCCTGTCAGTGAAGGCCGACTTCCCAACCCC<br>CAGCATCAGCGATTTCGAGATCCCCACCAGCAATATCAGGCGCATAATCTGCAGCACCAGCG<br>GCGGCTTTCCCGAGCCGCACCTCAGCTGGCTGGAGAATGGCGAAGAACTGAACGCCATCAAC<br>ACCACCGTCTCGCAGGACCCCGAGACGGAGCTCTACGCCGTGAGCTCCAAGCTGGACTTTAA<br>CATGACGACCAATCACTCCTTTATGTGCCTCATTAAATACGGACATCTGCGCGTGAACCAGA<br>CCTTCAACTGGAACACCACCAAGCAGGAACACTTTCCCGACGACAAGACGCATACGTGCCCA |

TABLE 5-continued

Sequence optimized sequences for CD80Fc

| SEQ ID NO | Name | Sequence |
|---|---|---|
| | | CCCTGCCCCGCCCCGGAGCTGCTGGGCGGCCCCAGCGTGTTCCTCTTCCCGCCCAAGCCCAA<br>GGACACGCTGATGATCTCCCGGACCCCCGAGGTGACCTGCGTGGTGGTGGATGTCTCGCACG<br>AGGACCCGGAGGTGAAGTTCAACTGGTACGTGGATGGCGTGGAAGTCCATAACGCCAAGACA<br>AAGCCCCGGGAGGAACAGTACAACAGCACCTATAGGGTGGTGAGCGTGCTGACGGTGCTGCA<br>CCAGGATTGGCTGAACGGCAAGGAATACAAGTGCAAGGTGTCCAACAAGGCCCTGCCTGCCC<br>CCATCGAGAAAACCATCTCCAAGGCCAAGGGCCAACCCCGAGAGCCCCAGGTTTACACTTTA<br>CCCCCCTCCAGGGACGAGCTGACCAAGAATCAGGTGAGCCTCACCTGCCTGGTCAAGGGGTT<br>CTACCCCAGCGACATCGCCGTGGAGTGGGAAAGCAACGGCCAGCCCGAGAACAACTACAAGA<br>CAACCCCGCCCGTGCTGGACAGCGACGGGAGCTTCTTCCTGTATAGCAAGCTGACCGTGGAT<br>AAGAGCCGGTGGCAGCAGGGCAACGTGTTTAGCTGCAGCGTTATGCACGAGGCCCTGCACAA<br>CCACTACACCCAGAAATCCCTGTCCCTGTCCCCCGGTAAG |
| 511 | CD80_Fc-CO14 | ATGGGCCACACGAGGCGTCAGGGCACCAGCCCCAGCAAGTGCCCCTACCTCAATTTCTTCCA<br>GCTCCTCGTCCTAGCCGGTCTGAGCCACTTCTGCAGCGGGGTCATCCACGTAACCAAGGAGG<br>TCAAGGAGGTCGCCACCTTGTCCTGCGGCCATAACGTCTCCGTAGAGGAGCTCGCGCAAACG<br>CGGATATATTGGCAAAAAGAGAAGAAGATGGTCCTCACCATGATGTCCGGGGACATGAATAT<br>CTGGCCCGAATACAAAAACAGGACCATCTTCGACATCACGAACAATCTCTCCATCGTGATCC<br>TGGCCCTGAGGCCCAGCGACGAGGGCACCTACGAGTGCGTGGTCCTGAAGTACGAGAAGGAC<br>GCCTTCAAGAGGGAGCACCTGGCCGAGGTGACCCTGTCCGTGAAGGCAGACTTCCCCACCCC<br>CAGCATCAGCGACTTCGAGATCCCCACCTCCAACATCAGAAGGATCATCTGCTCCACCTCGG<br>GCGGTTTCCCCGAGCCCCACCTGAGTTGGCTCGAGAACGGCGAGGAACTGAATGCCATTAAC<br>ACCACCGTCAGCCAGGACCCCGAGACGGAGCTGTACGCCGTCTCATCCAAACTGGACTTCAA<br>CATGACCACCAATCACAGCTTCATGTGTCTGATTAAGTACGGGCATCTGCGGGTCAACCAAA<br>CCTTTAACTGGAACACAACCAAACAGGAACATTTCCCGGACGACAAGACCCACACGTGCCCA<br>CCCTGCCCCGCCCCCGAGCTGCTCGGCGGGCCGAGCGTGTTCCTGTTCCCGCCCAAACCCAA<br>GGACACTCTGATGATCTCCCGGACCCCCGAGGTGACGTGCGTGGTGGTGGACGTGAGTCACG<br>AGGACCCCGAGGTGAAGTTCAACTGGTACGTGGACGGGGTGGAGGTGCATAATGCCAAGACC<br>AAGCCGAGGGAGGAGCAGTACAACTCCACCTACAGGGTCGTGAGCGTGCTTACGGTGCTCCA<br>CCAGGACTGGCTGAACGGGAAGGAGTACAAGTGTAAGGTGAGCAATAAGGCGCTGCCCGCCC<br>CCATCGAGAAAACCATCAGCAAAGCCAAGGGGCAGCCCCGGGAGCCCCAGGTGTACACCCTC<br>CCCCCATCCAGAGACGAGCTCACCAAGAATCAGGTGAGCCTCACCTGCCTGGTCAAGGGCTT<br>CTATCCCTCCGACATCGCCGTGGAGTGGGAATCCAACGGGCAGCCCGAGAACAACTATAAAA<br>CCACCCCACCGGTCCTGGACTCAGATGGGAGCTTCTTCCTGTACAGCAAGCTCACCGTCGAC<br>AAGTCGAGGTGGCAGCAGGGGAACGTGTTCAGCTGCTCCGTGATGCACGAAGCCCTGCACAA<br>CCACTACACCCAGAAGTCGCTCAGCCTGAGCCCAGGGAAG |
| 512 | CD80_Fc-CO15 | ATGGGCCACACGAGGAGGCAGGGGACCTCCCCCTCAAAGTGCCCCTATCTCAACTTCTTCCA<br>GCTCCTCGTCCTTGCCGGCCTCTCTCACTTCTGCAGCGGGGTCATCCACGTCACAAAGGAGG<br>TCAAGGAGGTCGCCACCCTCTCCTGCGGGCACAACGTCAGCGTTGAGGAGCTTGCCCAGACC<br>AGGATCTACTGGCAGAAGGAGAAGAAGATGGTCCTCACCATGATGTCCGGGGACATGAACAT<br>TTGGCCCGAGTACAAGAATAGGACCATCTTCGATATCACCAACAACTTGAGCATCGTGATCC<br>TGGCCCTGCGGCCCAGCGACGAGGGCACCTACGAGTGTGTCGTGCTGAAGTACGAGAAGGAC<br>GCCTTCAAGCGGGAGCATCTCGCCGAGGTGACCCTGAGCGTCAAGGCCGACTTCCCCACCCC<br>CTCCATCAGCGATTTCGAGATCCCGACCAGCAACATCCGGCGTATCATATGCAGCACCAGCG<br>GCGGATTCCCGGAGCCCCATCTGTCCTGGCTTGAGAACGGCGAGGAGCTGAATGCCATCAAT<br>ACCACGGTTAGCCAGGACCCGGAGACAGAACTGTACGCCGTGTCCAGCAAACTGGACTTCAA<br>CATGACAACCAATCACTCCTTCATGTGCCTGATCAAGTACGGCCACCTGAGGGTGAACCAGA<br>CGTTCAACTGGAATACCACCAAGCAGGAGCACTTCCCCGACGACAAAACGCACACATGCCCG<br>CCCTGCCCCGCCCCCGAGCTGCTGGGCGGTCCCTCCGTGTTCCTGTTCCCACCCAAGCCGAA<br>GGACACGCTGATGATCAGCCGCACCCCCGAGGTGACATGCGTGGTGGTCGACGTCAGCCACG<br>AGGACCCCGAGGTGAAGTTCAACTGGTACGTGGACGGCGTGGAAGTGCACAACGCCAAGACC<br>AAGCCCCGCGAGGAACAGTACAATTCGACCTACAGGGTGGTGAGCGTGCTGACCGTGCTGCA<br>CCAGGACTGGCTGAATGGCAAGGAATACAAGTGCAAGGTCAGCAATAAGGCCCTGCCCGCCC<br>CCATCGAGAAGACCATCAGCAAGGCCAAGGGCCAGCCCAGGGAACCCCAGGTGTACACCCTG<br>CCCCCGAGCCGGGACGAGCTGACCAAGAACCAGGTGAGCCTGACGTGTCTGGTGAAGGGCTT<br>CTACCCCAGCGACATCGCCGTGGAGTGGGAGAGCAACGGTCAGCCCGAGAACAACTACAAGA<br>CCACCCCTCCCGTCCTGGATAGCGACGGCTCCTTCTTCCTGTACAGCAAGCTGACCGTGGAC<br>AAAAGCAGGTGGCAGCAGGGCAACGTGTTCAGCTGCAGCGTGATGCACGAGGCGCTGCACAA<br>CCACTACACCCAAAAGAGCCTGTCGCTGAGCCCCGGCAAG |
| 513 | CD80_Fc-CO16 | ATGGGCCACACCAGGAGGCAGGGCACCTCGCCCTCGAAGTGCCCCTACCTTAATTTCTTCCA<br>GCTACTTGTACTCGCCGGCCTCAGCCACTTCTGCAGCGGCGTCATCCACGTTACCAAAGAAG<br>TAAAGGAGGTCGCAACCCTCAGCTGCGGACACAACGTGAGCGTCGAGGAGCTCGCGCAGACC<br>CGGATCTACTGGCAGAAGGAAAAGAAGATGGTCCTCACGATGATGTCCGGAGATATGAACAT<br>TTGGCCCGAGTACAAAAACCGCACCATCTTCGACATCACCAACAACCTTTCGATAGTGATCC<br>TGGCGCTCAGGCCCAGCGACGAGGGCACATACGAATGCGTGGTGCTTAAGTACGAGAAGGAT<br>GCCTTCAAGCGGGAGCACCTGGCCGAGGTGACGCTGTCCGTGAAGGCCGACTTCCCCACCCC<br>TAGCATAAGCGATTTCGAGATCCCCACCAGCAACATCAGGCGCATCATCTGCAGCACCAGCG<br>GGGGCTTCCCCGAGCCCCACCTGTCCTGGCTGGAAAACGGCGAGGAGCTGAACGCCATCAAC<br>ACCACCGTCAGCCAGGACCCCGAGACAGAGCTGTACGCCGTGAGCTCCAAGCTGGATTTCAA<br>CATGACCACAAACCATTCCTTCATGTGCCTGATTAAGTATGGTCACCTGCGGGTGAACCAGA<br>CCTTTAACTGGAACACGACCAAGCAGGAGCACTTCCCCGACGACAAGACCCACACGTGCCCC<br>CCTTGCCCCGCCCCCGAGCTGCTCGGCGGCCCCTCCGTGTTCCTGTTCCCACCCAAGCCGAA<br>GGACACCCTCATGATCAGCCGCACCCCCGAGGTGACCTGCGTGGTCGTGGACGTGAGCCATG<br>AGGATCCCGAAGTGAAGTTCAATTGGTACGTGGACGGGGTGGAGGTGCACAACGCAAAGACC |

TABLE 5-continued

Sequence optimized sequences for CD80Fc

| SEQ ID NO | Name | Sequence |
|---|---|---|
| | | AAGCCGAGGGAGGAGCAGTACAACAGCACCTACAGGGTGGTGTCCGTCCTGACCGTGCTGCA<br>CCAGGATTGGCTGAACGGGAAGGAGTATAAGTGCAAGGTGAGCAATAAAGCCCTGCCCGCCC<br>CCATCGAGAAGACCATCAGCAAGGCGAAGGGCCAACCCCGGGAGCCGCAGGTCTATACGCTG<br>CCCCCCAGCCGGGACGAGCTCACCAAGAACCAGGTGAGCCTGACCTGTCTGGTGAAGGGATT<br>CTATCCCTCCGACATCGCCGTGGAGTGGGAATCCAACGGCCAGCCCGAAAACAACTACAAGA<br>CAACGCCCCCCGTGCTGGACTCCGACGGCAGCTTCTTCCTGTATAGCAAGCTGACCGTCGAC<br>AAGTCGCGCTGGCAGCAGGGCAACGTGTTCAGCTGCAGCGTGATGCATGAGGCCCTGCACAA<br>CCATTACACGCAGAAGTCCCTCTCCCTTAGCCCCGGTAAG |
| 514 | CD80_Fc-CO17 | ATGGGCCATACGAGGCGCCAAGGCACGAGCCCCAGCAAGTGCCCCTACCTTAACTTCTTCCA<br>ACTTCTCGTCCTCGCCGGCTTAAGCCACTTTTGCAGCGGGGTCATCCACGTGACCAAGGAGG<br>TCAAAGAGGTCGCCACGCTCAGCTGCGGTCACAACGTATCGGTTGAGGAGTTAGCGCAGACC<br>AGGATCTACTGGCAGAAGGAAAAGAAGATGGTCCTCACCATGATGAGCGGCGATATGAACAT<br>CTGGCCCGAGTATAAGAACCGAACCATCTTCGACATAACCAACAACCTCTCCATCGTCATCC<br>TGGCCCTGCGCCCCAGCGACGAGGGCACCTACGAGTGCGTGGTCCTGAAGTATGAGAAGGAT<br>GCCTTTAAGCGGGAGCACCTGGCGGAGGTCACGCTGAGCGTGAAGGCCGACTTCCCCACGCC<br>CAGCATCAGCGATTTCGAGATCCCTACCAGCAATATCCGGCGGATTATCTGTAGCACCAGCG<br>GCGGCTTTCCCGAGCCCCACCTGTCCTGGCTGGAGAATGGCGAGGAGCTGAACGCCATCAAT<br>ACCACCGTGTCGCAGGACCCCGAGACGGAGCTCTACGCCGTGAGCTCCAAGCTGGACTTCAA<br>CATGACCACAAATCACAGCTTTATGTGCCTGATCAAGTACGGCCACCTGAGGGTAAACCAGA<br>CGTTTAACTGGAACACCACCAAGCAGGAGCACTTCCCCGATGACAAGACCCACACCTGCCCT<br>CCCTGCCCCGCCCCCGAGTTGCTCGGCGGCCCCAGCGTGTTTCTCTTTCCCCCCAAGCCCAA<br>GGACACCCTGATGATCTCCAGGACCCCCGAGGTTACCTGCGTCGTGGTCGACGTGAGCCACG<br>AGGATCCCGAGGTCAAGTTCAACTGGTACGTAGACGGCGTGGAGGTGCATAACGCCAAGACA<br>AAGCCCAGGGAGGAGCAATACAACTCGACCTACAGGGTTGTAAGCGTGCTGACCGTCCTGCA<br>CCAGGACTGGCTGAACGGGAAGGAGTACAAGTGCAAGGTCAGCAACAAGGCCCTGCCGGCCC<br>CCATCGAGAAGACCATCAGCAAGGCCAAGGGCCAGCCCAGGGAGCCGCAGGTGTATACCCTG<br>CCACCCAGCAGGGACGAGCTGACCAAAAACCAGGTGAGCCTCACCTGCTTGGTGAAGGGCTT<br>CTACCCCTCCGATATCGCCGTCGAATGGGAGAGCAACGGCCAGCCCGAGAATAACTATAAGA<br>CCACACCCCCGGTGCTAGACAGCGACGGCAGCTTCTTCCTGTACTCGAAGCTGACCGTGGAC<br>AAGAGCCGTTGGCAGCAGGGCAACGTGTTCAGCTGCTCCGTGATGCACGAAGCCCTGCACAA<br>TCACTACACCCAGAAAAGCCTGTCCCTGAGCCCGGGCAAG |
| 515 | CD80_Fc-CO18 | ATGGGCCACACTCGGCGGCAGGGCACCAGCCCCTCAAAGTGTCCCTACCTTAACTTCTTCCA<br>GCTCCTCGTCCTAGCCGGGCTCTCCCACTTCTGCTCGGGCGTCATCCACGTCACGAAGGAGG<br>TCAAGGAGGTCGCCACCCTCTCCTGCGGTCACAACGTCTCCGTCGAAGAACTCGCCCAGACC<br>AGGATCTACTGGCAAAAAGAGAAGAAGATGGTCCTCACCATGATGAGCGGCGACATGAATAT<br>CTGGCCCGAGTACAAGAACCGGACCATCTTCGACATCACCAACAACCTAAGCATCGTGATCC<br>TGGCCCTGCGCCCCTCGGACGAGGGGACCTACGAGTGCGTGGTGTTAAAGTACGAGAAGGAT<br>GCCTTTAAGAGGGAGCACCTGGCTGAGGTCACCCTCAGCGTGAAGGCCGACTTTCCGACCCC<br>CAGCATCTCCGACTTCGAGATACCCACCAGCAACATCAGGAGGATCATCTGCAGCACCAGCG<br>GAGGCTTTCCCGAGCCCCACCTGTCGTGGCTGGAGAACGGGGAAGAACTGAACGCCATCAAC<br>ACCACCGTGAGCCAGGACCCGGAGACGGAGCTCTACGCCGTGTCCAGCAAGCTGGACTTTAA<br>CATGACGACCAATCACAGCTTCATGTGCCTGATCAAGTACGGGCACCTGAGAGTCAACCAGA<br>CCTTCAACTGGAACACCACCAAGCAGGAGCACTTTCCGGATGACAAGACCCATACCTGCCCG<br>CCCTGCCCCGCGCCCGAGCTGCTGGGCGGCCCCAGCGTGTTTCTGTTCCCGCCCAAGCCCAA<br>GGATACCCTGATGATCAGCCGGACCCCCGAAGTGACGTGCGTGGTGGTGGACGTGAGCCACG<br>AGGACCCCGAGGTGAAGTTTAACTGGTACGTGGACGGCGTGGAGGTGCATAACGCCAAGACC<br>AAGCCCCGCGAGGAGCAGTACAACAGCACCTATAGGGTCGTCTCCGTGCTGACCGTGCTGCA<br>CCAGGATTGGCTGAACGGCAAGGAGTACAAGTGCAAGGTGTCGAACAAGGCCCTGCCCGCGC<br>CCATCGAGAAAACCATCTCCAAGGCCAAGGGCCAACCCAGGGAACCCCAGGTTTACACGCTC<br>CCGCCCTCCCGCGACGAGCTCACCAAGAACCAAGTGAGCCTGACGTGTCTGGTCAAGGGGTT<br>TTACCCCAGCGATATCGCGGTGGAGTGGGAGAGCAACGGTCAGCCCGAGAACAACTACAAGA<br>CCACCCCGCCGGTGCTGGACAGCGATGGGTCCTTCTTCCTCTACAGCAAGCTGACCGTGGAC<br>AAGAGCAGGTGGCAGCAGGGCAACGTGTTCAGCTGCTCCGTGATGCACGAGGCGCTGCACAA<br>CCACTACACCCAGAAGTCCCTGAGCCTGTCGCCCGGCAAG |
| 516 | CD80_Fc-CO19 | ATGGGTCACACACGGAGGCAGGGGACCAGCCCCAGCAAGTGCCCCTACCTCAACTTCTTTCA<br>GCTCCTCGTCCTCGCGGGGCTCTCCCACTTCTGCAGCGGGGTCATCCACGTGACCAAGGAGG<br>TAAAGGAGGTAGCCACACTCAGCTGCGGCCACAACGTTAGCGTCGAGGAACTCGCGCAGACG<br>CGGATCTATTGGCAGAAGGAGAAGAAGATGGTCTTAACCATGATGAGCGGCGACATGAACAT<br>CTGGCCCGAGTACAAGAACAGGACCATCTTCGACATCACAAACAACCTCTCCATCGTGATCC<br>TGGCCCTGCGACCCTCAGATGAGGGCACCTACGAGTGTGTGGTGCTCAAGTACGAGAAAGAC<br>GCCTTCAAGAGGGAGCACCTGGCAGAGGTGACCCTGAGCGTCAAGGCGGACTTCCCCACCCC<br>AAGCATCTCCGATTTCGAAATCCCCACCAGCAACATTCGGAGGATCATCTGCAGCACTAGCG<br>GTGGCTTCCCCGAGCCCCATCTGAGCTGGCTGGAGAACGGCGAGGAGCTCAATGCCATCAAC<br>ACCACCGTGAGCCAGGACCCCGAGACGGAGCTCTACGCCGTGAGCTCGAAGCTGGATTTCAA<br>CATGACCACGAACCACAGCTTCATGTGCCTGATCAAATATGGCCACCTGCGGGTGAACCAGA<br>CCTTCAACTGGAACACCACGAAGCAGGAGCACTTCCCCGACGATAAGACCCATACCTGCCCG<br>CCGTGCCCCGCCCCCGAGCTGCTGGGCGGTCCGTCCGTCTTCCTGTTCCCGCCCAAGCCCAA<br>GGACACCCTCATGATCTCCAGGACGCCGGAGGTGACCTGTGTGGTCGTGGACGTGAGCCACG<br>AGGACCCCGAGGTGAAGTTCAACTGGTACGTGGACGGGGTGGAGGTGCATAACGCCAAGACC<br>AAGCCGCGGGAGGAACAGTACAACAGCACCTATCGGGTGGTGTCCGTGCTCACGGTCCTGCA<br>CCAGGATTGGCTGAATGGCAAAGAATACAAGTGCAAAGTGAGCAACAAGGCCCTGCCCGCCC<br>CCATCGAAAAGACCATCAGCAAGGCCAAGGGCCAGCCCAGGGAGCCCCAGGTGTATACGCTG |

TABLE 5-continued

Sequence optimized sequences for CD80Fc

| SEQ ID NO | Name | Sequence |
|---|---|---|
| | | CCCCCCAGCCGGGACGAGCTCACCAAAAACCAAGTCTCACTGACCTGCCTGGTGAAGGGCTT<br>CTACCCATCCGATATCGCCGTGGAATGGGAGTCCAATGGGCAGCCCGAGAACAACTACAAGA<br>CCACCCCACCGGTGCTCGACTCCGACGGCAGCTTCTTCCTCTATAGCAAGCTGACCGTGGAC<br>AAGAGCAGGTGGCAGCAAGGCAACGTGTTCAGCTGCTCCGTGATGCACGAAGCCCTGCACAA<br>CCATTACACTCAGAAGTCCCTGAGCCTGAGCCCCGGGAAG |
| 517 | CD80_Fc-CO20 | ATGGGGCACACCAGGAGGCAGGGGACCAGCCCCTCCAAGTGCCCCTACCTTAACTTTTTTCA<br>GCTACTGGTGCTAGCCGGGCTCAGCCACTTCTGCAGCGGCGTCATCCACGTGACCAAAGAGG<br>TCAAGGAGGTCGCCACCCTCTCCTGCGGCCACAACGTCTCCGTCGAAGAACTAGCGCAGACC<br>AGGATATACTGGCAGAAGGAGAAGAAGATGGTCCTCACCATGATGTCCGGGGACATGAACAT<br>CTGGCCCGAGTACAAGAACAGGACCATCTTCGATATAACCAATAACCTCAGCATCGTGATCC<br>TGGCCCTGAGGCCCAGCGACGAGGGCACCTATGAGTGCGTGGTCCTGAAGTACGAGAAGGAC<br>GCCTTCAAGCGTGAGCACCTGGCCGAGGTCACCCTGAGCGTGAAGGCCGACTTCCCCACCCC<br>CAGCATCAGCGACTTCGAGATCCCCACCAGCAACATCCGCCGTATTATCTGCAGCACCAGCG<br>GGGGGTTCCCGGAGCCGCACCTGAGCTGGCTGGAGAACGGCGAGGAGCTGAACGCCATCAAC<br>ACTACTGTCTCCCAGGATCCCGAAACCGAACTGTACGCCGTGTCCAGCAAGCTGGACTTTAA<br>CATGACCACCAACCACTCGTTTATGTGCCTGATCAAATACGGACACCTGCGGGTAAACCAGA<br>CCTTCAACTGGAACACCACCAAGCAGGAGCACTTCCCGGATGACAAGACCCACACCTGCCCG<br>CCCTGCCCGGCTCCCGAGCTTCTGGGCGGCCCCAGCGTGTTTCTGTTTCCCCCCAAGCCCAA<br>GGATACCCTGATGATCTCCAGGACCCCCGAGGTGACCTGCGTGGTGGTGGATGTGTCCCACG<br>AGGATCCCGAGGTGAAATTTAATTGGTATGTGGACGGGGTCGAGGTGCACAATGCCAAGACC<br>AAGCCCAGAGAGGAGCAGTACAACAGCACCTACAGGGTGGTGAGCGTGCTGACGGTGCTGCA<br>TCAGGACTGGCTGAACGGGAAGGAGTACAAGTGCAAGGTGTCCAACAAGGCCCTCCCGGCCC<br>CCATCGAGAAGACCATCTCCAAGGCCAAGGGTCAGCCGCGCGAGCCCCAAGTGTACACCCTG<br>CCCCCCAGCCGGGACGAGCTGACCAAGAACCAGGTGAGCCTGACCTGTCTGGTGAAGGGCTT<br>CTACCCCAGCGACATCGCCGTCGAGTGGGAGAGCAACGGCCAGCCTGAGAACAACTACAAGA<br>CCACCCCGCCCGTCCTGGACAGCGACGGAAGCTTCTTCCTATACAGCAAGCTGACCGTAGAC<br>AAGAGCAGGTGGCAGCAGGGCAACGTGTTCTCATGCAGCGTGATGCACGAGGCCCTGCATAA<br>CCATTACACCCAGAAAAGCCTCTCGCTCAGCCCCGGCAAG |
| 518 | CD80_Fc-CO21 | ATGGGCCATACCAGGAGGCAGGGCACGAGCCCCAGCAAGTGCCCCTACCTCAACTTCTTCCA<br>GCTCCTCGTCCTTGCCGGGCTCAGCCACTTCTGTAGCGGCGTTATTCACGTAACCAAGGAAG<br>TAAAAGAGGTCGCCACCCTAAGCTGTGGCCACAACGTCAGCGTCGAGGAGCTCGCCCAGACC<br>AGGATCTACTGGCAGAAGGAGAAGAAGATGGTCCTCACAATGATGTCGGGCGACATGAATAT<br>CTGGCCCGAATACAAGAACCGGACAATCTTCGACATCACCAACAACCTCAGCATCGTGATCC<br>TGGCCCTGAGGCCCAGCGACGAAGGGACCTACGAGTGTGTCGTGCTCAAGTACGAAAAGGAC<br>GCCTTCAAAAGGGAGCACCTCGCGGAGGTGACGCTGAGCGTGAAGGCCGACTTCCCCACCCC<br>ATCCATCAGCGACTTCGAGATTCCCACGTCCAACATCCGTAGGATCATTTGCAGCACCTCCG<br>GCGGCTTCCCCGAGCCCCACCTCAGCTGGCTGGAGAACGGCGAGGAACTGAACGCCATCAAC<br>ACCACCGTGAGCCAGGATCCCGAGACGGAGCTGTATGCCGTGAGCAGCAAGCTGGATTTCAA<br>CATGACCACCAACCATTCATTCATGTGCCTGATAAAGTACGGCCACCTGAGGGTGAACCAGA<br>CCTTCAACTGGAACACCACCAAACAGGAACACTTCCCGGACGATAAGACCCATACCTGCCCG<br>CCCTGCCCCGCCCCCGAGCTGCTGGGCGGCCCCTCCGTCTTCCTGTTCCCGCCCAAGCCTAA<br>GGATACCCTGATGATTTCCAGGACCCCCGAGGTGACCTGCGTCGTGGTGGACGTCAGCCACG<br>AGGATCCCGAGGTGAAGTTTAATTGGTACGTCGACGGGGTTGAGGTGCACAACGCCAAGACG<br>AAGCCCAGGGAGGAGCAGTACAACAGCACCTACCGGGTGGTGAGCGTGCTCACCGTGCTGCA<br>TCAGGACTGGCTGAATGGGAAAGAGTACAAATGCAAGGTGAGCAATAAGGCCCTGCCGGCCC<br>CCATCGAGAAGACCATCAGCAAAGCCAAGGGCCAGCCGAGGGAACCCCAGGTGTACACGCTC<br>CCGCCCTCCAGGGACGAGCTGACCAAGAATCAGGTCAGCCTCACCTGCCTCGTGAAGGGGTT<br>TTACCCCTCCGATATCGCCGTGGAATGGGAGAGCAACGGGCAGCCCGAGAACAACTACAAAA<br>CGACGCCCCCCGTCCTGGACTCGGACGGGAGCTTTTTCCTGTATTCTAAGCTGACCGTGGAC<br>AAAAGCCGGTGGCAGCAGGGCAACGTCTTCAGCTGCAGCGTGATGCACGAGGCCCTGCACAA<br>CCATTACACCCAGAAAAGCCTGAGCCTGTCGCCCGGCAAG |
| 519 | CD80_Fc-CO22 | ATGGGGCACACCCGCAGGCAAGGGACCAGCCCTAGCAAGTGCCCCTACCTCAACTTCTTCCA<br>GCTCCTCGTCCTCGCCGGTCTGAGCCACTTCTGCAGCGGCGTCATCCACGTCACCAAGGAGG<br>TCAAGGAGGTCGCCACGCTCAGCTGCGGCCACAACGTCTCCGTAGAGGAGTTGGCCCAGACC<br>AGGATCTACTGGCAGAAGGAGAAGAAGATGGTCTTAACGATGATGAGCGGCGACATGAACAT<br>CTGGCCCGAGTACAAGAACCGCACCATCTTCGACATTACCAACAACCTCTCCATAGTGATCC<br>TGGCCCTCCGGCCGAGCGATGAGGGCACCTACGAATGCGTGGTGCTGAAGTACGAAAAGGAC<br>GCCTTCAAAAGGGAGCACCTGGCGGAGGTGACCCTGTCCGTGAAGGCCGACTTTCCCACGCC<br>CAGCATTAGCGATTTCGAGATCCCCACGAGCAACATCAGGCGCATCATCTGCAGCACCAGCG<br>GCGGGTTCCCCGAGCCCCACCTGTCCTGGCTGGAGAACGGCGAAGAACTGAACGCCATCAAC<br>ACCACCGTGAGCCAGGATCCCGAGACGGAGTTGTACGCCGTGAGCAGCAAACTGGACTTTAA<br>CATGACCACCAACCACTCATTCATGTGCCTCATCAAGTACGGCCACCTGCGGGTGAACCAGA<br>CCTTCAACTGGAACACGACCAAGCAGGAGCACTTCCCCGACGACAAGACGCATACTTGCCCG<br>CCCTGCCCAGCCCCTGAGCTGCTGGGCGGTCCTTCGGTATTCCTGTTTCCCCCCAAGCCCAA<br>GGATACCCTGATGATCAGCCGGACCCCGGAGGTGACCTGCGTCGTGGTGGACGTTAGTCACG<br>AAGACCCCGAGGTGAAGTTTAATTGGTACGTGGACGGCGTGGAGGTCCACAACGCCAAGACC<br>AAGCCCCGTGAGGAGCAGTACAATAGCACGTACAGGGTGGTGAGCGTGCTCACCGTGCTCCA<br>TCAGGACTGGCTCAACGGGAAGGAGTACAAGTGCAAGGTGAGCAATAAGGCCCTCCCCGCCC<br>CGATCGAGAAGACCATCTCGAAGGCCAAGGGGCAGCCCCGGGAACCCCAGGTGTACACCCTC<br>CCGCCCAGCCGGGACGAACTGACCAAGAACCAGGTGTCCCTGACCTGCCTAGTGAAGGGCTT<br>CTACCCCTCCGACATCGCCGTGGAGTGGGAGAGCAACGGCCAGCCCGAGAACAACTATAAGA<br>CCACCCCGCCCGTGCTGGACAGCGATGGCAGCTTTTTCCTGTACAGCAAACTGACCGTGGAC |

TABLE 5-continued

Sequence optimized sequences for CD80Fc

| SEQ ID NO | Name | Sequence |
|---|---|---|
| | | AAGTCCAGGTGGCAGCAGGGCAACGTGTTCAGCTGCAGCGTCATGCACGAGGCCCTGCACAA<br>CCACTACACCCAGAAAAGCCTGTCCCTCAGCCCCGGCAAG |
| 520 | CD80_Fc-CO23 | ATGGGCCATACCCGCAGGCAAGGCACCAGCCCCAGCAAGTGCCCCTACCTCAACTTCTTCCA<br>GCTCTTGGTCCTCGCCGGGCTCAGCCACTTCTGCTCCGGCGTCATACACGTGACCAAGGAGG<br>TCAAGGAGGTCGCCACCCTCTCGTGCGGGCACAACGTCAGCGTCGAGGAGCTCGCCCAGACC<br>AGGATCTACTGGCAGAAGGAGAAGAAGATGGTCCTCACCATGATGAGCGGGGACATGAACAT<br>CTGGCCCGAATACAAGAACCGGACGATCTTCGACATCACGAACAACCTCAGCATCGTGATCC<br>TCGCCCTGCGGCCCAGCGACGAGGGTACCTATGAGTGCGTCGTGCTGAAGTACGAGAAGGAC<br>GCGTTCAAGAGGGAGCATCTGGCGGAAGTGACCCTGAGCGTCAAGGCGGACTTCCCGACGCC<br>CTCGATCAGCGACTTCGAAATTCCCACCTCCAACATCCGCAGGATCATCTGCAGCACCTCCG<br>GAGGCTTCCCCGAGCCCCACCTCTCCTGGCTGGAGAACGGCGAGGAGCTGAACGCCATCAAC<br>ACCACGGTGTCCCAAGACCCAGAGACGGAGCTGTATGCCGTGTCCAGCAAACTGGACTTCAA<br>CATGACCACCAACCACTCCTTCATGTGCCTCATCAAATACGGCCACCTGAGGGTGAACCAGA<br>CCTTCAATTGGAACACCACCAAACAGGAGCACTTCCCCGACGATAAGACCCATACCTGTCCC<br>CCCTGCCCCGCCCCCGAGCTGCTGGGCGGCCCCAGCGTGTTCCTGTTCCCGCCCAAGCCCAA<br>GGACACCCTGATGATCAGTAGGACCCCCGAGGTTACCTGCGTGGTGGTGGACGTGAGCCACG<br>AGGACCCCGAGGTCAAGTTCAACTGGTATGTGGATGGCGTCGAGGTGCACAACGCCAAGACC<br>AAACCCCGGGAGGAGCAATACAACAGCACCTATAGGGTGGTGAGCGTCCTGACCGTGCTCCA<br>CCAGGATTGGCTCAATGGCAAGGAGTATAAGTGTAAGGTGTCCAACAAGGCCCTGCCGGCCC<br>CCATAGAGAAGACCATCTCCAAGGCCAAGGGCCAGCCCAGGGAGCCCCAGGTATACACCCTG<br>CCCCCCTCCCGGGATGAGCTGACGAAGAACCAGGTGAGCCTGACCTGCCTGGTGAAGGGGTT<br>CTACCCCAGCGACATAGCCGTGGAATGGGAATCCAACGGCCAGCCCGAAAACAACTACAAGA<br>CCACGCCGCCCGTGCTGGACAGCGACGGCAGCTTCTTCCTGTATAGCAAGCTGACCGTGGAC<br>AAGTCCCGCTGGCAGCAGGGCAACGTCTTCTCCTGCTCCGTGATGCATGAGGCCCTGCACAA<br>TCACTACACCCAAAAGAGCCTGAGCCTGAGCCCCGGTAAG |
| 521 | CD80_Fc-CO24 | ATGGGGCACACCAGGCGCCAGGGGACTTCTCCTAGCAAGTGCCCCTACCTCAACTTCTTCCA<br>GCTCCTCGTCCTCGCCGGCCTCTCGCATTTTGCAGCGGGGTCATCCACGTCACCAAGGAAG<br>TCAAGGAGGTCGCCACCCTCAGCTGCGGCCACAACGTCAGCGTCGAGGAGCTCGCTCAGACC<br>CGGATATACTGGCAGAAGGAGAAGAAGATGGTCCTCACCATGATGTCGGGCGATATGAACAT<br>CTGGCCCGAATATAAAAACCGGACCATCTTCGACATCACCAACAATCTCTCCATCGTGATCC<br>TCGCCCTGCGGCCCTCCGATGAAGGAACATACGAGTGCGTGGTCCTGAAATACGAGAAAGAC<br>GCCTTCAAGAGGGAGCATCTGGCCGAGGTCACCCTGTCGGTGAAAGCCGACTTCCCGACCCC<br>CAGCATCTCCGACTTCGAGATCCCCACCAGCAACATTAGGCGGATCATCTGCAGCACCAGCG<br>GGGGCTTTCCCGAACCGCACCTGAGCTGGCTGGAGAACGGGGAGGAACTGAACGCCATCAAC<br>ACCACCGTGTCCCAAGACCCCGAGACGGAACTGTACGCGGTCAGCAGCAAGCTGGACTTCAA<br>TATGACCACCAACCACTCGTTCATGTGCCTGATCAAGTACGGCCACCTCAGGGTTAACCAGA<br>CCTTCAACTGGAACACCACCAAGCAGGAGCACTTCCCCGACGATAAGACCCACACGTGCCCC<br>CCGTGCCCCGCCCCGGAGCTGCTGGGCGGCCCCAGCGTGTTCCTGTTCCCTCCCAAGCCCAA<br>GGATACCCTGATGATCAGCAGGACACCCGAGGTGACCTGCGTGGTGGTAGACGTGTCCCACG<br>AGGACCCGGAAGTGAAGTTCAACTGGTACGTGGACGGCGTAGAGGTGCACAACGCCAAAACG<br>AAGCCCCGCGAAGAACAGTACAACAGCACCTACAGGGTGGTGAGCGTGCTGACCGTGCTGCA<br>CCAAGACTGGCTGAACGGGAAGGAGTACAAGTGTAAGGTGAGCAATAAGGCCCTGCCCGCCC<br>CCATCGAGAAGACCATCAGCAAGGCGAAGGGGCAGCCCAGGGAGCCGCAGGTGTACACCCTG<br>CCCCCCTCCAGGGACGAGTTGACGAAGAATCAGGTGTCCCTGACGTGCCTGGTGAAGGGCTT<br>CTACCCCAGCGACATCGCCGTGGAGTGGGAGAGCAACGGGCAGCCCGAGAACAATTACAAGA<br>CCACCCCACCCGTGCTGGATTCCGACGGCAGCTTTTTTCTGTACTCCAAGCTGACCGTGGAC<br>AAATCCCGCTGGCAGCAGGGGAACGTGTTCTCGTGCAGCGTGATGCACGAGGCCCTGCACAA<br>CCACTACACTCAGAAAAGCTTGAGCCTGAGCCCCGGGAAA |
| 522 | CD80_Fc-CO25 | ATGGGCCATACCCGGCGTCAAGGGACCTCCCCGAGCAAGTGTCCCTACCTCAACTTCTTCCA<br>GCTCCTAGTCCTCGCCGGCCTCTCCCACTTCTGCTCCGGCGTAATCCACGTTACGAAGGAGG<br>TCAAAGAGGTCGCGACCCTCAGCTGTGGCCATAACGTCTCCGTAGAGGAGTTGGCGCAGACA<br>AGGATCTATTGGCAGAAGGAGAAGAAGATGGTCCTTACCATGATGAGCGGCGACATGAACAT<br>CTGGCCGGAGTACAAGAATCGGACCATCTTCGACATCACTAACAATCTTAGCATAGTGATCC<br>TCGCCCTGAGGCCCAGCGATGAGGGGACCTACGAATGCGTGGTGCTTAAGTACGAGAAGGAC<br>GCCTTCAAGAGGGAGCACCTCGCCGAGGTGACACTGAGCGTGAAAGCCGACTTCCCCACCCC<br>GAGCATCAGCGACTTCGAGATCCCCACCAGCAACATCAGGAGGATCATCTGTAGCACCAGCG<br>GAGGCTTTCCCGAGCCCCACCTCAGCTGGCTGGAGAACGGGGAGGAGCTCAATGCTATCAAT<br>ACCACCGTGAGCCAGGACCCCGAAACGGAGCTCTACGCCGTCTCCTCGAAGCTGGACTTCAA<br>CATGACCACCAACCACAGCTTCATGTGCCTGATCAAGTACGGGCACCTGCGGGTGAACCAGA<br>CCTTCAACTGGAACACCACAAAGCAGGAGCATTTTCCAGACGACAAAACCCACACGTGCCCC<br>CCGTGCCCCGCGCCCGAGCTCCTGGGGGGACCCAGCGTGTTCCTGTTTCCCCCCAAGCCCAA<br>AGACACCCTGATGATCAGCAGGACCCCGGAGGTGACCTGTGTCGTGGTGGACGTGAGCCACG<br>AGGACCCCGAGGTGAAGTTCAATTGGTACGTGGACGGCGTGGAGGTGCACAACGCCAAGACC<br>AAGCCCCGCGAGGAGCAGTACAACAGCACCTACCGGGTGGTGAGCGTGCTGACCGTCCTGCA<br>CCAGGACTGGCTGAACGGGAAGGAGTACAAGTGCAAGGTGAGCAACAAGGCCCTCCCCGCCC<br>CGATCGAGAAAACAATCAGCAAGGCCAAGGGGCAACCCCGGGAACCCCAGGTCTACACCCTG<br>CCCCCCAGCCGCGACGAGCTGACCAAGAACCAAGTGAGCCTGACCTGCCTGGTGAAGGGGTT<br>CTACCCGAGCGATATCGCCGTGGAGTGGGAGAGCAACGGTCAGCCCGAGAACAACTACAAGA<br>CCACCCCGCCCGTGCTCGACAGCGACGGTAGCTTCTTCCTGTACAGCAAGCTGACCGTCGAT<br>AAGAGCAGGTGGCAGCAAGGCAACGTGTTCTCCTGCAGCGTGATGCACGAGGCCCTCCACAA<br>CCACTACACCCAGAAAAGCCTGTCGCTTTCCCCCGGCAAG |

The CD80 sequence-optimized polynucleotide sequences disclosed herein are distinct from the corresponding CD80 wild type polynucleotide sequences and from other known sequence-optimized polynucleotide sequences, e.g., these sequence-optimized nucleic acids have unique compositional characteristics. See FIGS. 87A to 88B In some embodiments, the percentage of uracil or thymine nucleobases in a sequence-optimized CD80 polynucleotide sequence (e.g., encoding a CD80 polypeptide, a functional fragment, or a variant thereof) is modified (e.g., reduced) with respect to the percentage of uracil or thymine nucleobases in the reference wild-type polynucleotide sequence. Such a sequence is referred to as a uracil-modified or thymine-modified sequence. The percentage of uracil or thymine content in a CD80 polynucleotide sequence can be determined by dividing the number of uracils or thymines in a sequence by the total number of nucleotides and multiplying by 100. In some embodiments, the sequence-optimized CD80 polynucleotide sequence has a lower uracil or thymine content than the uracil or thymine content in the reference wild-type sequence. In some embodiments, the uracil or thymine content in a sequence-optimized CD80 polynucleotide sequence disclosed herein is greater than the uracil or thymine content in the reference wild-type sequence and still maintain beneficial effects, e.g., increased expression and/or CD80 response when compared to the reference wild-type sequence.

The uracil or thymine content of wild-type CD80 is about 26.60%. In some embodiments, the uracil or thymine content of a uracil- or thymine-modified sequence encoding a CD80 polypeptide is less than 25.60%. In some embodiments, the uracil or thymine content of a uracil- or thymine-modified sequence encoding a CD80 polypeptide disclosed herein is less than 25%, less than 24%, less than 23%, less than 22%, less than 21%, less than 20%, less than 19%, less that 18%, less than 17%, or less than 16%. In some embodiments, the uracil or thymine content is not less than 15%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding a CD80 polypeptide disclosed herein is between 15% and 25%, between 15% and 24%, between 16% and 25%, between 16% and 24%, between 17% and 24%, between 17% and 23%, between 17% and 22%, between 15% and 22%, between 15% and 21%, between 15% and 20%, between 15% and 19%, between 15% and 18%, or between 15% and 17%.

In some embodiments, the uracil or thymine content (% $U_{TL}$ or % $T_{TL}$) of a uracil- or thymine-modified sequence encoding a CD80 polypeptide disclosed herein is between 13% and 20%, between 13% and 19%, between 13% and 18%, between 14% and 19%, between 14% and 18%, between 14% and 17%, between 14% and 16%, between 15% and 18%, between 15% and 19%, between 15% and 17%, or between 16% and 17%.

In a particular embodiment, the uracil or thymine content (% $U_{TL}$ or % $T_{TL}$) of a uracil- or thymine modified sequence encoding a CD80 polypeptide disclosed herein is between about 15% and about 18%, e.g., between 16% and 18%

The uracil or thymine content of wild-type Fc is about 15.57%. In some embodiments, the uracil or thymine content of a uracil- or thymine-modified sequence encoding an Fc polypeptide is less than 15%. In some embodiments, the uracil or thymine content of a uracil- or thymine-modified sequence encoding a CD80 polypeptide disclosed is less than 15% or less than 14%. In some embodiments, the uracil or thymine content is not less than 13%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding an Fc region disclosed is between 13% and 16%, between 13% and 15%, between 13% and 14%, or between 14% and 15%.

In some embodiments, the uracil or thymine content (% $U_{TL}$ or % $T_{TL}$) of a uracil- or thymine-modified sequence encoding an Fc region disclosed is between 11% and 18%, between 11% and 17%, between 11% and 16%, between 11% and 15%, between 12% and 18%, between 12% and 17%, between 12% and 16%, between 12% and 15%, between 13% and 16%, between 13% and 17%, between 13% and 18%, between 13% and 15%, or between 14% and 15%.

In a particular embodiment, the uracil or thymine content (% $U_{TL}$ or % $T_{TL}$) of a uracil- or thymine modified sequence encoding a CD80 polypeptide disclosed herein is between about 13% and about 16%, e.g., between 13% and 15%.

In some embodiments, the % $U_{WT}$ or % $T_{WT}$ of a uracil- or thymine-modified sequence encoding a CD80 polypeptide disclosed herein is above 50%, above 55%, above 60%, or above 65%.

In some embodiments, the % $U_{WT}$ or % $T_{WT}$ of a uracil- or thymine modified sequence encoding a CD80 polypeptide disclosed herein is between 49% and 79%, between 50% and 78%, between 51% and 77%, between 52% and 76%, between 53% and 75%, between 54% and 74%, between 55% and 73%, between 56% and 72%, between 57% and 71%, between 58% and 70%, or between 59% and 69%.

In some embodiments, the % $U_{WT}$ or % $T_{WT}$ of a uracil- or thymine-modified sequence encoding a CD80 polypeptide disclosed herein is between 57% and 71%, between 57% and 70%, between 58% and 70%, between 59% and 70%, between 59% and 69%, between 60% and 70%, or between 61% and 70%.

In a particular embodiment, the % $U_{WT}$ or % $T_{WT}$ of a uracil- or thymine-modified sequence encoding a CD80 polypeptide disclosed herein is between about 59% and about 69%, e.g., between 60% and 69%.

In some embodiments, the % $U_{WT}$ or % $T_{WT}$ of a uracil- or thymine-modified sequence encoding an Fc polypeptide disclosed herein is above 50%, above 55%, above 60%, or above 65%, above 70%, above 75%, above 80%, above 85%, above 90%, or above 95%.

In some embodiments, the % $U_{WT}$ or % $T_{WT}$ of a uracil- or thymine modified sequence encoding an Fc polypeptide disclosed herein is between 75% and 100%, between 76% and 100%, between 77% and 100%, between 78% and 100%, between 79% and 100%, between 80% and 100%, between 81% and 100%, between 82% and 100%, between 83% and 100%, between 84% and 100%, or between 85% and 100%.

In some embodiments, the % $U_{WT}$ or % $T_{WT}$ of a uracil- or thymine-modified sequence encoding an Fc polypeptide disclosed herein is between 83% and 100%, between 84% and 100%, between 85% and 100%, between 86% and 100%, or between 87% and 100%.

In a particular embodiment, the % $U_{WT}$ or % $T_{WT}$ of a uracil- or thymine-modified sequence encoding an Fc polypeptide disclosed herein is between about 85% and about 100%, e.g., between 86% and 100%.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or $T_{TL}$ with respect to DNA.

In some embodiments, the % $U_{TM}$ of a uracil-modified sequence encoding a CD80 polypeptide disclosed herein or encoding an Fc polypeptide disclosed herein is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding a CD80 polypeptide disclosed herein or encoding an Fc polypeptide disclosed herein is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, above 132%, above 133%, above 134%, above 135%, above 136%, above 137% above 138%, above 139%, above 140%, above 141%, above 142%, or above 143%.

In some embodiments, the % $U_{TM}$ of a uracil-modified sequence encoding a CD80 polypeptide disclosed herein is between 122% and 124%, between 121% and 125%, between 120% and 126%, between 119% and 127%, between 118% and 128%, between 117% and 129%, between 116% and 130%, between 115% and 131%, between 114% and 132%, between 113% and 133%, between 112% and 134%, between 111% and 135%, between 110% and 136%, between 109% and 137%, or between 108% and 138%. In some embodiments, the % $U_{TM}$ of a uracil-modified sequence encoding a CD80 polypeptide disclosed herein is between about 119% and about 139%, e.g., between 120% and 138%.

In some embodiments, the % UI of a uracil-modified sequence encoding an Fc polypeptide disclosed herein is between 135% and 137%, between 134% and 138%, between 133% and 139%, between 132% and 140%, between 131% and 141%, between 130% and 142%, between 129% and 143%, between 128% and 144%, between 127% and 145%, between 126% and 146%, between 125% and 147%, between 124% and 148%, between 123% and 149%, between 122% and 150%, or between 121% and 151%. In some embodiments, the % $U_{TM}$ of a uracil-modified sequence encoding a CD80 polypeptide disclosed herein is between about 122% and about 144%, e.g., between 123% and 143%.

In some embodiments, a uracil-modified sequence encoding a CD80 polypeptide disclosed herein or an Fc polypeptide disclosed herein has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide. Wild type CD80 contains 23 uracil pairs (UU), and 8 uracil triplets (UUU). In some embodiments, a uracil-modified sequence encoding a CD80 polypeptide disclosed herein has a reduced number of uracil triplets (UUU) with respect to the wild-type nucleic acid sequence. In some embodiments, a uracil-modified sequence encoding a CD80 polypeptide disclosed herein contains 8, 7, 6, 5, 4, 3, 2, 1 or no uracil triplets (UUU).

In some embodiments, a uracil-modified sequence encoding a CD80 polypeptide disclosed herein or an Fc polypeptide disclosed herein has a reduced number of uracil pairs (UU) with respect to the number of uracil pairs (UU) in the wild-type nucleic acid sequence. In some embodiments, a uracil-modified sequence encoding a CD80 polypeptide, e.g., a CD80 polypeptide comprising the EC domain of CD80 or a functional portion thereof, disclosed herein has a number of uracil pairs (UU) corresponding to the minimum possible number of uracil pairs (UU) in the wild-type nucleic acid sequence, e.g., 11 uracil pairs in the case of wild type CD80.

In some embodiments, a uracil-modified sequence encoding a CD80 polypeptide disclosed herein or an Fc polypeptide disclosed herein has at least 1, 2, 3, 4, 5, 6, 7, 8, 9, or 10 uracil pairs (UU) less than the number of uracil pairs (UU) in the wild-type nucleic acid sequence. In some embodiments, a uracil-modified sequence encoding a CD80 polypeptide disclosed herein has between 5 and 14 uracil pairs (UU). In other embodiments, a uracil-modified sequence encoding an Fc polypeptide disclosed herein has between 4 and 11 uracil pairs (UU).

In some embodiments, a uracil-modified sequence encoding a CD80 polypeptide disclosed herein has a % $UU_{wt}$ less than 99%, less than 95%, less than 90%, less than 85%, less than 80%, less than 75%, less than 70%, less than 65%, less than 60%, less than 65%, less than 60%, less than 55%, less than 50%, less than 40%, or less than 35%.

In some embodiments, a uracil-modified sequence encoding a CD80 polypeptide has a % $UU_{wt}$ between 99% and 38%. In a particular embodiment, a uracil-modified sequence encoding a CD80 polypeptide, e.g., a CD80 polypeptide comprising the EC domain of CD80 or a functional portion thereof, disclosed herein has a % $UU_{wt}$ between 33% and 94%.

In some embodiments, a uracil-modified sequence encoding an Fc polypeptide disclosed herein has a % $UU_{wt}$ less than 99%, less than 95%, less than 90%, less than 85%, less than 80%, less than 75%, or less than 70%. In other embodiments, a uracil-modified sequence encoding an Fc polypeptide disclosed herein has a % $UU_{wt}$ more than 100%, more than 110%, more 120%, more than 130%, more than 140%, more than 150%, more than 160%, more than 170%, or more than 180%.

In some embodiments, a uracil-modified sequence encoding an Fc polypeptide has a % $UU_{wt}$ between 190% and 65%. In a particular embodiment, a uracil-modified sequence encoding a CD80 polypeptide, e.g., a CD80 polypeptide comprising the EC domain of CD80 or a functional portion thereof, disclosed herein has a % $UU_{wt}$ between 66% and 184%.

In some embodiments, the CD80 polynucleotide comprises a uracil-modified sequence encoding a CD80 polypeptide or an Fc polypeptide disclosed herein. In some embodiments, the uracil-modified sequence encoding a CD80 polypeptide or an Fc polypeptide comprises at least one chemically modified nucleobase, e.g., 5-methoxyuracil. In some embodiments, at least 95% of a nucleobase (e.g., uracil) in a uracil-modified sequence encoding a CD80 polypeptide or an Fc polypeptide are modified nucleobases.

In some embodiments, at least 95% of uracil in a uracil-modified sequence encoding a CD80 polypeptide or an Fc polypeptide is 5-methoxyuracil. In some embodiments, the CD80 polynucleotide comprising a uracil-modified sequence further comprises a miRNA binding site, e.g., a miRNA binding site that binds to miR-122. In some embodiments, the CD80 polynucleotide comprising a uracil-modified sequence is formulated with a delivery agent, e.g., a compound having Formula (I), e.g., any of Compounds 1-147.

In some embodiments, the "guanine content of the sequence optimized ORF encoding a CD80 polypeptide disclosed herein with respect to the theoretical maximum guanine content of a nucleotide sequence encoding the CD80 polypeptide," abbreviated as % $G_{TMX}$ is at least about 69%, at least about 70%, at least about 75%, at least about 80%, at least about 85%, at least about 90%, at least about 95%, or about 100%. In some embodiments, the % $G_{TMX}$ is between about 65% and about 80%, between about 66% and about 79%, between about 67% and about 78%, between about 68% and about 77%, or between about 68% and about 76%.

In some embodiments, the "guanine content of the sequence optimized ORF encoding an Fc polypeptide disclosed herein with respect to the theoretical maximum guanine content of a nucleotide sequence encoding the Fc polypeptide," abbreviated as % $G_{TMX}$ is at least about 74%, at least about 75%, at least about 80%, at least about 85%, at least about 90%, at least about 95%, or about 100%. In some embodiments, the % $G_{TMX}$ is between about 70% and about 85%, between about 71% and about 84%, between about 72% and about 83%, between about 73% and about 82%, or between about 74% and about 82%.

In some embodiments, the "cytosine content of the ORF relative to the theoretical maximum cytosine content of a nucleotide sequence encoding the CD80 polypeptide," abbreviated as % $C_{TMX}$, is at least 59%, at least 60%, at least about 65%, at least about 70%, at least about 75%, at least about 80%, at least about 85%, at least about 90%, at least about 95%, or about 100%. In some embodiments, the % $C_{TMX}$ is between about 65% and about 85%, between about 66% and about 84%, between about 67% and about 83%, between about 68% and about 82%, between about 69% and about 81%, between about 70% and about 80%, or between about 70% and about 79%.

In some embodiments, the "cytosine content of the ORF relative to the theoretical maximum cytosine content of a nucleotide sequence encoding the Fc polypeptide," abbreviated as % $C_{TMX}$, is at least 59%, at least 60%, at least about 65%, at least about 70%, at least about 75%, at least about 80%, at least about 85%, at least about 90%, at least about 95%, or about 100%. In some embodiments, the % $C_{TMX}$ is between about 62% and about 80%, between about 63% and about 79%, between about 64% and about 78%, between about 65% and about 77%, between about 66% and about 76%, or between about 67% and about 76%.

In some embodiments, the "guanine and cytosine content (G/C) of the ORF relative to the theoretical maximum G/C content in a nucleotide sequence encoding the CD80 polypeptide," abbreviated as % $G/C_{TMX}$ is at least about 80%, at least about 85%, at least about 90%, at least about 95%, or about 100%. In some embodiments, the % $G/C_{TMX}$ is between about 80% and about 100%, between about 85% and about 99%, between about 86% and about 97%, between about 87% and about 96%, between about 88% and about 95%, between about 89% and about 95%, or between about 90% and about 95%.

In some embodiments, the "guanine and cytosine content (G/C) of the ORF relative to the theoretical maximum G/C content in a nucleotide sequence encoding the Fc polypeptide," abbreviated as % $G/C_{TMX}$ is at least about 80%, at least about 85%, at least about 90%, at least about 95%, or about 100%. In some embodiments, the % $G/C_{TMX}$ is between about 80% and about 100%, between about 85% and about 99%, between about 86% and about 97%, between about 87% and about 96%, between about 88% and about 96%, between about 89% and about 96%, between about 90% and about 96%, between about 91% and about 96%, or between about 92% and about 96%.

In some embodiments, the "G/C content in the ORF relative to the G/C content in the corresponding wild-type ORF," abbreviated as % $G/C_{WT}$ is at least 102%, at least 103%, at least 104%, at least 105%, at least 106%, at least 107%, at least 110%, at least 115%, at least 120%, at least 125%, or at least 130%.

In some embodiments, the average G/C content in the 3rd codon position in the ORF is at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, or at least 49% higher than the average G/C content in the 3rd codon position in the corresponding wild-type ORF.

In some embodiments, the CD80 polynucleotide disclosed herein comprises an open reading frame (ORF) encoding a CD80 polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

In some embodiments, the CD80 polynucleotide disclosed herein comprises an open reading frame (ORF) encoding an Fc polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the CD80 polypeptide comprises an amino acid sequence at least 70%, at least 75%, at least 80%, at least 85%, at least 90%, at least 95%, at least 96%, at least 97%, at least 98%, at least 99%, or 100% identical to amino acids 35 to 241 of SEQ ID NO: 473.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the CD80 polypeptide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 473.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the polynucleotide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to nucleotides 103-723 of SEQ ID NO: 474.

In some embodiments, the CD80 polynucleotide (e.g., a RNA, e.g., a mRNA) comprises a nucleotide sequence (e.g., an ORF) encoding a CD80 polypeptide, e.g., a CD80 polypeptide comprising the EC domain of CD80 or a functional portion thereof, wherein the polynucleotide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 474.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 85% to 100%, 88% to 100%, 90% to 100%, 95% to 100%, 80% to 95%, 85% to 95%, 85% to 90%, 90% to 95%, or 95% to 100% sequence identity to nucleotides 103-723 of a sequence selected from the group consisting of SEQ ID NOs: 498-522.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to a sequence selected from the group consisting of SEQ ID NOs: 498-522.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 88%, at least 89%, at least 90%, at least 91%, at least 92%, at least 93%, at least 94%, at least 95%, at least 96%, at least 97%, at least 98%, at least 99%, or 100% sequence identity to nucleotides 103-723 of SEQ ID NO: 511.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 511.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 88% to 100%, 90% to 100%, 88% to 95%, 88% to 90%, 90% to 95%, or 95% to 100% sequence identity to nucleotides 103-723 of SEQ ID NO: 511.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 511.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to nucleotides 103-723 of a sequence selected from the group consisting of SEQ ID NOs: 513, 520, and 521.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 513, 520, and 521.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 89% to 100%, 90% to 100%, 89% to 95%, 90% to 95%, or 95% to 100% sequence identity to nucleotides 103-723 of a sequence selected from the group consisting of SEQ ID NOs: 513, 520, and 521.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 87% to 100%, 90% to 100%, 87% to 95%, 87% to 90%, 90% to 95%, or 95% to 100% sequence identity to a sequence selected from the group consisting of SEQ ID NOs: 513, 520, and 521.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 90%, at least 91%, at least 92%, at least 93%, at least 94%, at least 95%, at least 96%, at least 97%, at least 98%, at least 99%, or 100% sequence identity to nucleotides 103-723 of a sequence selected from the group consisting of SEQ ID NOs: 506-508, 510, 512, 514, 515, 517, 518, and 522.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 506-508, 510, 512, 514, 515, 517, 518, and 522.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 90% to 100%, 90% to 95%, or 95% to 100% sequence identity to nucleotides 103-723 of a sequence selected from the group consisting of SEQ ID NO: 501, 502, 514, 516, 518, and 515.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 88% to 100%, 90% to 100%, 88% to 95%, 88% to 90%, 90% to 95%, or 95% to 100% sequence identity to a sequence selected from the group consisting of SEQ ID NOs: 506-508, 510, 512, 514, 515, 517, 518, and 522.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 91%, at least 92%, at least 93%, at least 94%, at least 95%, at least 96%, at least 97%, at least 98%, at least 99%, or 100% sequence identity to amino acids 30 to 251 of SEQ ID NO: 516 or 519.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 89%, at least 90%, at least 91%, at least 92%, at least 93%, at least 94%, at least 95%, at least 96%, at least 97%, at least 98%, at least 99%, or 100% sequence identity to SEQ ID NO: 516 or 519.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 91% to 100%, 95% to 100%, or 91% to 95% sequence identity to nucleotides 103-723 30 to 251 of SEQ ID NO: 516 or 519.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 89% to 100%, 95% to 100%, or 89% to 95% sequence identity to SEQ ID NO: 516 or 519.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 92%, at least 93%, at least 94%, at least 95%, at least 96%, at least 97%, at least 98%, at least 99%, or 100% sequence identity to nucleotides 103-723 of a sequence selected from the group consisting of SEQ ID NOs: 504, 505, and 509.

In some embodiments, the CD80 polynucleotide (e.g., a RNA, e.g., a mRNA) comprises a nucleotide sequence (e.g., an ORF) encoding a CD80 polypeptide, wherein the nucleotide sequence has at least 80%, at least 85%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 504, 505, and 509.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 92% to 100%, 92% to 95%, or 95% to 100% sequence identity to nucleotides 103-723 of a sequence selected from the group consisting of SEQ ID NOs: 504, 505, and 509.

In some embodiments, the CD80 polynucleotide (e.g., a RNA, e.g., a mRNA) comprises a nucleotide sequence (e.g., an ORF) encoding a CD80 polypeptide, wherein the nucleotide sequence has 80% to 100%, 85% to 100%, 90% to 100%, 90% to 95%, or 95% to 100% sequence identity to a sequence selected from the group consisting of SEQ ID NOs: 504, 505, and 509.

In some embodiments, the CD80 polynucleotide (e.g., a RNA, e.g., a mRNA) comprises a nucleotide sequence (e.g., an ORF) encoding an Fc region polypeptide, e.g., a CD80Fc fusion polypeptide comprising the EC domain of CD80 or a functional portion thereof, wherein the Fc polypeptide comprises an amino acid sequence at least 70%, at least 75%, at least 80%, at least 85%, at least 90%, at least 95%, at least 96%, at least 97%, at least 98%, at least 99%, or 100% identical to amino acids 242 to 468 of SEQ ID NO: 473.

In some embodiments, the CD80 polynucleotide (e.g., a RNA, e.g., a mRNA) comprises a nucleotide sequence (e.g., an ORF) encoding an Fc polypeptide, e.g., a CD80Fc fusion polypeptide comprising the EC domain of CD80 or a functional portion thereof, wherein the CD80Fc fusion polypeptide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 473.

In some embodiments, the CD80 polynucleotide (e.g., a RNA, e.g., a mRNA) comprises a nucleotide sequence (e.g., an ORF) encoding an Fc polypeptide, wherein the polynucleotide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to nucleotides 724 to 1404 of SEQ ID NO: 474.

In some embodiments, the CD80 polynucleotide (e.g., a RNA, e.g., a mRNA) comprises a nucleotide sequence (e.g., an ORF) encoding a CD80Fc fusion polypeptide, wherein the polynucleotide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 474.

In some embodiments, the CD80 polynucleotide (e.g., a RNA, e.g., a mRNA) comprises a nucleotide sequence (e.g., an ORF) encoding an Fc polypeptide, wherein the nucleotide sequence has 85% to 100%, 88% to 100%, 90% to 100%, 95% to 100%, 80% to 95%, 85% to 95%, 85% to 90%, 90% to 95%, or 95% to 100% sequence identity to nucleotides 724 to 1404 of SEQ ID NO: 522.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to SEQ ID NO: 522.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to nucleotides 724 to 1404 of SEQ ID NO: 507.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 507.

In some embodiments, the CD80 polynucleotide (e.g., a RNA, e.g., a mRNA) comprises a nucleotide sequence (e.g., an ORF) encoding an Fc polypeptide, wherein the nucleotide sequence has 89% to 100%, 90% to 100%, 89% to 95%, 89% to 90%, 90% to 95%, or 95% to 100% sequence identity to nucleotides 724 to 1404 of SEQ ID NO: 507.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 507.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 90%, at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 506, 508, 511, 516, and 518.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 506, 508, 511, 516, and 518.

In some embodiments, the CD80 polynucleotide (e.g., a RNA, e.g., a mRNA) comprises a nucleotide sequence (e.g., an ORF) encoding an Fc polypeptide, wherein the nucleotide sequence has 90% to 100%, 90% to 95%, or 95% to 100% sequence identity to nucleotides 724 to 1404 of a sequence selected from the group consisting of SEQ ID NOs: 506, 508, 511, 516, and 518.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to a sequence selected from the group consisting of SEQ ID NOs: 506, 508, 511, 516, and 518.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 91%, at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 503, 504, 509, 510, 513, and 519.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 503, 504, 509, 510, 513, and 519.

In some embodiments, the CD80 polynucleotide (e.g., a RNA, e.g., a mRNA) comprises a nucleotide sequence (e.g., an ORF) encoding an Fc polypeptide, wherein the nucleotide sequence has 91% to 100%, 91% to 95%, or 95% to 100% sequence identity to nucleotides 724 to 1404 of a sequence selected from the group consisting of SEQ ID NOs: 503, 504, 509, 510, 513, and 519.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to a sequence selected from the group consisting of SEQ ID NOs: 503, 504, 509, 510, 513, and 519.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 92%, at least 93%, at least 94%, at least 95%, at least 96%, at least 97%, at least 98%, at least 99%, or 100% sequence identity to nucleotides 724 to 1404 of a sequence selected from the group consisting of SEQ ID NOs: 498, 500, 505, 514, 515, 517, 520, and 521.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 498, 500, 505, 514, 515, 517, 520, and 521.

In some embodiments, the CD80 polynucleotide (e.g., a RNA, e.g., a mRNA) comprises a nucleotide sequence (e.g., an ORF) encoding an Fc polypeptide, wherein the nucleotide sequence has 92% to 100%, 92% to 95%, or 95% to 100% sequence identity to nucleotides 724 to 1404 of a sequence selected from the group consisting of SEQ ID NOs: 498, 500, 505, 514, 515, 517, 520, and 521.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to a sequence selected from the group consisting of SEQ ID NOs: 498, 500, 505, 514, 515, 517, 520, and 521.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 93%, at least 94%, at least 95%, at least 96%, at least 97%, at least 98%, at least 99%, or 100% sequence identity to nucleotides 724 to 1404 of SEQ ID NO: 499 or 502.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 499 or 502.

In some embodiments, the CD80 polynucleotide (e.g., a RNA, e.g., a mRNA) comprises a nucleotide sequence (e.g., an ORF) encoding an Fc polypeptide, wherein the nucleotide sequence has 93% to 100%, 93% to 95%, or 95% to 100% sequence identity to nucleotides 724 to 1404 of SEQ ID NO: 499 or 502.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 499 or 502.

In some embodiments, the CD80 polynucleotide (e.g., a RNA, e.g., a mRNA) comprises a nucleotide sequence (e.g., an ORF) encoding an Fc polypeptide, wherein the nucleotide sequence has at least 94%, at least 95%, at least 96%, at least 97%, at least 98%, at least 99%, or 100% sequence identity to nucleotides 724 to 1404 of a sequence selected from the group consisting of SEQ ID NOs: 501, 505, and 522.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 501, 505, and 522.

In some embodiments, the CD80 polynucleotide (e.g., a RNA, e.g., a mRNA) comprises a nucleotide sequence (e.g., an ORF) encoding an Fc polypeptide, wherein the nucleotide sequence has 94% to 100%, 94% to 95%, or 95% to 100% sequence identity to nucleotides 724 to 1404 of a sequence selected from the group consisting of SEQ ID NOs: 501, 505, and 522.

In some embodiments, the CD80 polynucleotide (e.g., a RNA, e.g., a mRNA) comprises a nucleotide sequence (e.g., an ORF) encoding a CD80Fc fusion polypeptide, wherein the nucleotide sequence has 80% to 100%, 85% to 100%, 86% to 100%, 90% to 100%, 86% to 95%, 86% to 90%, 90% to 95%, or 95% to 100% sequence identity to a sequence selected from the group consisting of SEQ ID NOs: 501, 505, and 522.

Modified Nucleotide Sequences Encoding CD80 Polypeptides:

In some embodiments, the CD80 polynucleotide (e.g., a RNA, e.g., a mRNA) comprises a chemically modified nucleobase, e.g., 5-methoxyuracil. In some embodiments, the mRNA is a uracil-modified sequence comprising an ORF encoding a CD80 polypeptide or an Fc polypeptide, as disclosed herein, wherein the mRNA comprises a chemically modified nucleobase, e.g., 5-methoxyuracil.

In certain embodiments, when the 5-methoxyuracil base is connected to a ribose sugar, as it is in polynucleotides, the resulting modified nucleoside or nucleotide is referred to as 5-methoxyuridine. In some embodiments, at least about 25%, at least about 30%, at least about 40%, at least about 50%, at least about 60%, at least about 70%, at least about 80%, at least 90%, at least 95%, at least 99%, or about 100% of the uracil in the CD80 polynucleotide is 5-methoxyuracil. In one embodiment, at least 95% of the uracil in the CD80 polynucleotide is 5-methoxyuracil. In another embodiment, 100% of the uracil in the CD80 polynucleotide is 5-methoxyuracil.

In some embodiments, where uracil in the CD80 polynucleotide is at least 95% 5-methoxyuracil, overall uracil content can be adjusted such that an mRNA provides suitable protein expression levels while inducing little to no immune response.

In some embodiments, the uracil content of the CD80 ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the theoretical minimum uracil content in the corresponding wild-type ORF (% Um). In other embodiments, the uracil content of the CD80 ORF is between about 117% and about 134% or between 118% and 132% of the % Um. In some embodiments, the uracil content of the ORF encoding a CD80 polypeptide or an Fc polypeptide is about 115%, about 120%, about 125%, about 130%, about 135%, about 140%, about 145%, or about 150% of the % UI. In this context, the term "uracil" can refer to 5-methoxyuracil and/or naturally occurring uracil.

In some embodiments, the uracil content in the ORF of the mRNA encoding a CD80 polypeptide or an Fc polypeptide disclosed herein is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 18% and about 21% of the total nucleobase content in the ORF. In one embodiment, the uracil content in the ORF of the mRNA encoding a CD80 polypeptide or an Fc polypeptide is less than about 21% of the total nucleobase content in the open reading frame. Also in this context, the term "uracil" can refer to 5-methoxyuracil and/or naturally occurring uracil.

In further embodiments, the ORF of the mRNA encoding a CD80 polypeptide or an Fc polypeptide having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF.

In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the CD80 polypeptide or the Fc polypeptide (% $G_{TMX}$; % $C_{TMX}$, or % $G/C_{TMX}$). In other embodiments, the G, the C, or the G/C content in the ORF is between about 70% and about 80%, between about 71% and about 79%, between about 71% and about 78%, between about 71% and about 77%, or between about 90% and about 95% of the % $G_{TMX}$, % $C_{TMX}$, or % $G/C_{TMX}$.

In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding a CD80 polypeptide or an Fc polypeptide of the disclosure comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the CD80 polypeptide or the Fc polypeptide. In some embodiments, the ORF of the mRNA encoding a CD80 polypeptide or an Fc polypeptide of the disclosure contains no uracil pairs and/or uracil triplets and/or uracil quadruplets.

In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the CD80 polypeptide or an Fc polypeptide. In a particular embodiment, the ORF of the mRNA encoding the CD80 polypeptide or an Fc polypeptide of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the CD80 polypeptide or the Fc polypeptide contains no non-phenylalanine uracil pairs and/or triplets.

In further embodiments, the ORF of the mRNA encoding a CD80 polypeptide or an Fc polypeptide of the disclosure comprises 5-methoxyuracil and has an adjusted uracil content containing less uracil-rich clusters than the corresponding wild-type nucleotide sequence encoding the CD80 polypeptide or an Fc polypeptide. In some embodiments, the ORF of the mRNA encoding the CD80 polypeptide or the Fc polypeptide contains uracil-rich clusters that are shorter in length than corresponding uracil-rich clusters in the corresponding wild-type nucleotide sequence encoding the CD80 polypeptide or the Fc polypeptide.

In further embodiments, alternative lower frequency codons are employed in the sequence optimization of CD80 polynucleotides of the present disclosure. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the CD80 polypeptide-encoding or Fc polypeptide-encoding ORF of the 5-methoxyuracil-comprising mRNA are substituted with alternative codons, each alternative codon having a codon frequency lower than the codon frequency of the substituted codon in the synonymous codon set.

The ORF of the mRNA encoding the CD80 polypeptide or the Fc polypeptide also has adjusted uracil content, as described above. In some embodiments, at least one codon in the ORF of the mRNA encoding the CD80 polypeptide or the Fc polypeptide is substituted with an alternative codon having a codon frequency lower than the codon frequency of the substituted codon in the synonymous codon set.

In some embodiments, the adjusted uracil content CD80 polypeptide-encoding ORF of the 5-methoxyuracil-comprising mRNA exhibits expression levels of CD80, when administered to a mammalian cell, that are higher than expression levels of CD80 from the corresponding wild-type mRNA. In other embodiments, the expression levels of CD80, when administered to a mammalian cell, are increased relative to a corresponding mRNA containing at least 95% 5-methoxyuracil and having a uracil content of about 160%, about 170%, about 180%, about 190%, or about 200% of the theoretical minimum.

In yet other embodiments, the expression levels of CD80, when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, the CD80 is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the CD80 polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, the adjusted uracil content CD80 polypeptide-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the CD80 mRNA of the present disclosure induces a detectably lower immune response (e.g., innate or acquired) relative to the immune response induced by a corresponding wild-type mRNA under the same conditions. In other embodiments, the CD80 mRNA of the present disclosure induces a detectably lower immune response (e.g., innate or acquired) relative to the immune response induced by an mRNA that encodes for a CD80 polypeptide, but does not comprise 5-methoxyuracil under the same conditions, or relative to the immune response induced by an mRNA that encodes for a CD80 polypeptide, and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of the mRNA of the disclosure into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes a CD80 polypeptide, but does not comprise 5-methoxyuracil, or to an mRNA that encodes a CD80 polypeptide, and that comprises 5-methoxyuracil but that does not have adjusted uracil content. In some embodiments, the interferon is IFN-β. In some embodiments, cell death frequency caused by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for a CD80 polypeptide, but does not comprise 5-methoxyuracil, or an mRNA that encodes for a CD80 polypeptide, and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the Cd80 polynucleotide is an mRNA that comprises an ORF that encodes a CD80 polypeptide or an Fc polypeptide, as disclosed herein, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the CD80 polypeptide or the Fc polypeptide is less than about 21% of the total nucleobase content in the ORF. In some embodiments, the ORF that encodes the CD80 polypeptide or the Fc polypeptide is further modified to increase G/C content of the ORF (absolute or relative) by at least about 40%, as compared to the corresponding wild-type ORF.

In yet other embodiments, the ORF encoding the CD80 polypeptide or the Fc polypeptide contains less than 20 non-phenylalanine uracil pairs and/or triplets. In some embodiments, at least one codon in the ORF of the mRNA encoding the CD80 polypeptide or the Fc polypeptide is further substituted with an alternative codon having a codon frequency lower than the codon frequency of the substituted codon in the synonymous codon set. In some embodiments, the expression of the CD80 polypeptide or the Fc polypeptide encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the CD80 polypeptide or the Fc polypeptide from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

Polynucleotide Comprising an mRNA Encoding a CD80 Polypeptide:

In certain embodiments, a CD80 polynucleotide of the present disclosure, for example a polynucleotide comprising an mRNA nucleotide sequence encoding a CD80 polypeptide, e.g., a CD80 polypeptide comprising the EC domain of CD80 or a functional portion thereof, comprises from 5' to 3' end:

(i) a 5' UTR, such as the sequences provided below, comprising a 5' cap provided below;
(ii) an open reading frame encoding a CD80 polypeptide (e.g., a sequence optimized nucleic acid sequence encoding CD80 disclosed herein);
(iii) at least one stop codon;
(iv) a 3' UTR, such as the sequences provided below; and
(v) a poly-A tail provided below.

In certain embodiments, a CD80 polynucleotide of the present disclosure, for example a polynucleotide comprising an mRNA nucleotide sequence encoding an Fc region polypeptide or a functional portion thereof, comprises from 5' to 3' end:

(i) a 5' UTR, such as the sequences provided below, comprising a 5' cap provided below;
(ii) an open reading frame encoding an Fc region polypeptide or a functional portion thereof;
(iii) at least one stop codon;
(iv) a 3' UTR, such as the sequences provided below; and
(v) a poly-A tail provided below.

In certain embodiments, a CD80 polynucleotide of the present disclosure, for example a polynucleotide comprising an mRNA nucleotide sequence encoding a CD80 polypeptide, e.g., a CD80 polypeptide comprising the EC domain of CD80 or a functional portion thereof, comprises from 5' to 3' end:

(i) a 5' UTR, such as the sequences provided below, comprising a 5' cap provided below;
(ii) an open reading frame encoding a CD80 polypeptide (e.g., a sequence optimized nucleic acid sequence encoding CD80 disclosed herein) fused to an Fc region polypeptide or a functional portion thereof;
(iii) at least one stop codon;
(iv) a 3' UTR, such as the sequences provided below; and
(v) a poly-A tail provided below.

In some embodiments, the CD80 polynucleotide further comprises a miRNA binding site, e.g., a miRNA binding site that binds to miRNA-122. In some embodiments, the 3'UTR comprises the miRNA binding site.

In some embodiments, a CD80 polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of CD80 or a functional fragment thereof, e.g., the EC domain of CD80.

CD80 Compositions and Formulations for Use:

Certain aspects of the present disclosure are directed to compositions or formulations comprising any of the CD80 polynucleotides disclosed above. In some embodiments, the composition or formulation comprises:

(i) a CD80 polynucleotide (e.g., a RNA, e.g., a mRNA) comprising a sequence-optimized nucleotide sequence (e.g., an ORF) encoding a CD80 polypeptide or an Fc polypeptide (e.g., the wild-type sequence, functional fragment, or variant thereof), wherein the CD80 polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the CD80 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the CD80 polypeptide or the Fc polypeptide (% $U_{TM}$ or % $T_{TM}$), is between about 100% and about 150%.

In some embodiments, the CD80 polynucleotides, compositions or formulations above are used to treat a cancer.

C. Toll Like Receptor 4 (TLR4)

In some embodiments, the combination therapies disclosed herein comprise one or more TLR4 polynucleotides (e.g., mRNAs), i.e., polynucleotides comprising one or more ORFs encoding a TLR4 polypeptide (e.g., caTLR4, i.e., a constitutively active TLR4 polypeptide).

Toll-like Receptors (TLRs) are a family of receptors that recognize ligands having pathogen-associated or endogenous damage-associated molecular patterns. See, e.g., Mehmeti, M., et al., *Breast Cancer Res.* 17: 130 (2015), doi: 10.1186/s13058-015-0640-x; Oblak, A. and Jerala, R., *Clin. Dev. Immunol.* 2011, doi: 10.1155/2011/609579; and Vaure, C. and Liu, Y., *Front. Immunol.* 5: 1-15 (2014). TLRs are evolutionarily conserved and have an extracellular leucine-rich repeat domain associated with recognition of ligand, a transmembrane domain, and an intracellular toll/interleukin-1 receptor-like domain associated with signal transduction. See Vaure, C. and Liu, Y.

TLR4 was the first TLR discovered in humans and has been shown to recognize bacterial lipopolysaccharide (LPS) and other bacterial and viral ligands associated with microbial infections as well as endogenous ligands associated with tissue damage. See Vaure, C. and Liu, Y. TLR4 expressing cells are predominantly of myeloid origin, with TLR4 forming a complex on the cell surface with other proteins required for ligand recognition. Id. Binding of ligands induces TLR4 homodimerization through TIR domain interactions and activates intracellular signaling. Id. TLR4 activation by LPS, for example, leads to synthesis of pro-inflammatory cytokines and chemokines as well as dendritic cell maturation and antigen presentation. See Oblak, A. and Jerala, R. TLR4 also stimulates antibody class switching, affinity maturation, and formation of memory cells associated with development of an adaptive immune response. Id.

The innate and adaptive immune responses associated with TLR4 are not only required for natural defenses against microbial infections but are also implicated in control of malignant neoplasms. See Oblak, A. and Jerala, R., and Fang et al., *Cell Mol. Immunol.* 11: 150-159 (2014). For example, dendritic cells stimulated by TLR4 can in turn stimulate T-cell responses such as activation of $CD8^+$ cytotoxic T lymphocytes and $CD4^+$ Th1 immunity, which are essential to anti-tumor immune responses. See Fang et al. However, pro-inflammatory responses associated with TLR4 activation have also been associated with cancer development and progression. See Oblak, A. and Jerala, R., and Mehmeti, M., et al. Thus, therapeutic interventions based on TLR4 activation has been challenging, and there is a need in the art for improved TRL4 therapies and therapeutics to treat cancer.

Toll like receptor 4 (TLR4), also known as CD284, plays a role in pathogen recognition and activation of the innate immune system. Ligands for TLR4 include various proteins and polysaccharides expressed by bacteria (e.g., lipopolysaccharide (LPS), a component of many Gram-negative and some Gram-positive bacteria) and viruses, as well as a variety of endogenous proteins such as low-density lipoprotein, beta-defensins, and heat shock protein. Ligand binding induces TLR4 homodimerization through TIR domain interactions and activates intracellular signaling. TLR4 also stimulates antibody class switching, affinity maturation, and formation of memory cells associated with development of an adaptive immune response.

The structure of the 95 kDa TLR4 comprises an extracellular domain (608 residues), a single transmembrane domain, and an intracellular domain (187 residues). There are at least three transcript variants for TLR4, transcript variants 1, 3, and 4. The coding sequence (CDS) for wild type TLR4 canonical mRNA sequence, variant 1, is described at the NCBI Reference Sequence database (RefSeq) under accession number NM_138554.4 ("*Homo sapiens* toll like receptor 4 (TLR4), transcript variant 1, mRNA"). The wild type TLR4 canonical protein sequence, isoform A, is described at the RefSeq database under accession number NP_612564.1 ("toll-like receptor 4 isoform A precursor [*Homo sapiens*]"). The TLR4 transcript variant 3 (NM_003266.3) comprises an additional internal exon, as compared to isoform 1, which results in translation initiation from a downstream AUG and a polypeptide (isoform C) that lacks the 40 N-terminal amino acids of isoform A. The TLR4 transcript variant 4 (NM_138557.2) lacks an internal exon present in variant 1. Like variant 3, initiation of translation of variant 4 occurs at a downstream AUG, as compared to variant 1, resulting in a polypeptide (isoform D) that lacks the 200 N-terminal amino acids of isoform A. It is noted that the specific nucleic acid sequences encoding the reference protein sequence in the Ref Seq sequences are the coding sequence (CDS) as indicated in the respective RefSeq database entry.

In certain embodiments, the combination therapies disclosed herein provide a TLR4 polypeptide or a fusion protein thereof. In some embodiments, the TLR4 polypeptide is a constitutively active (ca) TLR4 variant. In some embodiments, the caTLR4 polypeptide is a variant, a peptide or a polypeptide containing a substitution, and insertion and/or an addition, a deletion and/or a covalent modification with respect to the corresponding wild-type TLR4 sequence.

As used herein, the term "caTLR4" refers to any variant of TLR4 which is constitutively active, including any such variants known in the art, e.g., the TLR4 D229G and T399I SNPs (see Hold et al., *PLoS ONE* 9(11): e111460 (2014)) and the variants disclosed by, e.g., Panter and Jerala, *J. Biol. Chem.* 286(26):23334-44 (2011); Pen et al., *J. Immunol.* 191(4):1976-83 (2013); Li et al, *Oncogene* 33:369-77 (2014); and Pato et al., *Clin. Exp. Immunol.* 182(2):220-29 (2015). In some embodiments, the caTLR4 is a truncated variant of wild type TLR4 that comprises the cytoplasmic (intracellular) (CP) domain, the transmembrane (TM) domain, and a portion of the extracellular (EC) domain of wild-type TLR4, wherein the caTLR4 does not comprise the full EC domain of wild type TLR4.

In some embodiments, the caTLR4 polypeptide comprises the CP domain and the TM domain, but does not comprise one or more leucine-rich repeat (LRR) domain, which include LRR1, LRR2, LRR3, LRR4, LRR5, LRR6, LRR7, LRR8, LRR9, LRR10, LRR11, LRR12, LRR13, LRR14, LRR15, LRR16, LRR17, or LRR18. In one embodiment, the caTLR4 contains the CP domain and the TM domain, but does not comprise any LRR domains. In certain embodiments, the caTLR4 polypeptide comprises amino acids 618-839 of wild type TLR4 isoform 1 (SEQ ID NO: 523). In one particular embodiment, the caTLR4 polypeptide comprises the amino acid sequence of SEQ ID NO: 525. See TABLE 6. In certain embodiments, the caTLR4 comprises or consists or consists essentially of the CP domain, the TM domain, and an EC fragment.

TABLE 6

| SEQ ID NO | Description | Sequence | Comments |
|---|---|---|---|
| 523 | TLR4, Toll-like receptor 4, isoform 1 (wtTLR4). Isoform 2 of wt TLR4 is missing amino acids 1-40 of SEQ ID NO: 1, and Isoform 3 of wt TLR4 is missing amino acids 1-200 of SEQ ID NO: 1. Signal peptide is underlined (positions 1-23) | MMSASRLAGTLIPAMAFLSCVRPESWEPCVEVVP<br>NITYQCMELNFYKIPDNLPFSTKNLDLSFNPLRH<br>LGSYSFFSFPELQVLDLSRCEIQTIEDGAYQSLS<br>HLSTLILTGNPIQSLALGAFSGLSSLQKLVAVET<br>NLASLENFPIGHLKTLKELNVAHNLIQSFKLPEY<br>FSNLTNLEHLDLSSNKIQSIYCTDLRVLHQMPLL<br>NLSLDLSLNPMNFIQPGAFKEIRLHKLTLRNNFD<br>SLNVMKTCIQGLAGLEVHRLVLGEFRNEGNLEKF<br>DKSALEGLCNLTIEEFRLAYLDYYLDDIIDLFNC<br>LTNVSSFSLVSVTIERVKDFSYNFGWQHLELVNC<br>KFGQFPTLKLKSLKRLTFTSNKGGNAFSEVDLPS<br>LEFLDLSRNGLSFKGCCSQSDFGTTSLKYLDLSF<br>NGVITMSSNFLGLEQLEHLDFQHSNLKQMSEFSV<br>FLSLRNLIYLDISHTHTRVAFNGIFNGLSSLEVL<br>KMAGNSFQENFLPDIFTELRNLTFLDLSQCQLEQ<br>LSPTAFNSLSSLQVLNMSHNNFFSLDTFPYKCLN<br>SLQVLDYSLNHIMTSKKQELQHFPSSLAFLNLTQ<br>NDFACTCEHQSFLQWIKDQRQLLVEVERMECATP<br>SDKQGMPVLSLNITCQMNKTIIGVSVLSVLVVSV<br>VAVLVYKFYFHLMLLAGCIKYGRGENIYDAFVIY<br>SSQDEDWVRNELVKNLEEGVPPFQLCLHYRDFIP<br>GVAIAANIIHEGFHKSRKVIVVVSQHFIQSRWCI<br>FEYEIAQTWQFLSSRAGIIFIVLQKVEKTLLRQQ<br>VELYRLLSRNTYLEWEDSVLGRHIFWRRLRKALL<br>DGKSWNPEGTVGTGCNWQEATSI | See Toll-like receptor 4, Uniprot Acc. No. 000206. This is the isoform 1 sequence. This isoform has been chosen as the 'canonical' sequence. All positional information in this entry refers to it. |
| 524 | Nucleotide sequence of wt TLR4, isoform 1. Underlined nucleobases indicate region encoding the signal peptide (1-69). | ATGATGTCTGCCTCGCGCCTGGCTGGGACTCTGA<br>TCCCAGCCATGGCCTTCCTCTCCTGCGTGAGACC<br>AGAAAGCTGGGAGCCCTGCGTGGAGGTGGTTCCT<br>AATATTACTTATCAATGCATGGAGCTGAATTTCT<br>ACAAAATCCCCGACAACCTCCCCTTCTCAACCAA<br>GAACCTGGACCTGAGCTTTAATCCCCTGAGGCAT<br>TTAGGCAGCTATAGCTTCTTCAGTTTCCCAGAAC<br>TGCAGGTGCTGGATTTATCCAGGTGTGAAATCCA<br>GACAATTGAAGATGGGGCATATCAGAGCCTAAGC<br>CACCTCTCTACCTTAATATTGACAGGAAACCCCA<br>TCCAGAGTTTAGCCCTGGGAGCCTTTTCTGGACT<br>ATCAAGTTTACAGAAGCTGGTGGCTGTGGAGACA<br>AATCTAGCATCTCTAGAGAACTTCCCCATTGGAC<br>ATCTCAAAACTTTGAAAGAACTTAATGTGGCTCA<br>CAATCTTATCCAATCTTTCAAATTACCTGAGTAT<br>TTTTCTAATCTGACCAATCTAGAGCACTTGGACC<br>TTTCCAGCAACAAGATTCAAAGTATTTATTGCAC<br>AGACTTGCGGGTTCTACATCAAATGCCCCTACTC<br>AATCTCTCTTTAGACCTGTCCCTGAACCCTATGA<br>ACTTTATCCAACCAGGTGCATTTAAAGAAATTAG<br>GCTTCATAAGCTGACTTTAAGAAATAATTTTGAT<br>AGTTTAAATGTAATGAAAACTTGTATTCAAGGTC<br>TGGCTGGTTTAGAAGTCCATCGTTTGGTTCTGGG<br>AGAATTTAGAAATGAAGGAAACTTGGAAAAGTTT<br>GACAAATCTGCTCTAGAGGGCCTGTGCAATTTGA<br>CCATTGAAGAATTCCGATTAGCATACTTAGACTA<br>CTACCTCGATGATATTATTGACTTATTTAATTGT<br>TTGACAAATGTTTCTTCATTTTCCCTGGTGAGTG<br>TGACTATTGAAAGGGTAAAAGACTTTTCTTATAA<br>TTTCGGATGGCAACATTTAGAATTAGTTAACTGT<br>AAATTTGGACAGTTTCCCACATTGAAACTCAAAT<br>CTCTCAAAAGGCTTACTTTCACTTCCAACAAAGG<br>TGGGAATGCTTTTTCAGAAGTTGATCTACCAAGC<br>CTTGAGTTTCTAGATCTCAGTAGAAATGGCTTGA<br>GTTTCAAAGGTTGCTGTTCTCAAAGTGATTTTGG<br>GACAACCAGCCTAAAGTATTTAGATCTGAGCTTC<br>AATGGTGTTATTACCATGAGTTCAAACTTCTTGG<br>GCTTAGAACAACTAGAACATCTGGATTTCCAGCA<br>TTCCAATTTGAAACAAATGAGTGAGTTTTCAGTA<br>TTCCTATCACTCAGAAACCTCATTTACCTTGACA<br>TTTCTCATACICACACCAGAGTIGCTITCAATGG<br>CATCTTCAATGGCTTGTCCAGTCTCGAAGTCTTG<br>AAAATGGCTGGCAATTCTTTCCAGGAAAACTTCC | |

TABLE 6-continued

| SEQ ID NO | Description | Sequence | Comments |
|---|---|---|---|
| | | TTCCAGATATCTTCACAGAGCTGAGAAACTTGAC<br>CTTCCTGGACCTCTCTCAGTGTCAACTGGAGCAG<br>TTGTCTCCAACAGCATTTAACTCACTCTCCAGTC<br>TTCAGGTACTAAATATGAGCCACAACAACTTCTT<br>TTCATTGGATACGTTTCCTTATAAGTGTCTGAAC<br>TCCCTCCAGGTTCTTGATTACAGTCTCAATCACA<br>TAATGACTTCCAAAAAACAGGAACTACAGCATTT<br>TCCAAGTAGTCTAGCTTTCTTAAATCTTACTCAG<br>AATGACTTTGCTTGTACTTGTGAACACCAGAGTT<br>TCCTGCAATGGATCAAGGACCAGAGGCAGCTCTT<br>GGTGGAAGTTGAACGAATGGAATGTGCAACACCT<br>TCAGATAAGCAGGGCATGCCTGTGCTGAGTTTGA<br>ATATCACCTGTCAGATGAATAAGACCATCATTGG<br>TGTGTCGGTCCTCAGTGTGCTTGTAGTATCTGTT<br>GTAGCAGTTCTGGTCTATAAGTTCTATTTTCACC<br>TGATGCTTCTTGCTGGCTGCATAAAGTATGGTAG<br>AGGTGAAAACATCTATGATGCCTTTGTTATCTAC<br>TCAAGCCAGGATGAGGACTGGGTAAGGAATGAGC<br>TAGTAAAGAATTTAGAAGAAGGGGTGCCTCCATT<br>TCAGCTCTGCCTTCACTACAGAGACTTTATTCCC<br>GGTGTGGCCATTGCTGCCAACATCATCCATGAAG<br>GTTTCCATAAAAGCCGAAAGGTGATTGTTGTGGT<br>GTCCCAGCACTTCATCCAGAGCCGCTGGTGTATC<br>TTTGAATATGAGATTGCTCAGACCTGGCAGTTTC<br>TGAGCAGTCGTGCTGGTATCATCTTCATTGTCCT<br>GCAGAAGGTGGAGAAGACCCTGCTCAGGCAGCAG<br>GTGGAGCTGTACCGCCTTCTCAGCAGGAACACTT<br>ACCTGGAGTGGGAGGACAGTGTCCTGGGGCGGCA<br>CATCTTCTGGAGACGACTCAGAAAAGCCCTGCTG<br>GATGGTAAATCATGGAATCCAGAAGGAACAGTGG<br>GTACAGGATGCAATTGGCAGGAAGCAACATCTAT<br>CTGA | |
| 525 | Constitutively active TLR4 (caTLR4) construct, protein sequence. The signal peptide (lysosome-associated membrane glycoprotein 1 (LAMP1) signal peptide) is italicized; the extracellular domain is underlined; the transmembrane domain is bolded; and the cytoplasmic domain has dotted underline. | *MAAPGSARRPLLLLLLLLLLGLMHCASAA*MPVLS<br>LNITCQMNK**TIIGVSVLSVLVVSVVAVLVY**KFYF<br>HLMLLAGCIKYGRGENIYDAFVIYSSQDEDWVRN<br>ELVKNLEEGVPPFQLCLHYRDFIPGVAIAANIIH<br>EGFHKSRKVIVVVSQHFIQSRWCIFEYEIAQTWQ<br>FLSSRAGIIFIVLQKVEKTLLRQQVELYRLLSRN<br>TYLEWEDSVLGRHIFWRRLRKALLDGKSWNPEGT<br>VGTGCNWQEATSI | |
| 526 | Constitutively active TLR4 (caTLR4) construct, nucleic acid sequence. The same notation using in the protein sequence is used to denote the different component of the caTRL4 construct. | *ATGGCGGCCCCCGGCAGCGCCCGGCGACCCCTGC*<br>*TGCTGCTACTGCTGTTGCTGCTGCTCGGCCTCAT*<br>*GCATTGTGCGTCAGCAGCA*ATGCCTGTGCTGAGT<br>TTGAATATCACCTGTCAGATGAATAAG**ACCATCA**<br>**TTGGTGTGTCGGTCCTCAGTGTGCTTGTAGTATC**<br>**TGTTGTAGCAGTTCTGGTCTAT**AAGTTCTATTTT<br>CACCTGATGCTTCTTGCTGGCTGCATAAAGTATG<br>GTAGAGGTGAAAACATCTATGATGCCTTTGTTAT<br>CTACTCAAGCCAGGATGAGGACTGGGTAAGGAAT<br>GAGCTAGTAAAGAATTTAGAAGAAGGGGTGCCTC<br>CATTTCAGCTCTGCCTTCACTACAGAGACTTTAT<br>TCCCGGTGTGGCCATTGCTGCCAACATCATCCAT<br>GAAGGTTTCCATAAAAGCCGAAAGGTGATTGTTG | |

TABLE 6-continued

| SEQ ID NO | Description | Sequence | Comments |
|---|---|---|---|
| | | TGGTGTCCCAGCACTTCATCCAGAGCCGCTGGTG<br>TATCTTTGAATATGAGATTGCTCAGACCTGGCAG<br>TTTCTGAGCAGTCGTGCTGGTATCATCTTCATTG<br>TCCTGCAGAAGGTGGAGAAGACCCTGCTCAGGCA<br>GCAGGTGGAGCTGTACCGCCTTCTCAGCAGGAAC<br>ACTTACCTGGAGTGGGAGGACAGTGTCCTGGGGC<br>GGCACATCTTCTGGAGACGACTCAGAAAAGCCCT<br>GCTGGATGGTAAATCATGGAATCCAGAAGGAACA<br>GTGGGTACAGGATGCAATTGGCAGGAAGCAACAT<br>CTATC | |

In some embodiments, the caTLR4 polypeptide comprises one or more amino acids of the extracellular (EC) domain of a full-length TLR4 polypeptide. In certain embodiments, the one or more amino acids of the EC domain comprises, consists of, or consists essentially of M, MP, MPV, MPV, MPVL (SEQ ID NO: 527), MPVLS (SEQ ID NO: 528), MPVLSL (SEQ ID NO: 529), MPVLSLN (SEQ ID NO: 530), MPVLSLN (SEQ ID NO: 531), MPVLSLNI (SEQ ID NO: 532), MPVLSLNIT (SEQ ID NO: 533), MPVLSLNITC (SEQ ID NO: 534), MPVLSLNITCQ (SEQ ID NO: 535), MPVLSLNITCQM (SEQ ID NO: 536), MPVLSLNITCQMN (SEQ ID NO: 537), or MPVLSLNITCQMNK (SEQ ID NO: 538).

In another embodiment, the caTLR4 polypeptide comprises an EC fragment consisting or consisting essentially of one, two, three, four, five, six, seven, eight, nine, ten, 11, 12, 13, 14, 15, 16, 17, 18, 19, 20, 21, 22, 23, 24, 25, 26, 27, 28, 29, or 30 amino acids of an EC domain of a full-length TLR4 polypeptide. In certain embodiments, the EC fragment is not an LRR region.

In some embodiments, sequence tags or amino acids, can be added to the TLR4 sequences encoded by the TLR4 polynucleotides disclosed herein (e.g., at the N-terminal or C-terminal ends), e.g., for localization. In some embodiments, amino acid residues located at the carboxy, amino terminal, or internal regions of a TLR4 polypeptide disclosed herein can optionally be deleted providing for fragments.

In some embodiments, the TLR4 polynucleotide (e.g., a RNA, e.g., a mRNA) comprises a nucleotide sequence (e.g., an ORF) encoding a substitutional variant of a TLR4 sequence, which can comprise one, two, three or more than three substitutions. In some embodiments, the TLR4 substitutional variant can comprise one or more conservative amino acids substitutions. In other embodiments, the TLR4 variant is an insertional variant. In other embodiments, the TLR4 variant is a deletional variant.

Certain compositions and methods presented in this disclosure refer to the protein or polynucleotide sequences of caTLR4. A person skilled in the art will understand that such disclosures are equally applicable to any other isoforms of caTLR4 known in the art.

In some embodiments, the caTRL4 polypeptide comprises an amino acid sequence at least about 80%, at least about 85%, at least about 90%, at least about 95%, at least about 95%, about 96%, at least about 97%, at least about 98%, at least about 99%, or about 100% identical to amino acids 30 to 251 of SEQ ID NO: 525.

In other embodiments, the caTLR4 polypeptide comprises a CP domain of a full-length TLR4 polypeptide, a TM domain of a full-length TLR4 polypeptide, and an EC domain of a full-length TLR4 polypeptide, wherein the CP domain has an amino acid sequence having at least about 80%, at least about 85%, at least about 90%, at least about 95%, at least about 95%, about 96%, at least about 97%, at least about 98%, at least about 99%, or about 100% identical to amino acids 653 to 839 of SEQ ID NO: 523, wherein the TM domain has an amino acid sequence having at least about 80%, at least about 85%, at least about 90%, at least about 95%, at least about 95%, about 96%, at least about 97%, at least about 98%, at least about 99%, or about 100% identical to amino acids 632 to 652 of SEQ ID NO: 523, and/or wherein the EC fragment has an amino acid sequence consisting of or consisting essentially of M, MP, MPV, MPV, MPVL (SEQ ID NO: 527), MPVLS (SEQ ID NO: 528), MPVLSL (SEQ ID NO: 529), MPVLSLN (SEQ ID NO:530), MPVLSLN (SEQ ID NO: 531), MPVLSLNI (SEQ ID NO: 532), MPVLSLNIT (SEQ ID NO:533), MPVLSLNITC (SEQ ID NO:534), MPVLSLNITCQ (SEQ ID NO:535), MPVLSLNITCQM (SEQ ID NO: 536), MPVLSLNITCQMN (SEQ ID NO:537), or MPVLSLNITCQMNK (SEQ ID NO:538).

In certain embodiments, the caTLR4 polypeptide can be fused to a signal peptide. In one embodiment, a signal peptide is a naturally occurring TLR4 signal peptide. In other embodiments, the signal peptide comprises a heterologous peptide, e.g., a peptide derived from a protein other than TLR4. In one embodiment, a signal peptide is a signal peptide of a lysosome-associated membrane glycoprotein 1 (LAMP-1) protein. In another embodiment, a signal peptide is an IgK signal peptide, e.g., a human IgK signal peptide or a murine IgK signal peptide. In other embodiments, the signal peptide comprises an amino acid sequence having at least about 80%, at least about 85%, at least about 90%, at least about 95%, at least about 95%, about 96%, at least about 97%, at least about 98%, at least about 99%, or about 100% identical to amino acids 1 to 29 of SEQ ID NO: 525.

In other embodiments, the caTLR4 polypeptide can be a fusion protein, which is fused to one or more heterologous polypeptide.

In some embodiments, a combination therapy disclosed herein includes any TLR4 polypeptide, e.g., a caTLR4 polypeptide, encoded by the sequence-optimized TLR4 polynucleotides disclosed herein or a nucleotide sequence comprising the sequence-optimized polynucleotides disclosed herein.

TLR4 Polynucleotides and Open Reading Frames (ORFs):

The combination therapies disclosed herein can include any TLR4 polynucleotides (e.g., DNA or RNA, e.g., mRNA) disclosed herein. In certain embodiments, the present disclosure provides TLR4 polynucleotides (e.g., a RNA, e.g., a mRNA) that comprise a nucleotide sequence (e.g., an ORF) encoding one or more TLR4 polypeptides, e.g., caTLR4 polynucleotides. In some embodiments, a TRL4 polynucleotide included in a combination therapy disclosed herein can encode a TLR4 polypeptide selected from:

(i) a caTLR4 polypeptide comprising a CP domain, a TM domain, and an EC domain without one or more LRR region;
(ii) a caTRL4 polypeptide comprising a CP domain, a TM domain, and an EC fragment comprising, consisting essentially of, or consisting of M, MP, MPV, MPV, MPVL (SEQ ID NO: 527), MPVLS (SEQ ID NO:528), MPVLSL (SEQ ID NO:529), MPVLSLN (SEQ ID NO:530), MPVLSLN (SEQ ID NO:531), MPVLSLNI (SEQ ID NO:532), MPVLSLNIT (SEQ ID NO:533), MPVLSLNITC (SEQ ID NO:534), MPVLSLNITCQ (SEQ ID NO:535), MPVLSLNITCQM (SEQ ID NO:536), MPVLSLNITCQMN (SEQ ID NO:537), or MPVLSLNITCQMNK (SEQ ID NO:538); and
(iii) a fusion protein comprising (i) a caTLR4 polypeptide, a functional fragment or a variant thereof, and (ii) a heterologous protein.

In some embodiments, a TLR4 polynucleotides included in a combination therapy disclosed herein can also encode:

(i) a full-length or mature TLR4 polypeptide (e.g., having the same or essentially the same length as wild-type TLR4 isoform 1, 2, or 3);
(ii) a functional fragment of any of the TLR4 isoforms described herein (e.g., a truncated (e.g., deletion of carboxy, amino terminal, or internal regions) sequence shorter than one of wild-type isoforms 1, 2, or 3; but still retaining TLR4 activity);
(iii) a variant thereof (e.g., full-length, mature, or truncated TLR4 isoform 1, 2, or 3 proteins in which one or more amino acids have been replaced, e.g., variants that retain all or most of the TLR4 activity of the polypeptide with respect to a reference isoform); or
(iv) a fusion protein comprising (i) the full-length or mature TLR4 polypeptide, a functional fragment, or a variant thereof, and (ii) a heterologous protein.

In certain embodiments, the encoded TLR4 polypeptide, e.g., caTLR4, is a mammalian TLR4 polypeptide, such as a human TLR4 polypeptide, a functional fragment or a variant thereof.

In some embodiments, the TLR4 polynucleotide (e.g., a RNA, e.g., a mRNA) increases TLR4, e.g., caTLR4, protein expression levels and/or detectable TLR4, e.g., caTLR4, activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to TLR4, e.g., caTLR4, protein expression levels and/or detectable TLR4, e.g., caTLR4, activity levels in the cells prior to the administration of the TLR4 polynucleotide.

The TLR4, e.g., caTLR4, protein expression levels and/or TLR4, e.g., caTLR4, activity can be measured according to methods know in the art. In some embodiments, the TLR4 polynucleotide (e.g., a RNA, e.g., a mRNA) is introduced to the cells in vitro. In some embodiments, the TLR4 polynucleotide (e.g., a RNA, e.g., a mRNA) is introduced to the cells in vivo.

In some embodiments, the TLR4 polynucleotide (e.g., a RNA, e.g., a mRNA) comprises a codon optimized nucleic acid sequence, wherein the open reading frame (ORF) of the codon optimized nucleic sequence is derived from a wild-type TLR4 sequence. For example, for TLR4 polynucleotides disclosed herein comprising a sequence optimized ORF encoding TLR4, the corresponding wild type sequence is the native TLR4.

In some embodiments, the TLR4 polynucleotide (e.g., a RNA, e.g., a mRNA) comprises a nucleotide sequence (e.g., an ORF) that encodes a TLR4, e.g., caTLR4, polypeptide with mutations that do not alter TLR4, e.g., caTLR4, activity. Such mutant TLR4, e.g., caTLR4, polypeptides can be referred to as function-neutral. In some embodiments, the TLR4 polynucleotide comprises an ORF that encodes a mutant TLR4, e.g., caTLR4, polypeptide comprising one or more function-neutral point mutations.

In some embodiments, the mutant TLR4 polypeptide has higher TLR4 activity than the corresponding wild-type TLR4. In some embodiments, the mutant TLR4 polypeptide has a TLR4 activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type TLR4.

In some embodiments, the TLR4 polynucleotide (e.g., a RNA, e.g., a mRNA) comprises a nucleotide sequence (e.g., an ORF) encoding a TLR4 fragment, e.g., caTLR4, that has higher TLR4 activity than the corresponding mature TLR4. Thus, in some embodiments the TLR4 fragment, e.g., caTLR4, has a TLR4 activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the TLR4 activity of the corresponding mature TLR4.

In some embodiments, the TLR4 polynucleotide (e.g., a RNA, e.g., a mRNA) comprises a nucleotide sequence (e.g., an ORF) encoding a TLR4 polypeptide, e.g., caTLR4, that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, or 25% shorter than the amino acid sequence as set forth in amino acids 30 to 251 of SEQ ID NO: 525.

In some embodiments, the TLR4 polynucleotide (e.g., a RNA, e.g., a mRNA) comprises a nucleotide sequence (e.g., an ORF) encoding a TLR4 polypeptide, e.g., caTLR4, wherein the TLR4 polypeptide comprises an amino acid sequence at least 70%, at least 75%, at least 80%, at least 85%, at least 90%, at least 95%, at least 96%, at least 97%, at least 98%, at least 99%, or 100% identical to amino acids 30 to 251 of SEQ ID NO: 525.

In some embodiments, the TLR4 polynucleotide (e.g., a RNA, e.g., a mRNA) comprises a nucleotide sequence (e.g., an ORF) encoding a TLR4 polypeptide, e.g., caTLR4, wherein the TLR4 polypeptide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 525.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 85% to 100%, 90% to 100%, 95% to 100%, 80% to 95%, 85% to 95%, 85% to 90%, 90% to 95%, or 95% to 100% sequence identity nucleotides 88-753 of SEQ ID NO: 541.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to SEQ ID NO: 541.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 88-753 of SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 86% to 100%, 90% to 100%, 86% to 95%, 86% to 90%, 90% to 95%, or 95% to 100% sequence identity to nucleotides 88-753 of SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 88-753 of a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 87% to 100%, 90% to 100%, 87% to 95%, 87% to 90%, 90% to 95%, or 95% to 100% sequence identity to nucleotides 88-753 of a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 87% to 100%, 90% to 100%, 87% to 95%, 87% to 90%, 90% to 95%, or 95% to 100% sequence identity to SEQ ID NOs: 552, 554, or 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 88%, at least 89%, at least 90%, at least 91%, at least 92%, at least 93%, at least 94%, at least 95%, at least 96%, at least 97%, at least 98%, at least 99%, or 100% sequence identity to nucleotides 88-753 of a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 88% to 100%, 90% to 100%, 88% to 95%, 88% to 90%, 90% to 95%, or 95% to 100% sequence identity to nucleotides 88-753 of a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 88% to 100%, 90% to 100%, 88% to 95%, 88% to 90%, 90% to 95%, or 95% to 100% sequence identity to a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to nucleotides 88-753 of a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 89% to 100%, 95% to 100%, or 89% to 95% sequence identity to nucleotides 88-753 of a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 89% to 100%, 95% to 100%, or 89% to 95% sequence identity to a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 90%, at least 91%, at least 92%, at least 93%, at least 94%, at least 95%, at least 96%, at least 97%, at least 98%, at least 99%, or 100% sequence identity to nucleotides 88-753 of a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 90% to 100%, 90% to 95%, or 95% to 100% sequence identity to nucleotides 88-753 of a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 90% to 100%, 90% to 95%, or 95% to 100% sequence identity to a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 91%, at least 92%, at least 93%, at least 94%, at least 95%, at least 96%, at least 97%, at least 98%, at least 99%, or 100% sequence identity to nucleotides 88-753 of SEQ ID NO: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 91%, at least 92%, at least 93%, at least 94%, at least 95%, at least 96%, at least 97%, at least 98%, at least 99%, or 100% sequence identity to SEQ ID NO: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 91% to 100%, 91% to 95%, or 95% to 100% sequence identity to nucleotides 88-753 of SEQ ID NO: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 90% to 100%, 91% to 100%, 91% to 95%, or 95% to 100% sequence identity to SEQ ID NO: 545 or 560.

In some embodiments, the TLR4 polynucleotide (e.g., a RNA, e.g., a mRNA) comprises from about 600 to about 100,000 nucleotides (e.g., from 600 to 650, from 600 to 675, from 600 to 700, from 600 to 725, from 600 to 750, from 600 to 775, from 600 to 800, from 600 to 900, from 600 to 1000, from 600 to 1100, from 600 to 1200, from 600 to 1300, from 600 to 1400, from 600 to 1500, from 700 to 800, from 700 to 900, from 700 to 1000, from 700 to 1100, from 700 to 1200, from 700 to 1300, from 700 to 1400, from 700 to 1500, from 753 to 800, from 753 to 900, from 753 to 1000, from 753 to 1200, from 753 to 1400, from 753 to 1600, from 753 to 1800, from 753 to 2000, from 753 to 3000, from 753 to 5000, from 753 to 7000, from 753 to 10,000, from 753 to 25,000, from 753 to 50,000, from 753 to 70,000, or from 753 to 100,000.).

In some embodiments, the TLR4 polynucleotide (e.g., a RNA, e.g., a mRNA) comprises a nucleotide sequence (e.g., an ORF) encoding a TLR4 polypeptide, e.g., caTLR4, wherein the length of the nucleotide sequence (e.g., an ORF) is at least 300 nucleotides in length (e.g., at least or greater than about 300, 400, 500, 600, 700, 750, 753, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 7000, 8000, 9000, 10,000, 20,000, 30,000, 40,000, 50,000, 60,000, 70,000, 80,000, 90,000 or up to and including 100,000 nucleotides).

In some embodiments, the TLR4 polynucleotide (e.g., a RNA, e.g., a mRNA) comprises a nucleotide sequence (e.g., an ORF) encoding a TLR4 polypeptide, e.g., caTLR4, that further comprises at least one nucleic acid sequence that is noncoding, e.g., a miRNA binding site.

In some embodiments, the TLR4 polynucleotide (e.g., a RNA, e.g., a mRNA) comprises a nucleotide sequence (e.g., an ORF) encoding a TLR4 polypeptide, e.g., caTLR4, that is single stranded or double stranded.

In some embodiments, the TLR4 polynucleotide comprising a nucleotide sequence (e.g., an ORF) encoding a TLR4 polypeptide, e.g., caTLR4, is DNA or RNA. In some embodiments, the TLR4 polynucleotide is RNA. In some embodiments, the TLR4 polynucleotide is, or functions as, a messenger RNA (mRNA). In some embodiments, the TLR4 mRNA comprises a nucleotide sequence (e.g., an ORF) that encodes at least one TLR4 polypeptide, e.g., caTLR4, and is capable of being translated to produce the encoded TLR4 polypeptide, e.g., caTLR4, in vitro, in vivo, in situ or ex vivo.

In some embodiments, the TLR4 polynucleotide (e.g., a RNA, e.g., a mRNA) comprises a sequence-optimized nucleotide sequence (e.g., an ORF) encoding a TLR4 polypeptide, e.g., caTLR4, (e.g., the wild-type sequence, functional fragment, or variant thereof), wherein the polynucleotide comprises at least one chemically modified nucleobase, e.g., 5-methoxyuracil. In some embodiments, the polynucleotide further comprises a miRNA binding site, e.g., a miRNA binding site that binds to miR-122. In some embodiments, the polynucleotide disclosed herein is formulated with a delivery agent, e.g., a compound having Formula (I), e.g., any of Compounds 1-147.

TLR4 Polynucleotide Signal Sequences:

The TLR4 polynucleotides (e.g., a RNA, e.g., a mRNA) can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the TLR4 polynucleotide (e.g., a RNA, e.g., a mRNA) comprises a nucleotide sequence (e.g., an ORF) that encodes a signal peptide operably linked a nucleotide sequence that encodes a TLR4 polypeptide, e.g., caTLR4, described herein.

In some embodiments, the signal sequence or signal peptide is a polynucleotide or polypeptide, respectively, which is from about 9 to 200 nucleotides (3-70 amino acids) in length that, optionally, is incorporated at the 5' (or N-terminus) of the coding region or the polypeptide, respectively. Addition of these sequences results in trafficking the encoded polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the TLR4 polynucleotide comprises a nucleotide sequence encoding a TLR4 polypeptide, e.g., caTLR4, wherein the nucleotide sequence further comprises a 5' nucleic acid sequence encoding a signal peptide. In one embodiment, a signal peptide is a naturally occurring TLR4 signal peptide, e.g., the signal peptide corresponding to amino acids 1-23 of wild-type TLR4. In other embodiments, the signal peptide is a heterologous signal peptide. In one embodiment, a signal peptide is a signal peptide of a lysosome-associated membrane glycoprotein 1 (LAMP-1) protein. In another embodiment, a signal peptide is an IgK signal peptide, e.g., a human IgK signal peptide or a murine IgK signal peptide. In other embodiments, the signal peptide comprises an amino acid sequence having at least about 80%, at least about 85%, at least about 90%, at least about 95%, at least about 95%, about 96%, at least about 97%, at least about 98%, at least about 99%, or about 100% identical to amino acids 1 to 29 of SEQ ID NO: 525.

TLR4 Fusion Proteins:

In some embodiments, the TLR4 polynucleotide (e.g., a RNA, e.g., a mRNA) can comprise more than one nucleic acid sequence (e.g., an ORF) encoding a polypeptide of interest. In some embodiments, the TLR4 polynucleotides comprises a single ORF encoding a TLR4 polypeptide, e.g., caTLR4, a functional fragment, or a variant thereof. However, in some embodiments, the TLR4 polynucleotide can comprise more than one ORF, for example, a first ORF encoding a TLR4 polypeptide, e.g., caTLR4 (a first polypeptide of interest), a functional fragment, or a variant thereof, and a second ORF expressing a second polypeptide of interest. In some embodiments, two or more polypeptides of interest can be genetically fused, i.e., two or more polypeptides can be encoded by the same ORF. In some embodiments, the TLR4 polynucleotide can comprise a nucleic acid sequence encoding a linker (e.g., a $G_4S$ peptide linker or another linker known in the art) between two or more polypeptides of interest.

In some embodiments, the TLR4 polynucleotide (e.g., a RNA, e.g., a mRNA) can comprise two, three, four, or more ORFs, each expressing a polypeptide of interest.

In some embodiments, the TLR4 polynucleotide (e.g., a RNA, e.g., a mRNA) can comprise a first nucleic acid sequence (e.g., a first ORF) encoding a TLR4 polypeptide, e.g., caTLR4, and a second nucleic acid sequence (e.g., a second ORF) encoding a second polypeptide of interest.

Sequence-Optimized TLR4 Polynucleotides:

In some embodiments, the TLR4 polynucleotide comprises a sequence-optimized nucleotide sequence encoding a TLR4 polypeptide, e.g., caTLR4. In some embodiments, the TLR4 polynucleotide comprises an open reading frame (ORF) encoding a TLR4 polypeptide, e.g., caTLR4, wherein the ORF has been sequence optimized.

Exemplary sequence-optimized nucleotide sequences encoding caTLR4 are shown in TABLE 7. In some embodiments, the sequence optimized caTLR4 sequences in TABLE 7, fragments, and variants thereof are used to practice the methods disclosed herein.

TABLE 7

Sequence optimized ORFs encoding caTLR4

| SEQ ID NO | Name | Sequence |
|---|---|---|
| 539 | TLR4ca-CO01 | ATGGCCGCCCCCGGTTCCGCCCGGCGCCCACTCTTGCTCCTCCTCCTC CTGCTCCTACTCGGCCTCATGCACTGCGCCAGCGCCGCCATGCCCGTA CTCAGCCTCAACATAACCTGCCAGATGAATAAGACCATCATCGGCGTG AGCGTCCTCAGCGTTCTCGTCGTCTCCGTCGTAGCAGTACTCGTTTAC AAGTTCTACTTCCACCTCATGCTCCTCGCCGGGTGTATCAAGTACGGC CGCGGGGAAAACATCTACGACGCCTTCGTCATCTATAGCAGCCAGGAC GAGGACTGGGTCCGGAATGAGCTGGTGAAGAACCTGGAGGAAGGCGTC CCGCCCTTCCAGCTGTGTCTGCACTACCGGGATTTCATCCCCGGGGTG GCGATCGCCGCGAACATCATCCACGAGGGATTCCACAAGTCCCGGAAG GTGATCGTGGTCGTGAGCCAGCACTTCATCCAAAGCCGGTGGTGCATC TTCGAGTACGAGATCGCCCAGACCTGGCAGTTTCTGTCCTCCAGGGCG GGAATCATCTTCATAGTGCTGCAGAAGGTGGAAAAAACCCTCCTGCGG CAGCAGGTGGAGCTGTACAGGCTGTTGAGCAGGAACACCTATCTGGAG TGGGAGGACAGCGTGCTGGGACGCCACATCTTCTGGAGGCGGCTGCGG AAAGCTCTGCTGGACGGGAAGTCTTGGAACCCGGAGGGGACGGTGGGC ACCGGTTGCAACTGGCAGGAGGCCACCTCCATC |
| 540 | TLR4ca-CO02 | ATGGCCGCCCCAGGCTCCGCCAGGCGGCCGCTCCTCCTCCTCCTTCTA CTCCTCCTCCTCGGCTTGATGCACTGCGCCAGCGCCGCGATGCCCGTT CTCAGCCTCAACATCACGTGCCAGATGAACAAGACCATCATCGGAGTC TCCGTCCTCAGCGTTCTCGTCGTCAGCGTCGTAGCCGTCCTCGTCTAC AAGTTCTATTTCCACCTCATGCTCCTGGCCGGGTGCATCAAGTACGGG CGCGGCGAGAACATCTACGACGCCTTCGTCATATACTCCAGCCAGGAC |

TABLE 7-continued

| Sequence optimized ORFs encoding caTLR4 | | |
|---|---|---|
| SEQ ID NO | Name | Sequence |
| | | GAGGACTGGGTCAGGAACGAGCTGGTGAAGAACCTCGAGGAGGGGGTC CCGCCCTTTCAGCTGTGCCTGCACTACCGGGACTTCATCCCCGGCGTG GCCATCGCCGCCAACATCATCCACGAGGGGTTCCACAAGAGCAGGAAG GTGATAGTGGTGGTGAGCCAGCACTTCATTCAGAGCCGGTGGTGCATC TTCGAGTATGAGATCGCCCAGACCTGGCAATTCCTGTCCTCCCGGGCA GGCATCATCTTCATCGTGCTGCAGAAGGTGGAGAAGACCCTGCTGAGG CAGCAGGTGGAGCTGTACAGGCTGCTGAGCAGGAACACTTACCTGGAA TGGGAGGACAGCGTGCTGGGCAGGCATATCTTCTGGAGGAGGCTGCGG AAGGCCCTGCTGGACGGCAAGAGCTGGAACCCCGAGGGCACCGTGGGG ACCGGCTGTAACTGGCAGGAAGCCACGAGCATC |
| 541 | TLR4ca-CO03 | ATGGCCGCCCCCGGCAGCGCCAGGCGGCCCCTCCTACTCCTCCTTTTG CTCCTCCTCCTCGGGCTCATGCACTGCGCGTCCGCCGCCATGCCGGTC CTCAGCCTCAACATCACCTGCCAGATGAACAAGACGATCATCGGCGTC TCCGTCCTCTCCGTCCTCGTCGTCTCCGTAGTTGCCGTCTTGGTCTAC AAATTCTACTTCCATCTTATGCTCCTTGCCGGGTGTATAAAGTACGGC AGGGGGGAGAACATCTACGACGCCTTCGTCATCTACAGCAGCCAGGAC GAAGACTGGGTTCGGAACGAGCTGGTGAAGAACCTGGAGGAGGGCGTG CCCCCCTTCCAGCTGTGTCTGCATTACCGGGACTTCATCCCGGGGGTG GCCATAGCCGCCAACATCATCCATGAGGGCTTCCACAAGTCCCGGAAG GTGATCGTGGTGGTGAGCCAGCACTTCATTCAATCCAGGTGGTGCATC TTCGAGTACGAGATCGCGCAGACCTGGCAGTTCCTGAGCTCCCGCGCC GGGATCATCTTCATCGTCCTCCAGAAAGTGGAGAAGACGCTGCTGCGG CAGCAGGTGGAACTGTACCGTCTGCTCTCCCGGAACACCTACCTGGAG TGGGAGGATAGCGTCCTGGGCCGGCACATCTTCTGGCGGCGGCTCCGG AAGGCGCTGCTCGACGGGAAAAGCTGGAACCCGGAGGGCACCGTGGGC ACTGGCTGCAATTGGCAGGAAGCAACGTCCATC |
| 542 | TLR4ca-CO04 | ATGGCCGCCCCCGGGTCCGCGAGGCGGCCCCTACTCCTCCTCCTTCTC CTTCTTCTACTCGGCCTCATGCATTGCGCCAGCGCCGCCATGCCCGTC CTCAGCCTCAACATCACCTGCCAGATGAACAAGACCATCATCGGGGTG AGCGTCCTCAGCGTCCTCGTCGTCAGCGTCGTCGCGGTCCTCGTATAT AAGTTCTACTTTCATCTCATGCTCCTCGCCGGCTGCATCAAGTACGGC AGGGGCGAGAACATCTACGACGCCTTCGTCATCTACTCCAGCCAAGAC GAGGATTGGGTTAGGAACGAGCTGGTGAAGAACCTGGAGGAGGGCGTG CCCCCCTTCCAGCTCTGCCTCCACTACCGGGACTTTATCCCCGGTGTG GCGATCGCCGCGAACATCATCCACGAGGGCTTCCACAAGAGCAGGAAA GTGATCGTGGTGGTGTCCCAGCACTTCATCCAGTCCCGGTGGTGCATC TTCGAGTACGAGATCGCCCAAACCTGGCAGTTCCTAAGCTCCAGGGCC GGCATCATCTTCATTGTGCTCCAGAAGGTGGAGAAGACCCTGCTGAGG CAGCAGGTGGAACTGTACCGCCTGCTGAGCAGGAACACCTACCTGGAG TGGGAGGATAGCGTCCTGGGGCGGCACATCTTCTGGAGGCGCCTGAGG AAGGCGCTGCTGGACGGCAAGTCCTGGAACCCCGAAGGCACCGTCGGG ACGGGCTGCAATTGGCAGGAGGCCACCTCCATC |
| 543 | TLR4ca-CO05 | ATGGCCGCCCCCGGCAGCGCCAGACGACCCCTCCTCCTCTTGCTCCTC CTTCTCCTCTTGGGCCTCATGCACTGCGCCAGCGCCGCGATGCCGGTC CTCTCCCTTAACATCACCTGCCAGATGAACAAGACAATCATCGGGGTA TCCGTCCTTTCCGTCCTTGTCGTCAGCGTCGTCGCCGTACTCGTTTAC AAGTTCTACTTCCACCTTATGCTCTTGGCCGGGTGCATCAAATACGGC CGCGGCGAGAATATATACGACGCGTTCGTGATCTACAGCTCACAGGAC GAGGACTGGGTCCGCAACGAGCTGGTGAAGAACCTGGAGGAGGGGGTG CCCCCCTTCCAGCTGTGTCTGCACTACAGGGACTTCATCCCCGGCGTG GCCATCGCCGCCAACATCATCCACGAGGGGTTCCACAAGAGCAGAAAG GTGATCGTGGTGGTCAGCCAGCACTTCATCCAGTCCAGGTGGTGCATC TTCGAGTATGAGATCGCCCAGACCTGGCAGTTTCTGTCCTCCAGGGCC GGGATCATCTTCATCGTGCTGCAGAAGGTGGAGAAGACCCTGCTCAGG CAGCAGGTGGAGCTCTACAGGCTGCTGAGCAGGAATACCTACCTGGAA TGGGAGGACAGCGTGCTGGGTCGCCACATCTTCTGGAGGCGCCTGCGG AAGGCCCTGCTGGATGGCAAGAGCTGGAACCCCGAAGGGACCGTGGGT ACCGGCTGCAACTGGCAGGAGGCCACCAGCATA |
| 544 | TLR4ca-CO06 | ATGGCCGCCCCGGGCAGCGCCCGCAGGCCCCTCCTCCTCTTGCTCCTC CTCCTCCTCCTCGGATTGATGCACTGCGCCAGCGCCGCGATGCCCGTC CTCTCCCTCAACATCACGTGCCAGATGAACAAGACCATTATCGGCGTT TCCGTCCTCAGCGTCCTCGTCGTCAGCGTCGTAGCCGTCTTGGTTTAC AAGTTCTACTTTCACTTGATGCTCCTCGCCGGCTGTATCAAGTACGGC CGGGGCGAGAACATATACGACGCCTTCGTCATCTACAGCAGCCAGGAC GAGGACTGGGTCCGCAACGAGCTGGTGAAGAACCTGGAGGAGGGCGTG CCCCCTTTTCAGCTGTGCCTCCATTACCGGGACTTCATTCCCGGCGTG GCCATCGCCGCCAACATCATCCACGAAGGCTTCCACAAGTCCAGGAAG GTGATCGTGGTGGTGAGCCAGCACTTCATCCAGAGCAGGTGGTGCATC TTCGAGTACGAGATCGCCCAGACCTGGCAGTTCCTGAGCAGCCGGGCC GGCATCATCTTCATCGTGCTCCAGAAGGTCGAGAAGACCCTCCTGAGG CAGCAGGTGGAGCTGTACAGGCTCCTTAGCCGGAACACGTACCTGGAG |

TABLE 7-continued

| Sequence optimized ORFs encoding caTLR4 | | |
|---|---|---|
| SEQ ID NO | Name | Sequence |
| | | TGGGAAGACTCCGTGCTGGGCCGGCACATCTTCTGGAGGCGACTGAGG |
| | | AAGGCCCTGCTCGACGGCAAGTCCTGGAACCCCGAGGGCACCGTGGGC |
| | | ACCGGCTGCAACTGGCAGGAGGCCACCAGCATC |
| 545 | TLR4ca-CO07 | ATGGCCGCCCCGGGGAGCGCCCGCCGGCCCCTCCTCCTCCTTCTCCTT |
| | | CTCCTCCTCCTAGGGCTCATGCATTGCGCCAGCGCCGCAATGCCCGTA |
| | | CTCAGCCTCAACATCACCTGCCAGATGAACAAGACGATCATCGGCGTT |
| | | AGCGTACTCAGCGTTCTCGTCGTCAGCGTCGTCGCGGTCCTCGTCTAC |
| | | AAATTCTACTTCCACCTCATGCTCCTAGCCGGCTGCATCAAATACGGC |
| | | AGGGGAGAGAACATCTACGACGCCTTCGTAATCTACAGCAGCCAGGAC |
| | | GAGGACTGGGTCCGCAACGAGCTGGTGAAGAACCTGGAGGAGGGCGTG |
| | | CCCCCCTTCCAGCTGTGCCTCCACTACAGGGACTTCATCCCAGGTGTG |
| | | GCGATCGCCGCCAACATAATCCACGAGGGCTTCCACAAGTCCAGGAAG |
| | | GTGATCGTGGTGGTGAGCCAGCACTTTATCCAGAGCAGGTGGTGTATC |
| | | TTCGAGTACGAGATCGCCCAGACCTGGCAGTTCCTCAGCAGTCGCGCC |
| | | GGCATCATCTTCATCGTGCTCCAGAAGGTGGAGAAGACCCTGCTGCGG |
| | | CAGCAGGTGGAGCTCTACCGGCTGCTGTCGCGCAACACCTACCTCGAG |
| | | TGGGAGGACAGCGTGCTGGGGCGACATATCTTTTGGCGAAGGCTGAGG |
| | | AAGGCCCTGCTGGACGGCAAGAGCTGGAACCCGGAGGGCACCGTGGGC |
| | | ACCGGATGTAACTGGCAAGAGGCCACCAGCATC |
| 546 | TLR4ca-CO08 | ATGGCCGCCCCCGGCAGCGCCAGGCGGCCCCTCCTCCTCTTGCTACTC |
| | | CTACTCCTCCTCGGCCTTATGCATTGCGCCTCCGCCGCCATGCCCGTC |
| | | CTCAGCCTTAACATCACCTGCCAGATGAACAAGACCATAATCGGCGTC |
| | | TCCGTCCTCTCGGTCCTAGTCGTCAGCGTCGTAGCCGTCCTTGTCTAC |
| | | AAGTTCTACTTCCACCTTATGTTGCTCGCCGGCTGCATCAAGTACGGC |
| | | AGGGGCGAGAATATCTACGACGCCTTCGTAATCTATAGCTCGCAAGAC |
| | | GAGGACTGGGTTAGGAACGAGCTGGTGAAGAATCTGGAGGAGGGGGTG |
| | | CCCCCATTTCAGCTGTGCCTGCATTACAGGGACTTCATCCCCGGCGTG |
| | | GCCATCGCCGCCAATATCATCCACGAAGGCTTCCACAAGTCCCGGAAG |
| | | GTGATCGTGGTGGTGTCGCAGCACTTTATCCAGAGCAGGTGGTGCATC |
| | | TTCGAGTACGAGATCGCCCAGACCTGGCAGTTCCTGAGCAGCCGCGCC |
| | | GGGATAATTTTCATCGTGCTGCAGAAGGTGGAAAAGACGCTGCTCAGG |
| | | CAGCAGGTGGAGCTCTACCGGCTGCTGAGCAGGAACACCTACCTGGAA |
| | | TGGGAGGACTCCGTGCTGGGCCGCCACATCTTCTGGCGGAGGCTGCGG |
| | | AAGGCCCTGCTGGATGGCAAGAGCTGGAACCCCGAGGGCACCGTGGGC |
| | | ACCGGCTGCAATTGGCAGGAGGCGACCAGCATC |
| 547 | TLR4ca-CO09 | ATGGCCGCCCCCGGCTCCGCCCGGCGGCCCCTCCTCCTCCTCTTACTC |
| | | CTCCTCCTCCTCGGACTCATGCACTGCGCCAGCGCCGCCATGCCCGTC |
| | | CTCTCCTTAAACATCACCTGCCAGATGAACAAGACCATCATCGGCGTC |
| | | AGCGTCCTCAGCGTACTCGTAGTCAGCGTCGTAGCGGTCCTCGTCTAC |
| | | AAGTTCTACTTCCACCTCATGTTACTTGCCGGCTGCATCAAGTACGGC |
| | | AGGGGCGAGAACATCTACGACGCGTTCGTCATCTATAGCAGCCAAGAC |
| | | GAGGACTGGGTCCGCAATGAGCTGGTCAAGAACCTCGAAGAGGGGGTG |
| | | CCCCCCTTCCAGCTGTGCCTGCACTACAGGGACTTCATCCCCGGGGTC |
| | | GCCATAGCGGCCAACATCATACACGAAGGCTTTCACAAGAGCCGGAAG |
| | | GTGATCGTGGTGGTGTCCCAGCACTTCATCCAGTCCCGGTGGTGCATC |
| | | TTCGAGTACGAGATCGCGCAGACCTGGCAGTTCCTGAGCAGCAGAGCC |
| | | GGCATCATCTTTATCGTGCTGCAGAAGGTGGAGAAGACCCTGCTGCGC |
| | | CAGCAGGTGGAGCTGTACAGGCTGCTGAGCAGGAACACCTACCTCGAG |
| | | TGGGAGGACTCCGTGCTGGGCCGACACATCTTCTGGCGGCGCCTGCGC |
| | | AAGGCCCTGCTGGACGGGAAAAGCTGGAACCCCGAGGGCACCGTGGGC |
| | | ACCGGGTGCAACTGGCAGGAAGCGACCAGCATC |
| 548 | TLR4ca-CO10 | ATGGCCGCCCCGGGGAGCGCCAGGAGGCCCCTACTCCTCCTCCTCCTC |
| | | CTTCTTCTACTCGGCTTAATGCATTGCGCCAGCGCCGCCATGCCCGTC |
| | | CTTAGCCTTAACATCACTTGTCAGATGAACAAGACCATCATCGGGGTC |
| | | AGCGTCCTCAGCGTCCTCGTCGTATCGGTAGTCGCCGTCCTCGTCTAC |
| | | AAGTTCTATTTCCACCTCATGCTCCTCGCCGGCTGCATCAAATACGGG |
| | | AGGGGGGAGAACATCTACGACGCCTTCGTTATCTACAGCAGCCAGGAC |
| | | GAGGACTGGGTCCGGAACGAACTGGTGAAAAACCTGGAAGAGGGGGTG |
| | | CCCCCCTTCCAGCTGTGTCTGCACTACAGGGACTTCATCCCCGGTGTG |
| | | GCCATCGCGGCCAACATCATCCACGAGGGGTTCCACAAAAGCAGGAAG |
| | | GTGATCGTGGTGGTGAGCCAGCACTTCATCCAGAGCAGGTGGTGCATC |
| | | TTCGAGTACGAGATCGCCCAGACCTGGCAGTTCCTGTCGAGCAGGGCG |
| | | GGGATCATCTTCATCGTGCTCCAGAAGGTGGAGAAGACCCTGCTGCGA |
| | | CAGCAGGTCGAGCTGTACCGGCTGCTGAGCAGGAACACCTATCTGGAG |
| | | TGGGAAGACAGCGTGCTGGGCCGCCATATCTTCTGGAGGCGCCTGAGG |
| | | AAGGCCCTGCTGGACGGCAAGAGCTGGAATCCCGAGGGCACCGTGGGC |
| | | ACGGGGTGCAACTGGCAGGAGGCCACCAGCATC |
| 549 | TLR4ca-CO11 | ATGGCGGCCCCCGGCTCCGCCAGGCGCCCCCTCCTCCTCCTACTCCTC |
| | | CTCCTCCTCCTCGGCCTAATGCACTGCGCCAGCGCCGCTATGCCCGTC |
| | | CTCAGCCTCAATATCACTTGTCAGATGAACAAGACCATCATCGGCGTC |

TABLE 7-continued

Sequence optimized ORFs encoding caTLR4

| SEQ ID NO | Name | Sequence |
|---|---|---|
| | | AGCGTCCTCTCAGTCCTCGTAGTCAGCGTCGTCGCCGTTCTCGTCTAC<br>AAGTTCTACTTCCATCTCATGCTTTTGGCGGGCTGCATCAAGTACGGC<br>CGAGGGGAGAATATCTACGACGCGTTCGTGATCTACTCCAGCCAGGAC<br>GAGGACTGGGTCAGGAACGAGCTGGTGAAGAATCTGGAGGAGGGGGTG<br>CCCCCCTTCCAGCTGTGCCTGCATTACCGGGACTTCATTCCCGGTGTG<br>GCCATCGCCGCCAATATCATCCACGAGGGCTTCCACAAGTCCAGGAAG<br>GTGATCGTGGTCGTGTCCCAGCACTTCATCCAAAGCCGGTGGTGCATC<br>TTCGAGTACGAGATTGCGCAGACCTGGCAATTCCTCAGCTCCAGGGCC<br>GGCATCATATTCATTGTGCTGCAAAAAGTGGAGAAGACGCTGCTGCGG<br>CAGCAAGTGGAGCTGTACCGCCTGCTGAGCAGGAACACCTACCTCGAG<br>TGGGAGGATTCCGTGCTCGGCAGGCACATCTTCTGGAGGAGGCTCCGC<br>AAGGCCCTGCTGGACGGCAAAAGCTGGAACCCCGAGGGGACAGTGGGC<br>ACAGGCTGCAACTGGCAGGAGGCGACCAGCATC |
| 550 | TLR4ca-CO12 | ATGGCCGCCCCCGGCAGCGCCCGGCGGCCTCTCCTCCTCCTCCTCTTG<br>CTCCTCCTCCTCGGCCTCATGCACTGCGCCAGCGCAGCCATGCCCGTA<br>CTCAGCTTGAACATCACGTGCCAGATGAACAAAACCATCATCGGCGTC<br>AGCGTACTCTCAGTGCTCGTCGTCAGCGTCGTCGCCGTACTCGTATAC<br>AAGTTCTACTTTCACTTAATGCTACTCGCCGGCTGCATCAAGTACGGC<br>CGCGGCGAAAACATCTACGACGCCTTCGTCATCTACTCCAGTCAGGAC<br>GAGGACTGGGTCAGGAACGAGCTGGTGAAGAACCTGGAGGAGGGCGTG<br>CCCCCCTTCCAGCTGTGCCTGCATTACCGGGATTTCATCCCGGGGGTG<br>GCCATTGCCGCGAACATCATCCACGAGGGCTTTCACAAGAGCAGGAAA<br>GTGATCGTGGTTGTGAGCCAGCACTTTATCCAGTCCAGGTGGTGCATC<br>TTTGAGTACGAGATCGCCCAGACCTGGCAGTTCCTGAGCAGCAGGGCC<br>GGCATCATCTTTATAGTGCTGCAGAAAGTTGAGAAGACCCTGCTGAGG<br>CAGCAGGTCGAGCTGTACAGGCTGCTCTCCAGGAACACCTACCTGGAG<br>TGGGAGGACTCCGTGCTCGGACGCCACATCTTTTGGAGGAGGCTGAGG<br>AAGGCCCTCCTGGACGGGAAAAGCTGGAACCCGGAGGGCACGGTGGGA<br>ACCGGGTGCAACTGGCAGGAGGCCACCAGCATC |
| 551 | TLR4ca-CO13 | ATGGCCGCCCCCGGGTCCGCCAGGCGGCCCCTCCTACTCCTCCTCTTG<br>CTCCTCCTACTCGGGCTAATGCATTGCGCCTCCGCCGCCATGCCCGTA<br>TTGAGCCTCAACATCACCTGCCAGATGAACAAGACGATCATCGGCGTT<br>AGCGTCCTCAGCGTTCTCGTAGTCTCCGTAGTCGCCGTCCTCGTCTAC<br>AAGTTCTATTTTCATTTGATGCTCCTGGCCGGCTGCATCAAATACGGC<br>AGGGGCGAAAACATCTACGACGCCTTCGTGATCTACTCCAGCCAGGAC<br>GAGGACTGGGTCCGCAATGAGCTGGTGAAGAACCTGGAGGAGGGGGTG<br>CCCCCCTTCCAGCTCTGCCTGCACTACCGTGACTTTATCCCCGGCGTG<br>GCCATCGCGGCCAACATCATACACGAGGGATTTCACAAGTCCCGCAAG<br>GTCATCGTGGTGGTGAGCCAACACTTCATCCAGTCGCGGTGGTGCATT<br>TTTGAGTACGAGATCGCCCAAACCTGGCAATTCCTGAGCTCCAGGGCC<br>GGGATCATCTTCATCGTGCTGCAGAAGGTCGAGAAGACCTTGCTGAGG<br>CAGCAGGTGGAGCTCTACAGGCTGCTCTCGAGGAACACCTACCTGGAG<br>TGGGAGGACAGCGTCCTGGGGCGGCACATCTTCTGGAGGAGGCTGAGG<br>AAGGCCCTGCTGGACGGCAAGAGCTGGAACCCCGAGGGCACCGTCGGC<br>ACCGGGTGTAACTGGCAGGAGGCCACCAGCATC |
| 552 | TLR4ca-CO14 | ATGGCCGCCCCCGGGAGCGCCCGTCGCCCCCTCCTCTTGCTACTCCTC<br>CTCTTGCTCCTGGGCCTCATGCATTGCGCGTCCGCGGCCATGCCCGTC<br>CTCAGCCTCAACATCACCTGCCAGATGAACAAAACGATCATCGGAGTA<br>AGCGTCCTCAGCGTCCTCGTCGTTTCCGTCGTGGCCGTACTCGTCTAC<br>AAATTCTACTTTCACCTTATGTTACTCGCCGGGTGCATCAAGTACGGA<br>AGGGGCGAGAACATCTACGACGCCTTCGTCATCTACAGCTCCCAGGAC<br>GAGGACTGGGTCCGCAACGAGCTGGTGAAGAACCTGGAAGAGGGCGTG<br>CCGCCCTTTCAGCTGTGCTTGCACTACCGGGACTTCATACCTGGCGTG<br>GCAATCGCCGCCAATATAATCCACGAGGGCTTCCACAAAAGCCGGAAG<br>GTGATCGTGGTGGTGAGCCAGCACTTTATCCAGTCCCGGTGGTGCATT<br>TTCGAGTACGAGATCGCGCAGACATGGCAGTTCCTGAGCAGCAGGGCC<br>GGCATCATCTTCATCGTGCTGCAGAAGGTCGAGAAGACGCTGCTGCGG<br>CAGCAGGTGGAGCTGTACCGGCTGCTGAGCCGGAACACCTACCTGGAG<br>TGGGAGGATAGCGTGCTCGGGCGGCACATCTTCTGGCGGCGTCTGAGG<br>AAGGCCCTCCTCGACGGCAAGAGCTGGAACCCGGAGGGCACGGTGGGC<br>ACAGGGTGCAACTGGCAAGAGGCCACGTCCATA |
| 553 | TLR4ca-CO15 | ATGGCCGCCCCCGGATCCGCCAGGCGGCCGTTACTACTCCTACTCCTC<br>CTCCTACTCCTCGGCCTAATGCATTGCGCGAGCGCCGCTATGCCCGTC<br>CTCAGCCTCAACATAACGTGTCAGATGAACAAGACGATCATCGGGGTC<br>AGCGTCCTCTCCGTCCTCGTCGTCTCCGTCGTCGCCGTTCTCGTCTAC<br>AAGTTCTACTTCCACCTCATGCTCCTCGCCGGCTGCATCAAGTACGGC<br>AGGGGCGAGAACATCTACGACGCTTTCGTCATCTACAGCAGCCAGGAC<br>GAGGACTGGGTCCGGAACGAGCTGGTGAAGAACCTGGAGGAGGGCGTC<br>CCGCCCTTCCAGCTGTGCCTCCACTATCGGGACTTCATCCCCGGCGTG<br>GCCATCGCCGCCAACATCATCCACGAGGGCTTTCACAAGAGCCGAAAG<br>GTGATCGTGGTGGTGTCCCAACACTTTATACAGAGCCGGTGGTGCATC |

TABLE 7-continued

| SEQ ID NO | Name | Sequence |
|---|---|---|
| | | TTCGAGTACGAGATCGCCCAGACCTGGCAGTTCCTGTCCAGCCGCGCA GGGATCATCTTCATCGTCCTGCAGAAGGTGGAGAAAACCCTGCTGCGG CAGCAGGTGGAGCTGTACAGGCTGCTGTCCCGGAACACCTACCTGGAG TGGGAGGATAGCGTGCTGGGGAGGCACATCTTTTGGAGGAGGCTGAGG AAGGCCCTGCTGGACGGCAAAAGCTGGAACCCCGAGGGGACCGTGGGA ACCGGCTGCAACTGGCAAGAGGCCACCAGCATC |
| 554 | TLR4ca-CO16 | ATGGCCGCCCCCGGCTCCGCCCGGCGCCCCCTCCTCCTCCTCTTGCTC CTCCTACTCCTTGGCCTCATGCACTGCGCCAGCGCGGCCATGCCGGTC CTCTCCTTGAACATAACCTGCCAGATGAATAAGACCATCATCGGCGTC AGCGTCCTCAGCGTCCTCGTCGTCAGCGTCGTGGCGGTCCTCGTTTAC AAATTCTACTTCCACCTCATGTTATTGGCCGGCTGCATAAAGTACGGG AGGGGCGAGAACATATACGACGCCTTCGTCATCTACAGCTCCCAGGAC GAGGACTGGGTCAGGAACGAGCTGGTGAAAAACCTGGAGGAGGGTGTG CCACCGTTCCAGCTGTGCCTGCACTACCGGGACTTCATACCCGGCGTG GCCATCGCCGCCAATATCATCCATGAGGGCTTCCACAAGTCCAGGAAG GTGATCGTGGTGGTGAGCCAACACTTCATCCAGTCCCGGTGGTGTATC TTCGAGTACGAGATCGCCCAGACCTGGCAGTTCCTGTCCAGCCGGGCC GGCATCATCTTCATCGTGCTGCAGAAGGTCGAGAAGACCCTGCTGCGA CAGCAGGTGGAGCTGTATCGCCTGCTCAGCAGGAATACATACCTGGAG TGGGAGGACAGTGTGCTGGGCCGGCACATCTTCTGGAGAAGGCTCAGG AAGGCCCTGCTGGACGGCAAATCGTGGAACCCCGAGGGCACCGTGGGC ACTGGTTGTAACTGGCAGGAGGCCACCTCCATC |
| 555 | TLR4ca-CO17 | ATGGCCGCCCCCGGCAGCGCCAGGCGCCCCCTCCTTCTCCTCCTCCTA TTGCTCTTGTTGGGCCTCATGCACTGCGCCAGCGCCGCGATGCCCGTC CTCTCCTTGAACATCACCTGCCAGATGAACAAGACCATCATCGGGGTC AGCGTCCTTTCCGTCCTCGTCGTTTCCGTTGTCGCCGTCCTGGTGTAC AAGTTCTACTTCCATTTGATGCTACTCGCCGGCTGCATCAAGTACGGC AGGGGAGAGAACATCTACGACGCCTTCGTGATCTACAGCTCGCAGGAC GAGGACTGGGTCAGGAACGAGCTGGTGAAGAACCTGGAGGAGGGGGTG CCCCCCTTCCAGCTGTGTCTACATTACAGGGACTTCATTCCGGGCGTC GCCATCGCCGCCAACATCATCCACGAAGGCTTCCACAAGAGCCGAAAG GTGATCGTGGTGGTGTCCCAGCATTTCATACAATCGCGCTGGTGCATA TTTGAGTACGAGATTGCCCAGACCTGGCAGTTCCTAAGCAGCCGGGCG GGGATCATCTTTATCGTGCTGCAGAAGGTCGAGAAGACCCTACTGAGA CAGCAGGTGGAGCTGTACCGGCTGCTCTCGAGGAACACCTACCTGGAG TGGGAGGACAGCGTGCTGGGGCGGCACATCTTCTGGAGGCGGCTGAGG AAGGCCCTGCTGGATGGGAAAAGCTGGAACCCCGAGGGCACAGTGGGG ACCGGCTGCAACTGGCAGGAGGCGACGAGCATC |
| 556 | TLR4ca-CO18 | ATGGCGGCCCCGGGCAGCGCCAGGAGGCCCCTCCTCCTCCTCCTCCTC TTATTGCTCTTGGGCCTCATGCACTGCGCCAGCGCCGCCATGCCGGTC CTCAGCCTAAATATCACCTGCCAGATGAATAAGACCATCATCGGGGTC AGCGTCCTTAGCGTCCTCGTAGTCAGCGTCGTAGCGGTCCTTGTCTAC AAGTTTTACTTTCACCTCATGCTCTTAGCCGGCTGCATCAAGTACGGC CGGGGGGAGAACATCTACGACGCCTTCGTTATCTACTCCAGCCAAGAC GAGGATTGGGTTCGTAACGAGCTGGTGAAGAACCTGGAGGAGGGCGTG CCCCCCTTCCAGCTGTGCCTGCACTACCGGGACTTTATCCCCGGCGTG GCCATCGCCGCCAACATCATCCATGAGGGCTTCCACAAAAGCCGCAAG GTGATAGTGGTGGTGAGCCAGCACTTTATCCAGTCCAGGTGGTGTATC TTCGAGTACGAGATCGCCCAGACCTGGCAGTTCCTGAGCTCCAGGGCC GGAATCATCTTCATTGTGCTGCAGAAGGTGGAGAAAACCCTCCTCCGC CAACAGGTCGAGCTGTACAGGCTGCTGTCCCGCAATACCTATCTGGAG TGGGAAGACAGCGTCCTCGGGCGGCACATCTTCTGGCGCCGCCTGCGG AAGGCCCTGCTGGATGGCAAGAGCTGGAACCCCGAAGGAACCGTCGGC ACGGGTTGCAACTGGCAAGAGGCCACCTCCATC |
| 557 | TLR4ca-CO19 | ATGGCCGCCCCCGGGTCCGCGAGGCGGCCACTCCTCCTCCTCTTGCTC CTCCTCCTTCTCGGCCTCATGCACTGTGCGAGCGCCGCCATGCCGGTC CTCAGCCTTAACATCACCTGCCAGATGAACAAGACCATAATCGGGGTC AGCGTCCTCTCCGTTCTCGTCGTCTCGGTAGTCGCCGTCTTAGTCTAC AAGTTCTATTTCCACCTCATGCTTCTCGCGGGCTGCATCAAGTACGGC AGGGGGGAGAACATCTACGACGCCTTCGTCATCTACTCCAGCCAGGAC GAGGACTGGGTCCGGAACGAACTGGTGAAGAACCTGGAGGAGGGCGTG CCCCCCTTCCAGCTGTGCCTGCACTACCGGGACTTCATCCCCGGAGTG GCCATCGCCGCCAACATCATCCATGAGGGATTTCACAAGTCCCGGAAA GTGATCGTGGTGGTGAGCCAGCACTTCATCCAGAGCAGGTGGTGCATC TTTGAGTATGAGATCGCTCAGACCTGGCAGTTCCTGTCCTCCCGGGCC GGAATAATTTTCATCGTTCTGCAGAAGGTGGAAAAGACCCTGCTGAGA CAGCAGGTGGAGCTCTACAGGCTGCTCAGCAGGAACACCTACCTGGAG TGGGAGGACTCCGTACTGGGGCGGCACATCTTCTGGCGGCGCCTGAGG AAGGCCCTTCTCGACGGCAAGAGCTGGAACCCCGAGGGTACCGTCGGC ACCGGATGCAACTGGCAGGAGGCCACCAGTATC |

Sequence optimized ORFs encoding caTLR4

TABLE 7-continued

Sequence optimized ORFs encoding caTLR4

| SEQ ID NO | Name | Sequence |
|---|---|---|
| 558 | TLR4ca-CO20 | ATGGCCGCCCCCGGCAGCGCGCGGCGTCCCCTCCTCCTCCTCCTCCTA CTCCTCCTCCTCGGGCTCATGCATTGCGCCTCCGCCGCCATGCCGGTC CTCAGCCTCAACATCACCTGCCAGATGAACAAGACCATCATCGGCGTT AGCGTCCTCAGCGTCCTGGTGGTGTCCGTCGTCGCCGTTCTCGTCTAC AAGTTCTACTTTCACCTCATGCTCCTCGCCGGGTGCATCAAGTACGGC AGGGGCGAAAACATCTACGACGCCTTCGTCATCTACTCCAGCCAGGAC GAGGACTGGGTCCGTAACGAGCTCGTAAAGAACCTGGAGGAGGGCGTG CCTCCCTTCCAGCTGTGCCTGCACTACAGGGACTTCATCCCAGGGGTG GCCATCGCCGCCAACATTATCCACGAGGGCTTCCACAAGAGCAGGAAA GTGATCGTGGTGGTGAGCCAGCACTTCATCCAGTCCCGGTGGTGCATC TTCGAATATGAGATCGCCCAGACCTGGCAGTTTCTGTCCTCCCGGGCC GGCATCATTTTCATCGTGCTTCAGAAGGTCGAAAAGACCCTGCTGAGG CAACAGGTGGAACTCTATAGGCTCCTGAGCCGTAACACCTACCTCGAA TGGGAGGACAGCGTGCTGGGCCGCCACATCTTCTGGAGGAGGCTGAGG AAGGCCCTGCTGGACGGCAAGAGCTGGAACCCCGAGGGCACCGTGGGT ACCGGGTGCAACTGGCAGGAGGCCACCAGCATA |
| 559 | TLR4ca-CO21 | ATGGCCGCGCCGGGCTCCGCCAGGAGGCCCCTCCTCCTACTCCTCTTG CTCCTACTCCTCGGCCTCATGCACTGCGCGTCCGCGGCGATGCCCGTC CTCAGCCTCAACATTACCTGCCAAATGAACAAAACCATCATAGGCGTC AGCGTCCTCTCCGTCCTCGTAGTCAGCGTCGTCGCCGTTCTCGTCTAC AAGTTCTACTTCCACTTGATGCTACTCGCCGGCTGTATAAAGTACGGC CGGGGGGAGAACATCTACGACGCCTTCGTCATCTACAGCTCGCAGGAC GAGGACTGGGTCCGGAACGAGCTGGTGAAAAACCTGGAAGAGGGCGTT CCCCCATTCCAGCTGTGCCTGCACTACCGGGACTTTATCCCGGGGGTG GCCATCGCCGCCAATATCATCCATGAGGGCTTCCACAAGAGCCGGAAG GTGATCGTCGTCGTCAGCCAACACTTCATCCAGTCCAGGTGGTGCATC TTCGAGTACGAGATCGCCCAGACCTGGCAGTTCCTGTCCTCCCGCGCC GGCATCATCTTCATCGTGCTGCAGAAGGTCGAGAAGACCCTGCTGCGG CAGCAGGTGGAGCTGTATCGCCTGCTCTCCCGAAACACTTACCTCGAG TGGGAGGATAGCGTGCTCGGCCGGCACATCTTCTGGAGGAGGCTGAGG AAGGCTCTCCTGGACGGCAAGAGCTGGAACCCCGAGGGAACCGTGGGC ACCGGGTGCAACTGGCAAGAGGCCACCAGCATC |
| 560 | TLR4ca-CO22 | ATGGCCGCCCCCGGCAGCGCCCGGAGGCCCCTCCTCCTCCTCCTTCTC CTACTCTTGCTCGGGCTCATGCATTGCGCCTCCGCCGCCATGCCCGTA TTGTCCCTCAACATCACGTGCCAGATGAACAAGACTATCATCGGCGTT AGCGTACTCAGCGTCCTCGTTGTCAGCGTCGTCGCCGTACTCGTCTAT AAGTTTTACTTCCACCTTATGCTCCTCGCCGGCTGCATCAAGTACGGC AGGGGCGAGAACATCTACGACGCCTTCGTGATCTACAGCAGCCAGGAC GAGGACTGGGTTAGGAACGAGCTGGTGAAGAACCTGGAGGAGGGCGTG CCCCCCTTTCAGCTGTGCCTCCACTATAGGGACTTCATCCCCGGGGTG GCCATCGCCGCCAACATCATACATGAGGGGTTCCACAAGAGCAGGAAG GTGATCGTGGTGGTCAGCCAGCACTTCATCCAGAGCAGATGGTGCATA TTCGAGTACGAGATCGCCCAGACCTGGCAGTTCCTGAGCAGCAGGGCC GGCATCATCTTCATTGTGCTGCAGAAGGTAGAAAAGACGCTGCTCAGG CAGCAAGTGGAGCTGTACCGGCTCCTGAGCAGGAACACCTACCTGGAG TGGGAGGACAGCGTGCTGGGCCGGCACATCTTCTGGCGACGGCTGAGG AAGGCCCTGCTGGACGGCAAGTCCTGGAACCCCGAGGGCACCGTGGGG ACCGGCTGTAACTGGCAGGAGGCTACTAGCATC |
| 561 | TLR4ca-CO23 | ATGGCGGCCCCCGGCAGCGCGCGCCGGCCCCTCCTCCTCTTGTTACTC TTGTTGCTCCTCGGTCTAATGCACTGCGCCAGCGCCGCCATGCCCGTC CTCAGCCTTAACATCACGTGCCAAATGAACAAGACTATCATCGGGGTC AGCGTCCTCTCCGTACTTGTAGTTAGCGTTGTCGCCGTCTTAGTCTAC AAGTTCTACTTCCACCTCATGCTCCTGGCCGGCTGCATAAAGTACGGT AGGGGCGAGAATATATACGACGCCTTCGTGATCTACTCCAGCCAGGAC GAGGACTGGGTCAGGAACGAGTTAGTGAAAAACCTGGAGGAGGGGGTG CCCCCCTTCCAGCTGTGCCTGCACTACCGGGACTTCATCCCGGGCGTG GCCATCGCCGCCAACATCATCCACGAGGGCTTCCACAAAAGCCGGAAG GTGATAGTGGTGGTGAGCCAGCACTTCATCCAGTCCAGGTGGTGCATA TTCGAGTACGAGATCGCCCAGACCTGGCAGTTCCTGTCCAGTAGGGCC GGCATCATCTTCATTGTGCTCCAGAAGGTGGAGAAGACCCTGCTGCGG CAGCAGGTCGAGCTGTACCGGCTGCTGTCCCGCAACACCTACCTGGAA TGGGAAGACAGCGTGCTGGGCCGGCACATCTTCTGGAGGCGGCTGAGG AAGGCCCTGCTGGACGGCAAGTCATGGAACCCCGAGGGCACCGTGGGC ACCGGCTGCAACTGGCAGGAGGCCACCAGCATC |
| 562 | TLR4ca-CO24 | ATGGCCGCCCCCGGCAGCGCCCGCCGTCCACTCTTGCTCCTCCTCCTT CTCCTCCTCCTTGGGCTCATGCATTGTGCCAGCGCGGCCATGCCAGTC CTCAGCCTCAATATCACCTGTCAGATGAACAAGACGATCATCGGCGTC AGCGTCCTTAGCGTACTCGTCGTCTCAGTGGTCGCCGTCCTTGTCTAT AAGTTTTATTTCCACCTCATGCTACTCGCCGGCTGTATCAAGTACGGC CGGGGCGAGAACATCTACGACGCCTTCGTCATCTACAGCTCTCAGGAC GAGGACTGGGTAAGGAATGAGCTGGTGAAGAACCTGGAGGAAGGGGTG |

TABLE 7-continued

| Sequence optimized ORFs encoding caTLR4 | | |
|---|---|---|
| SEQ ID NO | Name | Sequence |
| | | CCACCCTTCCAGCTGTGCCTGCACTACCGGGACTTCATCCCCGGGGTG GCCATCGCCGCCAACATCATCCACGAAGGGTTCCACAAGAGCAGGAAG GTGATAGTGGTGGTCAGCCAGCACTTCATCCAAAGCAGGTGGTGCATC TTCGAGTACGAGATCGCCCAGACCTGGCAGTTCCTTAGCAGCAGGGCC GGGATCATCTTCATCGTGCTGCAGAAGGTGGAGAAGACGCTCCTGAGG CAGCAAGTGGAGCTGTACAGGCTGCTGTCAAGGAACACCTACCTGGAG TGGGAGGACAGCGTGCTGGGCAGGCACATCTTTTGGCGGAGACTGAGG AAGGCCCTCCTGGACGGCAAGTCCTGGAACCCGGAGGGGACCGTGGGG ACGGGCTGCAACTGGCAGGAGGCCACCTCCATA |
| 563 | TLR4ca-CO25 | ATGGCCGCGCCCGGCAGCGCCAGGCGCCCCCTCCTCCTCCTATTACTC CTACTCCTCCTCGGCCTCATGCACTGCGCCTCGGCCGCCATGCCCGTC CTCTCCCTCAACATCACGTGCCAGATGAATAAGACCATCATCGGCGTC AGCGTCCTATCCGTCCTCGTCGTAAGCGTCGTTGCCGTACTCGTCTAC AAGTTCTATTTTCACCTAATGCTTCTCGCCGGGTGCATCAAGTACGGG AGGGGCGAGAACATCTACGACGCCTTCGTCATCTACTCGAGCCAGGAC GAGGACTGGGTCCGGAACGAGCTGGTGAAGAACCTGGAGGAGGGCGTG CCCCCCTTCCAGCTCTGCCTGCACTACCGGGATTTTATCCCCGGCGTG GCCATCGCCGCCAACATCATCCATGAGGGCTTCCATAAGTCCAGGAAG GTGATCGTGGTCGTGTCCCAGCACTTTATCCAGAGCAGGTGGTGCATC TTCGAGTACGAGATCGCCCAAACCTGGCAGTTTCTGAGCTCCCGGGCC GGCATCATCTTCATCGTACTGCAGAAGGTGGAGAAGACCCTGCTCAGG CAGCAGGTGGAGCTGTACCGCCTGCTCTCCAGGAACACCTACCTGGAG TGGGAGGACAGCGTCCTGGGAAGGCACATCTTCTGGCGGCGGCTCCGT AAGGCCCTGCTGGATGGAAAGAGCTGGAACCCCGAGGGCACCGTGGGG ACCGGCTGCAACTGGCAGGAGGCGACCTCCATC |

The sequence-optimized TLR4 polynucleotide sequences disclosed herein are distinct from the corresponding wild type TLR4 nucleotide acid sequences and from other known sequence-optimized nucleotide sequences, e.g., these sequence-optimized nucleic acids have unique compositional characteristics. See FIGS. 89A to 90.

In some embodiments, the percentage of uracil or thymine nucleobases in a sequence-optimized TLR4 polynucleotide sequence (e.g., encoding a TLR4, e.g., caTLR4, polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100.

In some embodiments, the sequence-optimized TLR4 polynucleotide sequence has a lower uracil or thymine content than the uracil or thymine content in the reference wild-type sequence. In some embodiments, the uracil or thymine content in a sequence-optimized nucleotide sequence is greater than the uracil or thymine content in the reference wild-type sequence and still maintain beneficial effects, e.g., increased expression and/or reduced TLR response when compared to the reference wild-type sequence.

The uracil or thymine content of wild-type caTLR4 is about 26%. In some embodiments, the uracil or thymine content of a uracil- or thymine-modified sequence encoding a caTLR4 polypeptide is less than 25%. In some embodiments, the uracil or thymine content of a uracil- or thymine-modified sequence encoding a caTLR4 polypeptide disclosed herein is less than 25%, less than 24%, less than 23%, less than 22%, less than 21%, less than 20%, less than 19%, less that 18%, less than 17%, or less than 16%. In some embodiments, the uracil or thymine content is not less than 18%, 17%, or 16. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding a caTLR4 polypeptide disclosed herein is between 16% and 25%, between 16% and 24%, between 17% and 24%, between 17% and 23%, between 18% and 23%, between 18% and 22%, between 19% and 22%, between 19% and 21%, between 19% and 21%, between 19% and 20%, or between 19% and 20%.

In some embodiments, the uracil or thymine content (% $U_{TL}$ or % $T_{TL}$) of a uracil- or thymine-modified sequence encoding a caTLR4 polypeptide disclosed herein is between 17% and 23%, between 17% and 22%, between 16% and 23%, between 16% and 22%, between 16% and 21%, between 17% and 21%, between 18% and 21%, between 18% and 20%, between 18% and 19%, between or between 19% and 20%.

In a particular embodiment, the uracil or thymine content (% $U_{TL}$ or % $T_{TL}$) of a uracil- or thymine modified sequence encoding a caTLR4 polypeptide disclosed herein is between about 18% and about 21% or 19% and 20%.

A uracil- or thymine-modified sequence encoding a caTLR4 polypeptide disclosed herein can also be described according to its uracil or thymine content relative to the uracil or thymine content in the corresponding wild-type nucleic acid sequence (% $U_{WT}$ Or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

In some embodiments, the % $U_{WT}$ or % $T_{WT}$ of a uracil- or thymine-modified sequence encoding a caTLR4 polypeptide disclosed herein is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding a caTLR4 polypeptide disclosed herein is between 60% and 88%, between 61% and 87%, between 62% and 86%, between 63% and 85%, between 64% and 84%, between 65% and 83%, between 66% and 82%, between 67% and 81%, between 68% and 80%, between 69% and 79%, or between 70% and 78%.

In some embodiments, the % $U_{WT}$ or % $T_{WT}$ of a uracil- or thymine-modified sequence encoding a caTLR4 polypeptide disclosed herein is between 68% and 79%, between 68% and 80%, between 68% and 81%, between 68% and 77%, between 69% and 77%, between 69% and 78%, between 69% and 79%, between 69% and 80%, between 69% and 81%, between 70% and 76%, between 70% and 77%, between 70% and 78%, or between 70% and 79.

In a particular embodiment, the % $U_{WT}$ or % $T_{WT}$ of a uracil- or thymine-modified sequence encoding a caTLR4 polypeptide disclosed herein is between about 70% and about 78%, e.g., between 70% and 77%.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, r % $T_{TL}$ with respect to DNA.

In some embodiments, the % $U_{TM}$ of a uracil-modified sequence encoding a caTLR4 polypeptide disclosed herein is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % UI of a uracil-modified sequence encoding a caTLR4 polypeptide disclosed herein is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%.

In some embodiments, the % $U_{TM}$ of a uracil-modified sequence encoding a caTLR4 polypeptide disclosed herein is between 122% and 124%, between 121% and 125%, between 120% and 126%, between 119% and 127%, between 118% and 128%, between 117% and 129%, between 116% and 130%, between 115% and 131%, between 114% and 132%, between 113% and 133%, between 112% and 134%, between 111% and 135%, or between 110% and 136%.

In some embodiments, the % $U_{TM}$ of a uracil-modified sequence encoding a caTLR4 polypeptide disclosed herein is between about 115% and about 129%, e.g., between 116% and 128%.

In some embodiments, a uracil-modified sequence encoding a TLR4 polypeptide, e.g., caTLR4, disclosed herein has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide.

Wild type caTLR4 contains 23 uracil pairs (UU), and 8 uracil triplets (UUU). In some embodiments, a uracil-modified sequence encoding a caTLR4 polypeptide disclosed herein has a reduced number of uracil triplets (UUU) with respect to the wild-type nucleic acid sequence. In some embodiments, a uracil-modified sequence encoding a caTLR4 polypeptide disclosed herein contains 8, 7, 6, 5, 4, 3, 2, 1 or no uracil triplets (UUU).

In some embodiments, a uracil-modified sequence encoding a TLR4 polypeptide, e.g., caTLR4, has a reduced number of uracil pairs (UU) with respect to the number of uracil pairs (UU) in the wild-type nucleic acid sequence. In some embodiments, a uracil-modified sequence encoding a TLR4 polypeptide, e.g., caTLR4, disclosed herein has a number of uracil pairs (UU) corresponding to the minimum possible number of uracil pairs (UU) in the wild-type nucleic acid sequence, e.g., 11 uracil pairs in the case of wild type caTLR4.

In some embodiments, a uracil-modified sequence encoding a TLR4 polypeptide, e.g., caTLR4, disclosed herein has at least 1, 2, 3, 4, 5, 6, 7, 8, 9, 10, 11, 12, or 13 uracil pairs (UU) less than the number of uracil pairs (UU) in the wild-type nucleic acid sequence. In some embodiments, a uracil-modified sequence encoding a caTLR4 polypeptide disclosed herein has between 10 and 22 uracil pairs (UU).

In some embodiments, a uracil-modified sequence encoding a TLR4 polypeptide, e.g., caTLR4, disclosed herein has a % $UU_{wt}$ less than 99%, less than 95%, less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding a TLR4 polypeptide, e.g., caTLR4, has a % $UU_{wt}$ between 99% and 38%. In a particular embodiment, a uracil-modified sequence encoding a TLR4 polypeptide, e.g., caTLR4, disclosed herein has a % $UU_{wt}$ between 43% and 96%.

In some embodiments, the TLR4 polynucleotide comprises a uracil-modified sequence encoding a TLR4 polypeptide, e.g., caTLR4, disclosed herein. In some embodiments, the uracil-modified sequence encoding a TLR4 polypeptide, e.g., caTLR4, comprises at least one chemically modified nucleobase, e.g., 5-methoxyuracil. In some embodiments, at least 95% of a nucleobase (e.g., uracil) in a uracil-modified sequence encoding a TLR4 polypeptide, e.g., caTLR4, are modified nucleobases. In some embodiments, at least 95% of uracil in a uracil-modified sequence encoding a TLR4 polypeptide, e.g., caTLR4, is 5-methoxyuracil. In some embodiments, the polynucleotide comprising a uracil-modified sequence further comprises a miRNA binding site, e.g., a miRNA binding site that binds to miR142 or miR122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding TLR4, e.g., caTLR4, with respect to the theoretical maximum guanine content of a nucleotide sequence encoding the TLR4 polypeptide, e.g., caTLR4," abbreviated as % $G_{TMX}$ is at least 69%, at least 70%, at least 75%, at least about 80%, at least about 85%, at least about 90%, at least about 95%, or about 100%. In some embodiments, the % $G_{TMX}$ is between about 70% and about 80%, between about 71% and about 79%, between about 71% and about 78%, or between about 71% and about 77%.

In some embodiments, the "cytosine content of the ORF relative to the theoretical maximum cytosine content of a nucleotide sequence encoding the TLR4 polypeptide, e.g., caTLR4," abbreviated as % $C_{TMX}$, is at least 59%, at least 60%, at least about 65%, at least about 70%, at least about 75%, at least about 80%, at least about 85%, at least about 90%, at least about 95%, or about 100%. In some embodiments, the % $C_{TMX}$ is between about 60% and about 80%, between about 62% and about 80%, between about 63% and about 79%, or between about 68% and about 76%.

In some embodiments, the "guanine and cytosine content (G/C) of the ORF relative to the theoretical maximum G/C content in a nucleotide sequence encoding the TLR4 polypeptide, e.g., caTLR4," abbreviated as % $G/C_{TMX}$ is at least about 81%, at least about 85%, at least about 90%, at least about 95%, or about 100%. The % $G/C_{TMX}$ is between about 80% and about 100%, between about 85% and about 99%, between about 90% and about 97%, or between about 91% and about 96%.

In some embodiments, the "G/C content in the ORF relative to the G/C content in the corresponding wild-type ORF," abbreviated as % $G/C_{WT}$ is at least 102%, at least 103%, at least 104%, at least 105%, at least 106%, at least 107%, at least 110%, at least 115%, or at least 120%.

In some embodiments, the average G/C content in the 3rd codon position in the ORF is at least 20%, at least 21%, at least 22%, at least 23%, at least 24%, at least 25%, at least 26%, at least 27%, at least 28%, at least 29%, or at least 30% higher than the average G/C content in the 3rd codon position in the corresponding wild-type ORF.

In some embodiments, the TLR4 polynucleotide comprises an open reading frame (ORF) encoding a TLR4 polypeptide, e.g., caTLR4, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

In some embodiments, the TLR4 polynucleotide (e.g., a RNA, e.g., a mRNA) comprises a nucleotide sequence (e.g., an ORF) encoding a TLR4 polypeptide, e.g., caTLR4, wherein the TLR4 polypeptide comprises an amino acid sequence at least 70%, at least 75%, at least 80%, at least 85%, at least 90%, at least 95%, at least 96%, at least 97%, at least 98%, at least 99%, or 100% identical to amino acids 30 to 251 of SEQ ID NO: 525.

In some embodiments, the TLR4 polynucleotide (e.g., a RNA, e.g., a mRNA) comprises a nucleotide sequence (e.g., an ORF) encoding a TLR4 polypeptide, e.g., caTLR4, wherein the TLR4 polypeptide comprises an amino acid sequence at least 60%, at least 65%, at least 70%, at least 75%, at least 80%, at least 85%, at least 90%, at least 95%, at least 96%, at least 97%, at least 98%, at least 99%, or 100% identical to SEQ ID NO: 525.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 85% to 100%, 90% to 100%, 95% to 100%, 80% to 95%, 85% to 95%, 85% to 90%, 90% to 95%, or 95% to 100% sequence identity to amino acids 30 to 251 of SEQ ID NO: 541.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 60% to 100%, 65% to 100%, 70% to 100%, 75% to 100%, 80% to 100%, 85% to 100%, 90% to 100%, 95% to 100%, 80% to 95%, 85% to 95%, 85% to 90%, 90% to 95%, or 95% to 100% sequence identity to SEQ ID NO: 541.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to amino acids 30 to 251 of SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 86% to 100%, 90% to 100%, 86% to 95%, 86% to 90%, 90% to 95%, or 95% to 100% sequence identity to amino acids 30 to 251 of SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 86% to 100%, 90% to 100%, 86% to 95%, 86% to 90%, 90% to 95%, or 95% to 100% sequence identity to SEQ ID NO: 539 or 549.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 87%, at least 88%, at least 89%, at least 90%, at least 91%, at least 92%, at least 93%, at least 94%, at least 95%, at least 96%, at least 97%, at least 98%, at least 99%, or 100% sequence identity to amino acids 30 to 251 of a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 87% to 100%, 90% to 100%, 87% to 95%, 87% to 90%, 90% to 95%, or 95% to 100% sequence identity to amino acids 30 to 251 of a sequence selected from the group consisting of SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 87% to 100%, 90% to 100%, 87% to 95%, 87% to 90%, 90% to 95%, or 95% to 100% sequence identity to SEQ ID NOs: 552, 554, and 556.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 88%, at least 89%, at least 90%, at least 91%, at least 92%, at least 93%, at least 94%, at least 95%, at least 96%, at least 97%, at least 98%, at least 99%, or 100% sequence identity to amino acids 30 to 251 of a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 88% to 100%, 90% to 100%, 88% to 95%, 88% to 90%, 90% to 95%, or 95% to 100% sequence identity to amino acids 30 to 251 of a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 88% to 100%, 90% to 100%, 88% to 95%, 88% to 90%, 90% to 95%, or 95% to 100% sequence identity to a sequence selected from the group consisting of SEQ ID NOs: 542, 543, 555, 557, 559, and 563.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 89%, at least 90%, at least 91%, at least 92%, at least 93%, at least 94%, at least 95%, at least 96%, at least 97%, at least 98%, at least 99%, or 100% sequence identity to amino acids 30 to 251 of a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 89% to 100%, 95% to 100%, or 89% to 95% sequence identity to amino acids 30 to 251 of a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 89% to 100%, 95% to 100%, or 89% to 95% sequence identity to a sequence selected from the group consisting of SEQ ID NOs: 546, 550, 551, 553, 561, and 562.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 90%, at least 91%, at least 92%, at least 93%, at least 94%, at least 95%, at least 96%, at least 97%, at least 98%, at least 99%, or 100% sequence identity to amino acids 30 to 251 of a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 90% to 100%, 90% to 95%, or 95% to 100% sequence identity to amino acids 30 to 251 of a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 90% to 100%, 90% to 95%, or 95% to 100% sequence identity to a sequence selected from the group consisting of SEQ ID NOs: 540, 544, 547, 548, and 558.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 91%, at least 92%, at least 93%, at least 94%, at least 95%, at least 96%, at least 97%, at least 98%, at least 99%, or 100% sequence identity to amino acids 30 to 251 of SEQ ID NOs: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has at least 80%, at least 85%, at least 91%, at least 92%, at least 93%, at least 94%, at least 95%, at least 96%, at least 97%, at least 98%, at least 99%, or 100% sequence identity to SEQ ID NOs: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 91% to 100%, 91% to 95%, or 95% to 100% sequence identity to amino acids 30 to 251 of SEQ ID NOs: 545 or 560.

In some embodiments, the TLR4 polynucleotide (e.g., a RNA, e.g., a mRNA) comprises a nucleotide sequence (e.g., an ORF) encoding a caTLR4 polypeptide, wherein the nucleotide sequence has 80% to 100%, 85% to 100%, 90% to 100%, 91% to 100%, 91% to 95%, or 95% to 100% sequence identity to SEQ ID NOs: 545 or 560.

Modified Nucleotide Sequences Encoding TLR4 Polypeptides:

In some embodiments, the TLR4 polynucleotide (e.g., a RNA, e.g., a mRNA) comprises a chemically modified nucleobase, e.g., 5-methoxyuracil. In some embodiments, the mRNA is a uracil-modified sequence comprising an ORF encoding a TLR4 polypeptide, e.g., caTLR4, wherein the mRNA comprises a chemically modified nucleobase, e.g., 5-methoxyuracil.

In certain embodiments, when the 5-methoxyuracil base is connected to a ribose sugar, as it is in polynucleotides, the resulting modified nucleoside or nucleotide is referred to as 5-methoxyuridine. In some embodiments, uracil in the TLR4 polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the TLR4 polynucleotide is at least 95% 5-methoxyuracil. In another embodiment, uracil in the TLR4 polynucleotide is 100% 5-methoxyuracil.

In embodiments where uracil in the TLR4 polynucleotide is at least 95% 5-methoxyuracil, overall uracil content can be adjusted such that an mRNA provides suitable protein expression levels while inducing little to no immune response. In some embodiments, the uracil content of the ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the theoretical minimum uracil content in the corresponding wild-type ORF (% $U_{TM}$). In other embodiments, the uracil content of the ORF is between about 117% and about 134% or between 118% and 132% of the % $U_{TM}$. In some embodiments, the uracil content of the ORF encoding a TLR4 polypeptide, e.g., caTLR4, is about 115%, about 120%, about 125%, about 130%, about 135%, about 140%, about 145%, or about 150% of the % $U_{TM}$. In this context, the term "uracil" can refer to 5-methoxyuracil and/or naturally occurring uracil.

In some embodiments, the uracil content in the ORF of the mRNA encoding a TLR4 polypeptide, e.g., caTLR4, of the disclosure is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 18% and about 21% of the total nucleobase content in the ORF. In one embodiment, the uracil content in the ORF of the mRNA encoding a TLR4 polypeptide, e.g., caTLR4, is less than about 21% of the total nucleobase content in the open reading frame. In this context, the term "uracil" can refer to 5-methoxyuracil and/or naturally occurring uracil.

In further embodiments, the ORF of the mRNA encoding a TLR4 polypeptide, e.g., caTLR4, having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF.

In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the TLR4 polypeptide, e.g., caTLR4(% $G_{TMX}$; % $C_{TMX}$, or % $G/C_{TMX}$).

In other embodiments, the G, the C, or the G/C content in the ORF is between about 70% and about 80%, between about 71% and about 79%, between about 71% and about 78%, between about 71% and about 77%, or between about 90% and about 95% of the % $G_{TMX}$, % $C_{TMX}$, or % $G/C_{TMX}$.

In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding a TLR4 polypeptide, e.g., caTLR4, comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the TLR4 polypeptide, e.g., caTLR4. In some embodiments, the ORF of the mRNA encoding a TLR4 polypeptide, e.g., caTLR4, contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the TLR4 polypeptide, e.g., caTLR4. In a particular embodiment, the ORF of the mRNA encoding the TLR4 polypeptide, e.g., caTLR4, of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the TLR4 polypeptide, e.g., caTLR4, contains no non-phenylalanine uracil pairs and/or triplets.

Polynucleotide Comprising an mRNA Encoding a TLR4 Polypeptide:

In certain embodiments, a TLR4 polynucleotide of the present disclosure, for example a TLR4 polynucleotide comprising an mRNA nucleotide sequence encoding a TLR4 polypeptide, e.g., caTLR4, comprises from 5' to 3' end:

(i) a 5' UTR, such as the sequences provided below, comprising a 5' cap provided below;

(ii) an open reading frame encoding a TLR4 polypeptide, e.g., caTLR4, (e.g., a sequence optimized nucleic acid sequence encoding TLR4, e.g., caTLR4, disclosed herein);

(iii) at least one stop codon;

(iv) a 3' UTR, such as the sequences provided below; and (v) a poly-A tail provided below.

In some embodiments, the TLR4 polynucleotide further comprises a miRNA binding site, e.g, a miRNA binding site that binds to miRNA-122. In some embodiments, the 3'UTR comprises the miRNA binding site.

In some embodiments, a TLR4 polynucleotide of the present disclosure comprises a nucleotide sequence encoding a TLR4 polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of caTLR4.

Compositions and Formulations for Use Comprising TLR4 Polynucleotides:

Certain aspects of the disclosure are directed to compositions or formulations comprising any of the TLR4 polynucleotides disclosed above.

In some embodiments, the composition or formulation comprises:

(i) a TLR4 polynucleotide (e.g., a RNA, e.g., a mRNA) comprising a sequence-optimized nucleotide sequence (e.g., an ORF) encoding a caTLR4 polypeptide (e.g., the wild-type sequence, functional fragment, or variant thereof), wherein the TLR4 polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the TLR4 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a TLR4 nucleotide sequence encoding the caTLR4 polypeptide (% $U_{TM}$ or % $T_{TM}$), is between about 100% and about 150%.

In some embodiments, the TLR4 polynucleotides, compositions or formulations above are used to treat a cancer.

D. Interleukin 18 (IL18)

In some embodiments, the combination therapies disclosed herein comprise one or more IL18 polynucleotides (e.g., mRNAs). As used herein, the term "IL polynucleotide" refers to a polynucleotide (e.g., an mRNA) comprising an ORF encoding an IL18 polypeptide disclosed herein.

Interleukin-18 ("IL18"), also known as interferon-gamma inducing factor, is a key regulator of immune responses and inflammation. IL18 is constitutively expressed in several cell types, including dendritic cells and macrophages. IL18 works by binding to the IL18 receptor, and together with IL12, it induces cell-mediated immunity by stimulating natural killer (NK) cells and some types of T-cells to produce the cytokine interferon-γ (INF-γ), which plays an important role in activating macrophages and other immune cells. Dinarello, C. A. et al., *Frontiers in Immunology* 4:article 289 (2013).

IL18 has also been found to induce strong inflammatory reactions and its expression has been associated with systemic lupus, rheumatoid arthritis, Type-1 diabetes, Crohn's disease, psoriasis and graft versus host disease. Id. However, in some disease models, such as age-related macular degeneration and some cancer models, expression of IL18 has been found to be protective rather than causative. Doyle, S. L. et al. *Sci Transl Med* 6 (230): 230ra44(2014).

The ability of IL18 to activate NK cells has been studied as a method for targeting cancer cells with the immune system. Fabbi, M. et al., *J. Leukocyte Biol.* 97: 665-675 (2015). However, certain studies have suggested that IL18 may support tumor progression in advanced gastric cancer. Indeed, it stimulates the production of the proangiogenic factor, thrombospondin-1, in IL18R-expressing gastric cancer cells through the activation of the c-Jun N-terminal kinase. Kim, J. et al., (2006) *Biochem. Biophys. Res. Commun.* 344, 1284-1289. In another study, VEGF stimulates IL18 production and processing in gastric cancer cells, and IL18, in turn, promotes cell migration through tensin down-regulation and actin polymerization. Kim, K. E. et al., (2007) *Oncogene* 26, 1468-1476.

Other studies have also indicated that IL18 converts a subset of Kit− NK cells into Kit+ NK cells, which overexpress PD-L1 and mediate immune-ablative functions, in mouse models. Indeed, the silencing of IL18 in tumors or its blockade by IL18BP restores NK cell-dependent immune surveillance. Terme, M. et al., (2012) *Cancer Res.* 72, 2757-2767. Therefore, there remains a need to identify an improved IL18 product that has an anti-tumor efficacy without the pro-tumor effect.

The wild type IL18 gene encodes a 192 amino acid preprotein. The preprotein is cleaved by caspase-1 to remove the 35 amino acid signal peptide, leaving a mature protein 157 amino acids in length. Gracie, J. A. et al., *J. Leukocyte Biol.* 73:213-224 (2003). See also, GenBank Accession Numbers NM_001562.3 for the *Homo sapiens* interleukin-18 isoform 1 precursor mRNA sequence and NP_001553.1 for the corresponding IL18 isoform 1 preprotein. Following cleavage by caspase-1, mature IL18 is secreted from the cell in which it was formed. In one embodiment, the polynucleotide of the disclosure encodes a mature IL18 polypeptide.

IL18 signaling occurs through a heterodimeric receptor present on NK cells and some types of T cells. IL18 first binds with low affinity to the IL18 receptor alpha chain (IL18Ra) followed by recruitment of IL18 receptor beta chain (IL18Rβ) to form a high affinity complex. Gracie, J. A. et al., *J. Leukocyte Biol.* 73:213-224 (2003). This heterotrimer complex interacts with Toll-Interleukin-1 receptor (TIR) which recruits MyD88, IRAK and TRAF-6 to cause the degradation of IκB, activation of NFκB and subsequent activation of proinflammatory genes. Dinarello, C. A. et al., *Frontiers in Immunology* 4:article 289 (2013). Therefore, the IL18 polypeptide encoded by the polynucleotides can bind to an IL18 receptor alpha chain and/or form a heterodimer with the IL18Rα chain and the IL18Rβ chain.

The coding sequence (CDS) for the wild type IL18 mRNA sequence, isoform 1, is described at the NCBI Reference Sequence database (RefSeq) under accession number NM_001562.3 ("*Homo sapiens* interleukin 18 (IL18), transcript variant 1, mRNA"). In one embodiment, the polynucleotide of the disclosure encodes the wild-type IL18 polypeptide, isoform 1. The wild type IL18 protein sequence, isoform 1, is described at the RefSeq database under accession number NP_001553.1 ("interleukin-18 isoform 1 precursor [*Homo sapiens*]").

"IL18 polypeptide" as used herein refers to a mature IL18 polypeptide or a variant, mutant, or derivative thereof that has one or more IL18 function. In one embodiment, the IL18 polypeptide can comprise a signal peptide that is heterologous to the mature IL18 polypeptide. In another embodiment, an IL18 polypeptide comprises a signal peptide that is naturally occurring within the mature IL18 polypeptide. IL18 isoform 2 lacks an in-frame coding exon compared to isoform 1. Isoform 2 is shorter and can be resistant to proteolytic activation, compared to isoform 1. Wild type IL18 isoform 2 mRNA is described at the RefSeq database under accession number NM_001243211.1 ("*Homo sapiens* interleukin 18 (IL18), transcript variant 2, mRNA") and the wild type IL18 isoform 2 protein is described in the RefSeq database under accession number NP_001230140.1 ("interleukin-18 isoform 2 [*Homo sapiens*]"). Isoform 1 is 193 amino acids in length and isoform 2 is 189 amino acids in length.

In some embodiments, sequence tags or amino acids, can be added to the sequences encoded by the polynucleotides of the disclosure (e.g., at the N-terminal or C-terminal ends), e.g., for localization. In some embodiments, amino acid residues located at the carboxy, amino terminal, or internal regions of an IL18 polypeptide disclosed herein can optionally be deleted providing for fragments.

In some embodiments, the IL18 polynucleotide (e.g., a RNA, e.g., a mRNA) comprising a nucleotide sequence (e.g., an ORF) encoding IL18 encodes a substitutional variant of an IL18 isoform 1 or 2 sequence, which can comprise one, two, three or more than three substitutions. In some embodiments, the substitutional IL18 variant can comprise one or more conservative amino acids substitutions. In other embodiments, the IL18 variant is an insertional variant. In other embodiments, the variant is a deletional variant.

Certain compositions and methods presented in this disclosure refer to polynucleotide sequences comprising an ORF encoding TL 8, or to IL18 proteins or polypeptides. A person skilled in the art will understand that such disclosures are equally applicable to human IL18, isoform 1, as well as any other isoforms of IL18 known in the art.

In some embodiments, the IL18 polypeptide comprises an amino acid sequence at least about 80%, at least about 85%, at least about 90%, at least about 95%, at least about 95%, about 96%, at least about 97%, at least about 98%, at least about 99%, or about 100% identical to amino acids 37 to 193 of SEQ ID NO: 564, or SEQ ID NO: 566.

The IL18 polynucleotides (e.g., a RNA, e.g., a mRNA) disclosed herein can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the IL18 polynucleotide (e.g., a RNA, e.g., a mRNA) comprises a nucleotide sequence (e.g., an ORF) that encodes a signal peptide operably linked a nucleotide sequence that encodes an IL18 polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the IL18 polypeptide, respectively. Addition of these sequences results in trafficking the encoded IL18 polypeptide to a desired site, such as the endoplasmic reticulum or the mitochondria through one or more targeting pathways. Some signal peptides are cleaved from the protein, for example by a signal peptidase after the proteins are transported to the desired site.

Any heterologous signal sequence known in the art can be used in the present disclosure. In one embodiment, a signal peptide useful for the disclosure is a naturally occurring IL18 signal peptide.

In another embodiment, a signal peptide useful for the disclosure is a signal peptide of human IL2 protein. In some embodiment, the signal peptide comprises an amino acid sequence at least about 70%, at least about 80%, at least about 85%, at least about 90%, at least about 95%, at least about 95%, about 96%, at least about 97%, at least about 98%, at least about 99%, or about 100% identical to

```
(SEQ ID NO: 568)
MYRMQLLSCIALSLALVTNS.
```

In another embodiment, a signal peptide useful for the disclosure is a signal peptide is a human Lambda signal peptide. In some embodiment, the signal peptide comprises an amino acid sequence at least about 70%, at least about 80%, at least about 85%, at least about 90%, at least about 95%, at least about 95%, about 96%, at least about 97%, at least about 98%, at least about 99%, or about 100% identical to

```
(SEQ ID NO: 569)
MAWTVLLLGLLSHCTGSVTS.
```

In another embodiment, a signal peptide useful for the disclosure is a signal peptide is a human IL1ra signal peptide. In some embodiment, the signal peptide comprises an amino acid sequence at least about 70%, at least about 80%, at least about 85%, at least about 90%, at least about 95%, at least about 95%, about 96%, at least about 97%, at least about 98%, at least about 99%, or about 100% identical to

```
(SEQ ID NO: 570)
MEICRGLRSHLITLLLFLFHSETIC.
```

In another embodiment, a signal peptide useful for the disclosure is a signal peptide of tissue plasminogen activator (tPA). In other embodiments, the signal peptide comprises an amino acid sequence having at least about 80%, at least about 85%, at least about 90%, at least about 95%, at least about 95%, about 96%, at least about 97%, at least about 98%, at least about 99%, or about 100% identical to

```
(SEQ ID NO: 571)
MDAMKRGLCCVLLLCGAVFVSPSQEIHARFRRGAR.
```

In certain embodiments, the IL18 polypeptide comprises one or more amino acid substitutions, mutations, deletions, or insertions. In one embodiment, the IL18 polypeptide comprises one or more amino acid substitutions or mutations that allow a cleavage by a caspase enzyme. In another embodiment, the IL18 polypeptide comprises one or more amino acid substitutions or mutations at the caspase cleavage site. In other embodiments, the one or more amino acid substitutions or mutations are at amino acids 71 corresponding to SEQ ID NO: 564 (full-length wild type IL18, isoform 1), at amino acid 76 corresponding to SEQ ID NO: 564 (full-length wild type IL18 isoform 1), or at amino acids 71 and 76 corresponding to SEQ ID NO: 564. In some embodiments, the amino acid substitutions or mutations are D71S, D76N, or both D71S and D76N. In some embodiments, the IL18 comprises SEQ ID NO: 578 (IL18 double mutant) without the signal peptide.

In other embodiments, the IL18 polypeptide can be a fusion protein, which is fused to one or more heterologous polypeptides.

In some embodiments, the IL18 polynucleotides disclosed herein can comprise an ORF encoding any IL18 polypeptide disclosed herein, e.g., an IL18 polypeptide encoded by a sequence-optimized IL18 polynucleotides disclosed herein or by a nucleotide sequence comprising a sequence-optimized IL18 polynucleotides disclosed herein.

IL18 Polynucleotides and Open Reading Frames (ORFs):

The IL18 polynucleotides used in the combination therapies disclose herein include any IL18 polynucleotides (e.g., DNA or RNA, e.g., mRNA) provided in the present disclosure. In certain embodiments, the IL18 polynucleotide (e.g., a RNA, e.g., a mRNA) that comprise a nucleotide sequence (e.g., an ORF) encoding one or more IL18 polypeptides, e.g., IL18 polynucleotides.

In some embodiments, the IL18 polynucleotide can encode:

(i) a mature IL18 polypeptide (e.g., having the same or essentially the same length as wild-type IL18 isoform 1 or 2) with or without a signal peptide;

(ii) a functional fragment of any of the IL18 isoforms described herein (e.g., a truncated (e.g., deletion of carboxy, amino terminal, or internal regions) sequence shorter than one of wild-type isoforms 1 or 2; but still retaining IL18 activity);

(iii) a variant thereof (e.g., full-length, mature, or truncated IL18 isoform 1 or 2 proteins in which one or more amino acids have been replaced, e.g., D71S, D76N, or both D71S and D76N, or variants that retain all or most of the IL18 activity of the polypeptide with respect to a reference isoform;

(iv) an IL18 polypeptide of any one of (i) to (iii) fused to a signal peptide, e.g., tPA signal peptide, IL2 signal peptide, human immunoglobulin Lambda chain (hIgLC) signal peptide, human interleukin-1 receptor antagonist (hIL-1ra) signal peptide, or any combination thereof.

(v) a fusion protein comprising (i) the mature IL18 polypeptide, a functional fragment or a variant thereof, and (ii) a heterologous protein.

In certain embodiments, the encoded IL18 polypeptide, is a mammalian IL18 polypeptide, such as a human IL18 polypeptide, a functional fragment or a variant thereof.

In some embodiments, the IL18 polynucleotide (e.g., a RNA, e.g., a mRNA) increases IL18 protein expression levels and/or detectable IL18 activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to IL18 protein expression levels and/or detectable IL18 activity levels in the cells prior to the administration of the IL18 polynucleotide. The IL18 protein expression levels and/or IL18 activity can be measured according to methods know in the art. In some embodiments, the IL18 polynucleotide is introduced to the cells in vitro. In some embodiments, the IL18 polynucleotide is introduced to the cells in vivo.

In some embodiments, the IL18 polynucleotide (e.g., a RNA, e.g., a mRNA) comprises a codon optimized nucleic acid sequence, wherein the open reading frame (ORF) of the codon optimized nucleic sequence is derived from a wild-type IL18 sequence. For example, for IL18 polynucleotides comprising a sequence optimized ORF encoding IL18, the corresponding wild type sequence is the native IL18.

In some embodiments, the IL18 polynucleotide (e.g., a RNA, e.g., a mRNA) comprises a nucleotide sequence (e.g., an ORF) that encodes a IL18 polypeptide with mutations that do not alter IL18 activity. Such mutant IL18 polypeptides can be referred to as function-neutral. In some embodiments, the IL18 polynucleotide comprises an ORF that encodes a mutant IL18 polypeptide comprising one or more function-neutral point mutations.

In some embodiments, the mutant IL18 polypeptide has higher IL18 activity than the corresponding wild-type IL18. In some embodiments, the mutant IL18 polypeptide has an IL18 activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type IL18.

In some embodiments, the IL18 polynucleotide (e.g., a RNA, e.g., a mRNA) comprises a nucleotide sequence (e.g., an ORF) encoding an IL18 fragment that has higher IL18 activity than the corresponding full-length IL18. Thus, in some embodiments the IL18 fragment has an IL18 activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the IL18 activity of the corresponding full-length TL 8.

In some embodiments, the IL18 polynucleotide (e.g., a RNA, e.g., a mRNA) comprises a nucleotide sequence (e.g., an ORF) encoding an IL18 polypeptide that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, or 25% shorter than the amino acid sequence as set forth in amino acids 30 to 251 of SEQ ID NO: 564, 566, 572, 574, 576, 577 or 578 (with or without signal peptide).

In other embodiments, the IL18 polynucleotide (e.g., a RNA, e.g., a mRNA) encodes an amino acid sequence having 85% to 100%, 90% to 100%, 95% to 100%, 80% to 95%, 85% to 95%, 85% to 90%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 85% to 100%, 90% to 100%, 95% to 100%, 80% to 95%, 85% to 95%, 85% to 90%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 86% to 100%, 90% to 100%, 86% to 95%, 86% to 90%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 87% to 100%, 90% to 100%, 87% to 95%, 87% to 90%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 88% to 100%, 90% to 100%, 88% to 95%, 88% to 90%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 89% to 100%, 95% to 100%, or 89% to 95% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 90% to 100%, 90% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises a nucleotide sequence (e.g., an ORF) encoding an IL18 polypeptide, wherein the nucleotide sequence has 91% to 100%, 91% to 95%, or 95% to 100% sequence identity to SEQ ID NO: 564, 566, 572, 574, 576, 577 or 578 (with or without signal peptide).

In some embodiments, the IL18 polynucleotide (e.g., a RNA, e.g., a mRNA) comprises from about 500 to about 100,000 nucleotides (e.g., from 500 to 650, from 500 to 675, from 500 to 700, from 500 to 725, from 500 to 750, from 500 to 775, from 500 to 800, from 500 to 900, from 500 to 1000, from 500 to 1100, from 500 to 1200, from 500 to 1300, from 500 to 1400, from 500 to 1500, from 567 to 800, from 567 to 900, from 567 to 1000, from 567 to 1100, from 567 to 1200, from 567 to 1300, from 567 to 1400, from 567 to 1500, from 579 to 800, from 579 to 900, from 579 to 1000, from 579 to 1200, from 579 to 1400, from 579 to 1600, from 579 to 1800, from 579 to 2000, from 579 to 3000, from 579 to 5000, from 579 to 7000, from 579 to 10,000, from 579 to 25,000, from 579 to 50,000, from 579 to 70,000, or from 579 to 100,000.).

In some embodiments, the IL18 polynucleotide (e.g., a RNA, e.g., a mRNA) comprises a nucleotide sequence (e.g., an ORF) encoding an IL18 polypeptide, wherein the length of the nucleotide sequence (e.g., an ORF) is at least 300 nucleotides in length (e.g., at least or greater than about 300, 400, 500, 567, 579, 600, 700, 750, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 7000, 8000, 9000, 10,000, 20,000, 30,000, 40,000, 50,000, 60,000, 70,000, 80,000, 90,000 or up to and including 100,000 nucleotides).

In some embodiments, the IL18 polynucleotide (e.g., a RNA, e.g., a mRNA) comprises a nucleotide sequence (e.g., an ORF) encoding an IL18 polypeptide that further comprises at least one nucleic acid sequence that is noncoding, e.g., a miRNA binding site.

In some embodiments, the IL18 polynucleotide (e.g., a RNA, e.g., a mRNA) comprises a nucleotide sequence (e.g., an ORF) encoding an IL18 polypeptide that is single stranded or double stranded.

In some embodiments, the IL18 polynucleotide comprising a nucleotide sequence (e.g., an ORF) encoding an IL18 polypeptide is DNA or RNA. In some embodiments, the IL18 polynucleotide is RNA. In some embodiments, the IL18 polynucleotide is, or functions as, a messenger RNA (mRNA). In some embodiments, the mRNA comprises a nucleotide sequence (e.g., an ORF) that encodes at least one IL18 polypeptide, and is capable of being translated to produce the encoded IL18 polypeptide in vitro, in vivo, in situ or ex vivo.

In some embodiments, the IL18 polynucleotide (e.g., a RNA, e.g., a mRNA) comprises a sequence-optimized nucleotide sequence (e.g., an ORF) encoding an IL18 polypeptide (e.g., the wild-type sequence, functional fragment, or variant thereof), wherein the polynucleotide comprises at least one chemically modified nucleobase, e.g., 5-methoxyuracil. In some embodiments, the IL18 polynucleotide further comprises a miRNA binding site, e.g., a miRNA binding site that binds to miR-122. In some embodiments, the polynucleotide disclosed herein is formulated with a delivery agent, e.g., a compound having Formula (I), e.g., any of Compounds 1-147.

IL18 Fusion Proteins:

In some embodiments, the IL18 polynucleotide (e.g., a RNA, e.g., a mRNA) can comprise more than one nucleic acid sequence (e.g., an ORF) encoding a polypeptide of interest. In some embodiments, IL18 polynucleotides disclosed herein comprise a single ORF encoding an IL18 polypeptide, a functional fragment, or a variant thereof. However, in some embodiments, the IL18 polynucleotides disclosed herein can comprise more than one ORF, for example, a first ORF encoding an IL18 polypeptide (a first polypeptide of interest), a functional fragment, or a variant thereof, and a second ORF expressing a second polypeptide of interest. In some embodiments, two or more polypeptides of interest can be genetically fused, i.e., two or more polypeptides can be encoded by the same ORF. In some embodiments, the IL18 polynucleotide can comprise a nucleic acid sequence encoding a linker (e.g., a $G_4S$ peptide linker or another linker known in the art) between two or more polypeptides of interest.

In some embodiments, the IL18 polynucleotide (e.g., a RNA, e.g., a mRNA) can comprise two, three, four, or more ORFs, each expressing a polypeptide of interest.

In some embodiments, the IL18 polynucleotide (e.g., a RNA, e.g., a mRNA) can comprise a first nucleic acid sequence (e.g., a first ORF) encoding an IL18 polypeptide and a second nucleic acid sequence (e.g., a second ORF) encoding a second polypeptide of interest.

Sequence-Optimized Nucleotide Sequences Encoding IL18 Polypeptides:

In some embodiments, the IL18 polynucleotide (e.g., a RNA, e.g., a mRNA) comprises a sequence-optimized nucleotide sequence encoding an IL18 polypeptide disclosed herein. In some embodiments, the IL18 polynucleotide (e.g., a RNA, e.g., a mRNA) comprises an open reading frame (ORF) encoding an IL18 polypeptide, wherein the ORF has been sequence optimized.

Exemplary sequence-optimized nucleotide sequences encoding IL18, are shown in TABLE 8. In some embodiments, the sequence optimized IL18, sequences in TABLE 8, fragments, and variants thereof are used to practice the methods disclosed herein.

TABLE 8

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 579 | tPA_IL18-WT amino acid sequence | MDAMKRGLCCVLLLCGAVFVSPSQEIHARFRRGARYFGKLESKLSVIR NLNDQVLFIDQGNRPLFEDMTDSDCRDNAPRTIFIISMYKDSQPRGMA VTISVKCEKISTLSCENKIISFKEMNPPDNIKDTKSDIIFFQRSVPGH DNKMQFESSSYEGYFLACEKERDLFKLILKKEDELGDRSIMFTVQNED |
| 580 | tPA_IL18-WT nucleotide sequence | ATGGATGCAATGAAGAGAGGGCTCTGCTGTGTGCTGCTGCTGTGTGGA GCAGTCTTCGTTTCGCCCAGCCAGGAAATCCATGCCCGATTCAGAAGA GGAGCCAGATACTTTGGCAAGCTTGAATCTAAATTATCAGTCATAAGA AATTTGAATGACCAAGTTCTCTTCATTGACCAAGGAAATCGGCCTCTA TTTGAAGATATGACTGATTCTGACTGTAGAGATAATGCACCCCGGACC ATATTTATTATAAGTATGTATAAAGATAGCCAGCCTAGAGGTATGGCT GTAACTATCTCTGTGAAGTGTGAGAAAATTTCAACTCTCTCCTGTGAG AACAAAATTATTTCCTTTAAGGAAATGAATCCTCCTGATAACATCAAG GATACAAAAAGTGACATCATATTCTTTCAGAGAAGTGTCCCAGGACAT GATAATAAGATGCAATTTGAATCTTCATCATACGAAGGATACTTTCTA GCTTGTGAAAAAGAGAGAGACCTTTTTAAACTCATTTTGAAAAAAGAG GATGAATTGGGGGATAGATCTATAATGTTCACTGTTCAAAACGAAGAC |
| 581 | IL2sp_IL18-WT | MYRMQLLSCIALSLALVTNSYFGKLESKLSVIRNLNDQVLFIDQGNRP LFEDMTDSDCRDNAPRTIFIISMYKDSQPRGMAVTISVKCEKISTLSC ENKIISFKEMNPPDNIKDTKSDIIFFQRSVPGHDNKMQFESSSYEGYF LACEKERDLFKLILKKEDELGDRSIMFTVQNED |
| 582 | IL2sp_IL18-WT | ATGTACAGGATGCAACTCCTGTCTTGCATTGCACTAAGTCTTGCACTT GTCACAAACAGTTACTTTGGCAAGCTTGAATCTAAATTATCAGTCATA AGAAATTTGAATGACCAAGTTCTCTTCATTGACCAAGGAAATCGGCCT CTATTTGAAGATATGACTGATTCTGACTGTAGAGATAATGCACCCCGG ACCATATTTATTATAAGTATGTATAAAGATAGCCAGCCTAGAGGTATG GCTGTAACTATCTCTGTGAAGTGTGAGAAAATTTCAACTCTCTCCTGT GAGAACAAAATTATTTCCTTTAAGGAAATGAATCCTCCTGATAACATC AAGGATACAAAAAGTGACATCATATTCTTTCAGAGAAGTGTCCCAGGA CATGATAATAAGATGCAATTTGAATCTTCATCATACGAAGGATACTTT CTAGCTTGTGAAAAAGAGAGAGACCTTTTTAAACTCATTTTGAAAAAA GAGGATGAATTGGGGGATAGATCTATAATGTTCACTGTTCAAAACGAA GAC |
| 583 | tPA_IL18 | ATGGACGCCATGAAGAGGGGCCTCTGCTGCGTCCTATTGCTCTGCGGG GCCGTCTTCGTCTCCCCCAGCCAGGAGATCCACGCCCGGTTTAGGAGG GGGGCGAGGTACTTCGGGAAGCTCGAGAGCAAGCTCAGCGTAATCAGG AACTTGAACGACCAAGTCCTCTTTATCGACCAGGGTAACCGTCCCCTC TTCGAGGACATGACCGACTCCGATTGCCGCGACAACGCCCCGCGGACC ATCTTTATCATCAGCATGTACAAGGACTCCCAGCCGAGGGGGATGGCC GTCACAATCAGCGTCAAATGCGAGAAGATCTCGACCCTGAGCTGCGAG AACAAAATCATCTCCTTTAAGGAGATGAATCCCCCGGACAACATAAAG GACACCAAGTCGGACATCATCTTCTTCCAGAGGTCGGTCCCTGGCCAC GACAACAAAATGCAGTTCGAGAGCTCCAGCTACGAGGGCTATTTCCTC GCCTGCGAGAAGGAGAGGGACCTGTTCAAGCTCATCCTGAAGAAGGAG GACGAGCTGGGCGACAGGTCGATCATGTTCACTGTGCAGAACGAGGAC |
| 584 | tPA_IL18 | ATGGACGCGATGAAGCGGGGCCTCTGCTGCGTACTCCTACTCTGCGGG GCCGTCTTCGTGTCCCCGTCCCAGGAGATCCACGCCAGGTTCCGGAGG GGGGCGCGGTACTTCGGAAAGCTTGAGAGCAAGCTCTCAGTCATCCGA AATCTCAACGACCAGGTACTCTTCATCGACCAGGGCAACCGCCCCTTG TTCGAGGATATGACCGACTCCGACTGCCGGGACAACGCCCCCCGGACC ATTTTCATCATAAGCATGTACAAGGACTCCCAGCCCCGGGGCATGGCG GTAACCATCAGCGTCAAGTGCGAGAAGATCTCCACCCTGTCCTGCGAA AACAAGATCATCAGCTTCAAGGAGATGAACCCTCCCGACAACATCAAG GACACCAAGAGCGACATCATCTTCTTCCAGAGGAGCGTCCCCGGCCAC GACAACAAGATGCAGTTCGAGTCCAGTAGCTACGAGGGCTACTTCCTG GCCTGCGAGAAGGAGAGGGATCTGTTTAAGCTCATCCTCAAGAAGGAG GACGAGCTGGGGGACCGCAGCATCATGTTTACGGTGCAGAACGAGGAC |
| 585 | tPA_IL18 | ATGGACGCCATGAAGAGGGGCCTCTGCTGCGTCCTACTCCTCTGCGGC GCCGTCTTCGTGAGCCCCTCGCAGGAAATCCACGCGAGGTTCAGGCGG GGCGCCAGGTACTTCGGCAAGCTCGAGTCGAAGCTTAGCGTCATCCGC AACCTCAACGACCAGGTCCTCTTCATCGACCAGGGCAACCGCCCCCTC TTCGAAGATATGACCGACAGCGACTGCAGGGACAACGCCCCCAGGACC ATCTTCATCATCAGCATGTACAAGGACTCCCAGCCCCGGGGGATGGCC GTTACCATCAGCGTGAAATGCGAGAAGATCAGCACCCTTAGCTGCGAG AACAAGATCATCTCCTTCAAGGAGATGAACCCGCCCGATAACATCAAG GACACCAAGTCGGACATCATCTTCTTCCAACGTAGCGTGCCCGGCCAC GACAACAAGATGCAGTTTGAGAGTTCCAGCTACGAGGGCTACTTCCTC GCCTGCGAGAAGGAGCGCGACCTGTTCAAGCTCATCCTGAAAAAAGAG GATGAGCTGGGGGACAGGTCCATCATGTTCACTGTGCAGAACGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 586 | tPA_IL18 | ATGGACGCGATGAAGCGGGGGCTCTGCTGCGTCCTACTCTTGTGCGGC GCCGTCTTCGTGTCCCCCAGCCAGGAAATCCACGCCAGGTTCAGGAGG GGCGCCAGGTATTTCGGAAAGCTCGAGAGCAAGCTCAGCGTCATCAGA AACCTCAACGACCAGGTCCTCTTCATCGATCAGGGCAACCGGCCCCTC TTCGAGGATATGACCGACAGCGACTGCAGGGACAACGCCCCCCGGACC ATCTTCATCATCTCCATGTACAAGGATAGCCAGCCCAGGGGCATGGCC GTCACAATCTCCGTGAAGTGCGAGAAGATCAGCACCCTGAGCTGCGAA AATAAGATCATCTCCTTCAAGGAGATGAATCCCCCCGATAACATTAAG GACACCAAGTCCGACATCATCTTCTTCCAGAGGAGCGTCCCCGGACAT GACAATAAGATGCAGTTCGAGAGCTCCAGCTATGAGGGCTATTTCCTG GCCTGCGAAAAGGAAAGGGACCTGTTCAAGCTGATCCTGAAGAAGGAA GATGAGCTGGGGGACCGGTCCATCATGTTCACAGTCCAGAACGAGGAC |
| 587 | tPA_IL18 | ATGGACGCCATGAAGCGCGGTCTTTGCTGCGTACTCCTTCTCTGCGGC GCCGTCTTCGTGTCGCCGAGTCAGGAGATCCACGCGCGCTTCAGGAGG GGGGCCCGGTACTTCGGCAAGTTGGAGAGCAAGCTCTCGGTCATACGC AACCTCAACGACCAGGTTCTCTTTATCGACCAGGGCAATAGGCCCCTC TTCGAAGACATGACCGACTCCGACTGCAGGGACAACGCCCCCCGGACC ATCTTTATCATCAGCATGTATAAAGACAGCCAGCCCCGAGGGATGGCC GTCACCATCTCCGTCAAATGCGAGAAGATCTCCACGCTGTCCTGCGAG AACAAGATCATTTCCTTCAAGGAGATGAACCCCCCTGACAACATCAAG GACACCAAGTCCGACATCATCTTCTTCCAAAGGAGCGTGCCCGGCCAC GACAACAAGATGCAGTTCGAGAGCAGCTCCTACGAAGGATACTTCCTC GCATGTGAGAAGGAGCGCGATCTGTTCAAGCTGATCCTGAAGAAGGAG GACGAGCTGGGGGATAGGTCCATCATGTTTACGGTGCAGAACGAGGAC |
| 588 | tPA_IL18 | ATGGACGCCATGAAGCGGGGCCTTTGCTGCGTCTTGCTTCTCTGCGGC GCCGTTTTCGTCTCCCCCAGCCAAGAGATCCACGCCAGGTTCAGGAGG GGGGCCAGGTACTTCGGTAAGCTCGAGAGCAAGCTCTCGGTCATCAGG AACTTGAACGACCAGGTCCTCTTCATCGACCAGGGCAACCGGCCCCTC TTCGAGGACATGACCGACAGCGACTGCAGGGACAACGCCCCCAGAACG ATCTTCATCATCTCGATGTACAAGGACAGCCAGCCCCGCGGCATGGCC GTCACCATCTCCGTCAAGTGCGAGAAGATCAGCACGCTGTCCTGCGAG AATAAAATCATCTCCTTCAAGGAGATGAACCCACCCGACAACATCAAG GACACCAAGAGCGACATCATCTTCTTCCAGCGTAGCGTGCCCGGCCAC GACAACAAGATGCAGTTCGAGAGCAGCAGCTACGAGGGCTACTTTCTC GCCTGCGAGAAGGAGCGCGACCTGTTTAAGCTGATCCTCAAAAAGGAG GACGAGCTCGGCGACAGGTCCATCATGTTCACGGTGCAGAACGAGGAC |
| 589 | tPA_IL18 | ATGGACGCGATGAAGCGGGGCCTCTGCTGCGTCCTACTCTTGTGCGGA GCCGTCTTCGTTTCACCGAGCCAGGAGATCCACGCGCGTTTCCGGAGG GGCGCCCGATATTTCGGGAAGCTCGAAAGCAAGCTCAGCGTCATCCGC AACCTCAACGACCAGGTCCTCTTCATCGACCAGGGGAACAGGCCCCTG TTCGAAGACATGACCGACTCCGACTGCCGGGACAACGCCCCCCGCACC ATTTTCATCATCAGCATGTACAAAGACAGCCAGCCCCGGGGCATGGCC GTCACAATCTCCGTGAAGTGTGAAAAGATCTCCACCCTGTCGTGCGAG AACAAGATCATCAGCTTCAAGGAGATGAACCCGCCCGACAACATCAAG GACACCAAGTCCGATATTATCTTCTTCCAGAGGAGCGTGCCCGGCCAC GACAACAAGATGCAGTTCGAAAGCTCGAGCTACGAGGGCTACTTCCTG GCCTGTGAGAAGGAGCGTGATCTCTTCAAGCTGATCCTCAAGAAGGAG GACGAGCTCGGCGATAGGAGCATCATGTTTACGGTGCAGAACGAGGAC |
| 590 | tPA_IL18 | ATGGACGCCATGAAGAGGGGCCTCTGCTGCGTCCTCCTCCTCTGCGGC GCCGTTTTCGTGAGCCCCAGCCAGGAGATCCACGCCCGTTTCAGGAGG GGAGCCCGGTATTTCGGCAAGCTTGAGAGCAAGCTCAGCGTCATCAGG AACCTAAACGACCAGGTTCTATTCATCGACCAGGGCAACAGACCCCTA TTCGAGGACATGACCGATAGCGACTGTCGGGACAACGCCCCACGGACC ATCTTCATCATCAGCATGTACAAGGATAGCCAGCCCAGGGGCATGGCC GTCACCATCTCCGTGAAGTGTGAGAAGATCTCCACCCTGAGCTGTGAG AACAAAATCATCAGCTTCAAGGAGATGAACCCGCCCGATAATATCAAG GACACCAAGAGCGATATCATCTTCTTCCAGAGGAGCGTGCCGGGCCAC GACAACAAGATGCAGTTCGAGTCCTCCAGCTACGAGGGTTACTTCCTC GCCTGCGAGAAGGAACGTGACCTGTTCAAGCTCATCCTCAAAAAGGAG GATGAGCTGGGGGACAGGAGCATAATGTTCACCGTGCAGAACGAAGAC |
| 591 | tPA_IL18 | ATGGACGCGATGAAGAGGGGCCTCTGTTGTGTCCTCCTCCTCTGCGGG GCGGTCTTCGTCAGCCCCAGCCAGGAGATCCACGCCCGCTTCCGCCGG GGCGCCCGGTACTTCGGCAAGCTCGAAAGCAAGTTGAGCGTTATCAGG AACCTCAACGACCAAGTCCTTTTCATCGACCAAGGCAATAGGCCCCTC TTCGAGGACATGACCGACAGCGACTGCCGGGACAACGCCCCGCGGACC ATCTTCATCATCTCCATGTATAAGGACTCCCAGCCCAGGGGCATGGCC GTCACCATCTCCGTGAAGTGTGAGAAGATCTCCACCCTGTCCTGCGAG AACAAAATCATCAGCTTCAAGGAGATGAACCCGCCCGATAACATCAAA GACACGAAGTCGGATATAATCTTCTTCCAGAGGAGCGTGCCCGGGCAT |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GACAATAAGATGCAGTTCGAAAGCAGCTCCTACGAGGGCTACTTCCTC<br>GCCTGCGAGAAGGAACGGGATCTATTCAAGCTGATCCTGAAAAAAGAG<br>GACGAGCTGGGCGACCGCAGCATCATGTTCACCGTGCAGAACGAGGAC |
| 592 | tPA_IL18 | ATGGACGCCATGAAACGCGGTCTGTGCTGCGTTCTCCTCCTCTGCGGG<br>GCCGTCTTCGTTAGCCCCAGCCAGGAGATCCACGCCCGCTTCAGGAGG<br>GGCGCGAGGTATTTCGGCAAGTTGGAAAGCAAGCTCTCGGTCATCCGA<br>AACTTGAACGATCAGGTCCTCTTCATCGACCAGGGCAACAGGCCCCTC<br>TTCGAGGACATGACCGACAGCGACTGCCGGGATAACGCCCCCCGGACC<br>ATCTTCATCATCAGCATGTATAAGGACAGCCAGCCCCGCGGCATGGCC<br>GTCACCATCAGCGTGAAGTGCGAGAAAATCAGCACCCTGAGCTGCGAG<br>AACAAGATCATCTCCTTCAAGGAGATGAACCCGCCCGACAACATCAAG<br>GATACCAAAAGCGACATAATCTTCTTCCAGAGGTCGGTACCCGGCCAT<br>GACAACAAGATGCAGTTCGAGAGCAGCTCCTATGAGGGCTACTTCCTG<br>GCCTGCGAGAAGGAGAGGGATCTGTTTAAGCTCATCCTCAAGAAAGAA<br>GATGAGCTGGGGGACCGCAGCATCATGTTCACCGTGCAAAATGAGGAC |
| 593 | tPA_IL18 | ATGGACGCCATGAAGAGGGGCCTCTGTTGCGTCCTTCTCCTCTGCGGC<br>GCCGTATTCGTCAGCCCCAGCCAGGAGATACACGCCAGGTTCCGGAGG<br>GGCGCCCGGTATTTCGGAAAGCTCGAGAGCAAGCTCAGCGTCATCCGG<br>AACCTCAACGACCAGGTCCTCTTCATCGACCAGGGGAATCGGCCCTTG<br>TTCGAGGACATGACCGATTCCGACTGCAGAGATAACGCGCCCAGGACG<br>ATCTTCATCATCTCCATGTATAAGGACAGCCAGCCAAGGGGCATGGCC<br>GTCACCATCAGCGTGAAGTGCGAGAAGATCAGCACCCTGAGCTGCGAG<br>AACAAAATCATCTCCTTCAAGGAGATGAACCCGCCCGACAACATCAAG<br>GACACCAAGTCCGACATAATCTTTTTCCAGCGCAGCGTGCCCGGCCAT<br>GACAACAAGATGCAGTTCGAGAGCTCCTCCTACGAAGGCTACTTCCTG<br>GCCTGCGAGAAGGAGAGGGACCTGTTCAAGCTGATCCTGAAGAAGGAG<br>GACGAGCTGGGCGACCGGAGCATAATGTTCACCGTGCAGAACGAAGAC |
| 594 | tPA_IL18 | ATGGACGCCATGAAGCGGGGCTTATGTTGTGTCCTTCTCTTGTGCGGC<br>GCCGTATTCGTGAGCCCGAGCCAGGAGATCCACGCCCGCTTCAGGCGG<br>GGGGCGCGATACTTCGGCAAGCTCGAGAGCAAGCTCTCGGTTATCCGC<br>AACCTCAACGACCAGGTCCTCTTCATCGACCAGGGCAACCGTCCCCTC<br>TTCGAGGATATGACGGATTCAGATTGCAGGGACAACGCCCCCCGCACG<br>ATATTCATCATCAGCATGTACAAGGACAGCCAGCCCCGCGGCATGGCC<br>GTCACGATAAGCGTCAAGTGCGAAAAGATCAGCACCCTGAGCTGTGAG<br>AACAAGATCATCTCCTTCAAGGAAATGAACCCGCCGGACAACATCAAG<br>GACACGAAAAGCGACATCATATTCTTCCAAAGGAGCGTGCCCGGCCAC<br>GACAACAAGATGCAGTTCGAGTCCAGCAGCTACGAGGGCTACTTTCTG<br>GCCTGCGAAAAAGAACGCGACCTGTTCAAGCTGATCCTGAAGAAGGAG<br>GATGAGCTGGGGGACAGGAGCATCATGTTCACCGTGCAGAACGAGGAC |
| 595 | tPA_IL18 | ATGGACGCCATGAAACGCGGCCTCTGCTGCGTTCTCCTCCTCTGCGGC<br>GCGGTCTTCGTCAGCCCCAGCCAGGAGATTCACGCCCGCTTCAGAAGG<br>GGCGCCCGGTACTTCGGGAAGCTCGAGAGCAAGCTCAGCGTCATCAGG<br>AACTTGAACGATCAGGTTCTTTTCATCGATCAGGGGAACAGGCCCCTC<br>TTCGAGGACATGACAGACAGCGACTGTCGGGACAACGCCCCTAGAACC<br>ATCTTCATCATCAGCATGTACAAGGATTCCCAGCCCAGGGGCATGGCC<br>GTCACTATCAGCGTCAAGTGTGAGAAAATCTCCACCCTGAGCTGCGAG<br>AACAAAATCATCTCGTTCAAGGAGATGAACCCACCCGACAACATCAAA<br>GATACCAAGAGCGACATCATCTTCTTCCAACGGTCCGTGCCCGGCCAT<br>GATAACAAGATGCAGTTCGAGTCCTCCAGCTATGAAGGCTACTTCCTG<br>GCCTGCGAGAAGGAGAGGGACCTGTTCAAGCTGATCCTGAAGAAGGAG<br>GATGAGCTCGGCGACAGGAGCATCATGTTCACCGTGCAGAACGAGGAC |
| 596 | tPA_IL18 | ATGGACGCTATGAAGCGGGGCCTCTGCTGTGTCCTCCTCCTCTGTGGG<br>GCCGTCTTCGTGTCCCCGAGCCAGGAAATCCACGCCCGTTTTAGGAGG<br>GGGGCCCGGTACTTCGGCAAGCTCGAGAGCAAGCTCAGCGTCATAAGG<br>AATCTCAACGACCAGGTCCTCTTCATCGACCAAGGCAACCGGCCACTC<br>TTCGAAGATATGACGGACTCAGACTGCAGGGACAACGCTCCCCGCACG<br>ATCTTCATAATCTCCATGTATAAGGACTCGCAGCCCAGGGGCATGGCC<br>GTCACCATCTCCGTGAAGTGCGAGAAGATCTCCACCCTGAGCTGCGAG<br>AACAAAATCATCAGCTTCAAGGAGATGAACCCCCCGGACAACATCAAA<br>GACACGAAGTCCGACATAATCTTCTTCCAGCGGAGCGTGCCGGGCCAC<br>GACAATAAAATGCAGTTCGAATCCAGCTCCTACGAGGGCTACTTCCTG<br>GCCTGCGAGAAGGAGAGGGACCTGTTCAAGCTGATCCTGAAGAAGGAG<br>GACGAGCTGGGGGACCGGTCGATCATGTTCACGGTGCAGAATGAGGAC |
| 597 | tPA_IL18 | ATGGACGCGATGAAGCGGGGCCTCTGCTGTGTCCTCCTACTCTGCGGG<br>GCCGTCTTCGTTAGCCCGAGCCAGGAGATCCACGCCAGGTTCAGGCGC<br>GGCGCCCGATACTTCGGCAAGCTCGAGTCCAAGCTCTCCGTCATCCGG<br>AACCTCAACGACCAAGTCCTCTTCATCGACCAGGGCAACCGGCCGCTG<br>TTCGAGGACATGACCGACTCCGACTGTCGGGACAACGCCCCCAGGACC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | ATCTTCATCATCAGTATGTATAAGGACTCCCAGCCCAGAGGCATGGCC GTCACCATCAGCGTGAAATGCGAGAAGATCAGCACCCTGAGCTGCGAG AATAAGATCATCAGCTTCAAGGAAATGAACCCCCCGGATAATATCAAA GACACGAAGTCGGACATCATCTTCTTCCAGAGGAGCGTCCCCGGCCAC GACAACAAGATGCAGTTCGAGAGCAGCAGCTATGAGGGGTACTTCCTG GCGTGCGAGAAGGAGAGGGATCTGTTCAAGCTCATCCTCAAGAAGGAG GACGAGCTGGGGGACAGGTCGATCATGTTCACCGTTCAGAACGAGGAC |
| 598 | tPA_IL18 | ATGGACGCCATGAAGCGGGGCCTATGCTGTGTTCTCCTCCTCTGTGGC GCCGTCTTCGTGAGCCCCAGCCAGGAAATCCACGCGAGGTTCAGGCGG GGCGCCCGGTACTTCGGGAAGCTCGAGTCCAAGCTCAGCGTAATCCGA AACCTAAACGACCAGGTCTTGTTCATCGACCAGGGCAACCGGCCCCTC TTCGAGGACATGACCGACAGCGACTGCCGGGACAACGCCCCCAGGACC ATATTCATCATCAGCATGTACAAGGACAGCCAGCCCAGGGGTATGGCC GTCACGATTAGCGTCAAGTGCGAGAAGATCTCCACGCTCAGCTGCGAG AACAAGATCATCAGCTTCAAGGAGATGAATCCACCCGACAATATCAAG GACACCAAAAGCGACATCATCTTCTTTCAGCGTTCCGTGCCCGGCCAC GACAACAAGATGCAGTTCGAGTCCAGCAGCTACGAAGGTTACTTCCTG GCCTGCGAAAAAGAAAGGGACCTGTTCAAGCTCATCCTGAAGAAAGAG GATGAGCTGGGCGACAGGAGCATCATGTTTACGGTGCAGAACGAGGAC |
| 599 | tPA_IL18 | ATGGACGCCATGAAGAGGGGCTTATGCTGCGTACTCCTCCTATGCGGC GCCGTTTTCGTGAGCCCCAGCCAGGAGATCCACGCCCGGTTCCGGAGG GGGGCCAGGTACTTCGGTAAGCTGGAGTCCAAGCTCTCCGTCATCCGG AACTTGAACGATCAGGTCCTTTTCATCGACCAGGGCAACAGGCCCTTA TTCGAGGACATGACGGACTCCGACTGCAGGGATAACGCCCCGAGGACC ATCTTCATCATCAGCATGTACAAGGACAGCCAGCCCAGGGGCATGGCG GTCACCATCAGCGTGAAGTGCGAGAAGATTTCCACCCTGAGCTGCGAG AACAAGATCATCAGCTTCAAAGAGATGAACCCGCCGGACAATATCAAG GACACGAAGTCCGACATCATCTTTTTCCAGCGGTCCGTCCCGGGACAC GACAACAAGATGCAGTTTGAGTCGAGCTCTTACGAAGGCTATTTCCTT GCCTGCGAGAAGGAGCGGGATCTCTTCAAACTGATCCTGAAGAAGGAG GACGAGCTGGGGGACCGGTCCATCATGTTTACCGTCCAAAACGAAGAC |
| 600 | tPA_IL18 | ATGGACGCCATGAAACGGGGCCTCTGCTGCGTCCTCCTACTTTGCGGC GCCGTCTTCGTAAGCCCCAGCCAGGAGATCCACGCCAGGTTTCGGCGC GGCGCCAGGTACTTCGGGAAACTCGAGTCCAAGCTCAGCGTCATCAGG AACCTTAACGACCAGGTCCTCTTCATCGACCAGGGCAACAGGCCGCTG TTCGAGGACATGACCGACTCCGACTGCCGCGACAACGCCCCGAGGACC ATCTTTATTATCAGCATGTACAAGGACTCCCAGCCCCGCGGAATGGCC GTCACCATCTCCGTGAAGTGCGAGAAAATCTCCACCCTGAGCTGTGAG AACAAGATCATCAGCTTCAAGGAGATGAACCCGCCCGACAATATCAAG GACACCAAGTCGGACATCATCTTCTTTCAGAGGTCCGTCCCCGGCCAC GATAACAAGATGCAGTTCGAGTCCAGCTCCTACGAGGGTTACTTCCTC GCCTGCGAGAAGGAGAGGGACCTGTTCAAGCTGATCCTGAAAAAGGAG GACGAGCTGGGCGATCGCAGCATCATGTTCACGGTGCAGAACGAAGAT |
| 601 | tPA_IL18 | ATGGACGCCATGAAGCGCGGACTCTGCTGCGTCCTCCTCCTCTGCGGG GCGGTCTTCGTTAGCCCCAGCCAGGAGATTCACGCCCGGTTCCGTAGG GGCGCGAGATACTTCGGGAAGCTCGAGTCCAAGCTATCAGTCATCAGG AACCTAAACGACCAGGTCCTCTTCATCGACCAGGGCAACAGGCCCCTC TTCGAGGACATGACCGATAGCGACTGTCGCGACAACGCGCCCCGGACC ATCTTTATCATCAGCATGTACAAGGATAGCCAGCCCAGGGGCATGGCC GTCACCATCTCGGTGAAGTGTGAGAAAATCAGCACCCTCTCATGTGAA AACAAGATCATCAGCTTCAAAGAGATGAATCCCCCCGACAACATCAAG GACACCAAGAGCGACATCATCTTCTTCCAGCGTTCGGTGCCCGGCCAT GACAACAAGATGCAGTTCGAGTCCAGCTCCTACGAGGGCTACTTCCTG GCCTGCGAGAAGGAGAGGGACCTGTTCAAACTGATCCTCAAGAAGGAG GACGAGCTGGGCGACAGGAGCATTATGTTCACGGTGCAGAACGAGGAC |
| 602 | tPA_IL18 | ATGGACGCGATGAAGAGGGGGCTCTGCTGTGTCCTCTTATTGTGCGGG GCAGTCTTCGTCTCCCCCAGCCAGGAGATCCACGCCCGATTTAGGAGG GGCGCCCGGTACTTCGGGAAGCTCGAGAGCAAGTTGAGCGTGATCCGG AACCTCAACGACCAGGTCCTCTTTATCGACCAGGGCAACAGACCGCTG TTCGAGGACATGACCGACAGCGATTGCCGCGACAACGCCCCCAGGACC ATCTTCATCATCAGCATGTACAAGGATAGCCAACCGCGGGGGATGGCC GTCACCATCAGCGTGAAATGTGAGAAGATCAGCACGCTGAGCTGTGAG AACAAGATCATCTCCTTCAAGGAAATGAATCCCCCCGACAACATCAAA GACACTAAGAGCGACATCATCTTCTTCCAGCGCAGCGTGCCCGGCCAC GATAACAAGATGCAGTTCGAGAGCAGCTCCTACGAGGGCTACTTCCTG GCCTGTGAGAAGGAGAGGGATCTGTTCAAGCTGATCCTGAAGAAGGAG GACGAGCTCGGGGATCGGAGCATCATGTTCACCGTGCAGAACGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 603 | tPA_IL18 | ATGGACGCCATGAAACGGGGTTTGTGCTGCGTCCTCTTGCTCTGCGGG GCCGTATTCGTTTCCCCCAGCCAGGAGATCCACGCCCGGTTCAGGCGG GGCGCCAGGTACTTCGGGAAGCTCGAGAGTAAGCTAAGCGTCATCCGT AACCTCAACGACCAGGTCCTCTTCATCGATCAGGGCAACAGGCCCCTC TTCGAGGACATGACCGATAGCGACTGCCGGGACAACGCCCCCCGGACC ATCTTTATCATCAGCATGTACAAGGACAGCCAGCCCAGAGGGATGGCC GTCACCATCAGCGTGAAGTGCGAGAAAATCTCCACACTGTCATGCGAG AACAAGATCATCTCCTTTAAGGAGATGAATCCGCCTGACAACATAAAG GACACCAAGTCCGACATCATCTTCTTCCAACGGAGCGTACCCGGCCAT GATAACAAGATGCAGTTCGAGAGCAGCAGCTACGAGGGCTACTTCCTG GCCTGCGAAAAGGAGCGAGATCTCTTCAAGCTGATCCTGAAGAAGGAG GACGAGCTGGGCGACCGCAGCATTATGTTCACGGTGCAGAACGAGGAT |
| 604 | tPA_IL18 | ATGGACGCCATGAAGAGGGGCCTTTGTTGTGTCCTCCTCCTCTGCGGG GCCGTCTTCGTGAGCCCCTCGCAAGAGATCCACGCCCGGTTTAGGCGG GGCGCCCGGTACTTCGGGAAGCTTGAAAGCAAGCTCAGCGTTATCCGC AACCTCAACGATCAGGTCCTTTTCATCGATCAGGGCAACCGCCCCCTC TTCGAGGATATGACCGACTCCGATTGCAGGGATAACGCCCCCAGGACC ATCTTTATCATCAGCATGTACAAGGACAGCCAGCCCAGGGGCATGGCC GTAACCATCAGCGTGAAGTGCGAAAAGATTTCCACCCTCTCCTGCGAG AACAAAATCATCTCCTTCAAGGAGATGAATCCCCCTGACAATATCAAG GACACCAAGAGCGACATCATCTTTTTCCAGAGGTCCGTGCCCGGACAC GACAACAAGATGCAGTTCGAGAGCTCCAGCTACGAAGGCTACTTCCTG GCCTGCGAGAAAGAGCGGGACCTGTTCAAGCTAATCCTGAAGAAGGAA GATGAGCTGGGCGATCGGAGCATCATGTTCACCGTCCAAAACGAGGAT |
| 605 | tPA_IL18 | ATGGACGCGATGAAGCGAGGGCTCTGCTGCGTCCTCCTCCTCTGCGGC GCCGTCTTCGTCAGCCCCAGCCAGGAGATCCACGCCAGGTTCAGGAGG GGGGCTAGGTATTTCGGGAAGCTTGAGTCCAAGCTCTCCGTTATCAGG AACCTCAACGACCAGGTCCTCTTCATCGACCAGGGCAACCGGCCCCTC TTCGAGGACATGACCGACAGCGACTGCAGGGACAACGCCCCCAGGACC ATCTTCATCATCAGCATGTACAAGGATTCCCAGCCAAGGGGCATGGCC GTCACAATCTCCGTGAAGTGTGAGAAAATCAGCACCCTGAGCTGCGAA AACAAGATAATCAGCTTCAAGGAGATGAACCCGCCCGATAACATCAAG GACACCAAGAGCGATATCATTTTCTTCCAGCGCAGCGTGCCCGGCCAT GACAACAAGATGCAGTTCGAAAGCTCGAGCTATGAGGGCTACTTCCTG GCCTGCGAGAAGGAGAGGGACCTGTTCAAGCTCATCCTGAAGAAGGAG GATGAGCTGGGGGACAGGAGCATTATGTTCACGGTCCAGAACGAGGAC |
| 606 | tPA_IL18 | ATGGACGCCATGAAGAGGGGGGTTGTGCTGCGTCCTTCTCCTCTGCGGG GCCGTCTTCGTGAGCCCGAGCCAGGAGATACACGCCAGGTTCAGGAGG GGCGCCCGCTATTTCGGCAAGCTTGAAAGCAAGCTCAGCGTCATCCGG AACCTCAACGACCAGGTCCTCTTTATCGACCAGGGGAACAGGCCCTTG TTCGAGGATATGACGGACTCCGACTGTAGGGACAACGCCCCCCGAACC ATCTTTATCATCAGCATGTACAAGGACAGCCAGCCCAGGGGCATGGCC GTCACGATCAGCGTGAAGTGCGAGAAAATCAGCACACTCAGCTGTGAG AACAAGATCATCAGCTTTAAAGAGATGAACCCGCCCGACAACATCAAG GACACCAAGAGCGACATCATCTTCTTCCAGCGCAGTGTGCCCGGCCAC GATAACAAAATGCAGTTCGAGTCCAGCAGCTACGAGGGCTACTTCCTG GCCTGTGAGAAGGAGAGGGACCTGTTCAAGCTGATCCTGAAGAAGGAG GATGAGCTCGGCGACAGGAGCATCATGTTTACGGTGCAGAACGAGGAC |
| 607 | tPA_IL18 | ATGGACGCCATGAAGAGGGGACTCTGCTGCGTACTCCTTCTCTGCGGC GCCGTCTTCGTCAGCCCGAGCCAGGAAATCCACGCCCGGTTCCGGCGG GGGGCCAGGTACTTCGGCAAGCTCGAGAGCAAGCTCAGCGTCATCCGG AACCTCAACGATCAGGTCCTCTTCATCGACCAGGGCAACAGGCCCCTC TTCGAGGACATGACGGACAGCGACTGCAGAGACAACGCCCCGAGGACT ATCTTCATCATCAGCATGTACAAGGACAGCCAGCCCCGCGGCATGGCG GTCACCATTTCGGTGAAGTGCGAGAAGATAAGCACGCTCAGCTGCGAA AACAAGATCATCTCCTTTAAGGAGATGAACCCGCCGGACAACATCAAG GACACCAAGAGCGACATCATCTTCTTCCAGAGGAGCGTGCCCGGCCAC GACAATAAGATGCAGTTCGAGTCCTCCAGCTATGAGGGTTACTTCCTG GCCTGCGAGAAGGAGAGGGACCTGTTCAAACTGATACTGAAGAAGGAA GACGAGCTGGGCGATAGGTCCATAATGTTCACCGTGCAGAACGAGGAC |
| 608 | IL18_WT | ATGGCCGCCGAGCCAGTTGAAGACAACTGCATCAACTTCGTCGCCATG AAGTTTATCGACAACACGCTCTACTTTATCGCCGAGGACGACGAGAAT CTCGAGTCCGACTACTTCGGCAAACTCGAGAGCAAGCTCAGCGTCATC CGGAACCTAAACGACCAGGTCCTTTTCATCGACCAGGGCAACAGGCCG CTGTTCGAAGACATGACCGACTCCGATTGCAGGGATAACGCCCCCGAGG ACCATATTCATCATCTCGATGTATAAGGACTCCCAGCCCAGGGGCATG GCCGTCACGATCTCCGTGAAGTGCGAGAAGATCTCCACCCTCTCCTGC GAGAACAAGATCATCTCCTTCAAGGAGATGAATCCCCCCGACAACATA AAGGACACCAAGTCCGACATTATCTTCTTCCAGAGGAGCGTGCCTGGC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CATGACAACAAGATGCAGTTCGAGTCCAGCTCCTACGAGGGCTACTTC CTGGCCTGCGAGAAGGAGCGGGACCTGTTCAAGCTGATCCTCAAGAAG GAGGACGAGCTGGGGGATAGGTCCATCATGTTCACCGTGCAGAACGAG GAC |
| 609 | IL18_WT | ATGGCCGCCGAGCCCGTCGAGGATAACTGCATCAACTTCGTTGCCATG AAGTTCATCGACAACACGCTCTACTTCATCGCGGAGGACGACGAGAAC CTCGAGTCCGATTACTTCGGCAAGCTTGAGTCCAAGCTTAGCGTCATC AGGAATCTCAACGACCAGGTTTTGTTCATCGACCAGGGCAACAGGCCC CTATTCGAAGACATGACCGATTCAGACTGTCGGGACAACGCCCCCAGG ACCATCTTCATAATAAGCATGTACAAGGATTCCCAGCCCAGGGGCATG GCCGTCACCATCTCCGTGAAGTGCGAGAAGATCTCCACCCTCAGCTGC GAGAATAAGATCATCTCCTTCAAGGAGATGAACCCGCCCGACAACATC AAGGACACTAAGTCCGACATCATCTTCTTCCAGAGGAGCGTCCCCGGC CATGATAACAAGATGCAGTTCGAGAGCAGCAGCTACGAGGGGTACTTC CTGGCCTGCGAGAAGGAGAGGGATCTGTTCAAGCTCATCCTCAAAAAG GAGGACGAGCTGGGGGACAGGTCCATCATGTTCACCGTGCAGAACGAG GAC |
| 610 | IL18_WT | ATGGCGGCCGAGCCCGTCGAAGACAACTGCATCAACTTCGTCGCCATG AAGTTCATCGACAACACACTCTACTTCATCGCCGAGGACGACGAGAAC CTCGAGAGCGACTACTTCGGGAAACTCGAGAGCAAGCTATCCGTCATC AGGAACCTCAACGACCAGGTCCTCTTCATCGACCAGGGCAACAGGCCC CTCTTCGAGGACATGACGGATAGCGATTGCAGGGATAACGCCCCTAGG ACCATCTTCATCATCTCCATGTACAAGGACAGCCAGCCGAGAGGCATG GCGGTCACCATTTCCGTGAAGTGCGAGAAGATCAGCACCCTGAGCTGC GAGAACAAGATCATCAGCTTTAAAGAGATGAACCCGCCGGACAACATA AAAGACACTAAGAGCGACATCATCTTCTTCCAGAGGAGCGTCCCCGGC CACGACAACAAGATGCAGTTCGAGTCCAGCAGCTACGAGGGGTACTTC CTGGCCTGCGAGAAGGAGAGGGATCTGTTCAAGCTGATCCTCAAGAAA GAGGACGAGCTGGGTGACCGAAGCATCATGTTCACCGTGCAGAACGAG GAC |
| 611 | IL18_WT | ATGGCGGCCGAGCCAGTCGAGGACAACTGCATCAATTTCGTCGCCATG AAGTTCATCGACAACACCTTGTACTTCATCGCCGAGGACGACGAGAAC CTCGAGAGCGATTACTTCGGCAAGCTCGAGAGCAAGTTGAGCGTAATC AGGAACTTGAACGACCAGGTCCTCTTCATCGACCAGGGCAACAGGCCC CTTTTCGAGGATATGACCGACAGCGACTGCAGGGACAACGCGCCTCGC ACCATCTTTATCATCAGCATGTACAAGGATTCCCAGCCCAGGGGGATG GCCGTCACCATATCGGTGAAGTGCGAGAAAATCTCCACCCTGAGCTGC GAGAACAAGATCATCAGCTTTAAGGAGATGAATCCCCCCGACAATATC AAGGACACCAAGTCCGACATCATCTTCTTCCAGAGGTCGGTCCCCGGT CACGATAATAAGATGCAGTTTGAGTCCAGCTCCTACGAGGGCTACTTT CTGGCCTGCGAGAAGGAGCGGGACCTGTTCAAACTGATTCTGAAGAAG GAGGACGAGCTGGGGGATAGGAGCATCATGTTCACCGTCCAAAACGAG GAC |
| 612 | IL18_WT | ATGGCCGCCGAGCCCGTAGAGGATAACTGCATCAACTTCGTTGCCATG AAGTTCATCGACAACACGTTGTACTTCATCGCCGAGGACGACGAGAAC CTCGAGTCCGATTACTTCGGCAAGCTCGAGAGCAAACTTTCCGTCATT AGGAATCTCAACGACCAGGTCCTCTTCATCGACCAGGGCAATAGGCCC CTCTTCGAGGACATGACCGACTCCGACTGCAGGGACAACGCCCCCAGG ACCATCTTCATCATCTCCATGTACAAGGACAGCCAGCCCCGGGGCATG GCCGTCACCATCAGCGTGAAGTGCGAAAAGATCAGCACCCTGAGCTGT GAGAACAAGATCATCAGCTTCAAGGAGATGAACCCGCCCGACAACATC AAGGACACGAAGTCCGATATCATCTTCTTCCAACGCTCCGTGCCCGGC CACGACAACAAGATGCAGTTCGAATCCAGCTCATACGAGGGGTACTTC CTGGCGTGCGAGAAGGAGAGAGATCTGTTCAAGCTGATCCTGAAAAAG GAGGACGAGCTGGGCGACAGGAGCATCATGTTCACGGTCCAGAACGAG GAC |
| 613 | IL18_WT | ATGGCCGCCGAGCCCGTCGAGGACAACTGCATCAACTTCGTAGCGATG AAGTTCATCGACAATACCCTCTACTTCATCGCCGAGGACGACGAGAAC CTCGAGAGCGACTACTTCGGCAAACTCGAGAGCAAGCTCAGCGTCATC AGGAACTTGAACGACCAAGTCCTCTTCATAGATCAGGGCAACAGGCCC CTCTTCGAGGATATGACCGATAGCGACTGCCGGGACAACGCCCCCGAGG ACCATCTTCATCATCAGCATGTACAAGGACAGCCAGCCCAGGGGCATG GCGGTCACCATCTCGGTGAAGTGCGAGAAGATCTCCACCCTGAGCTGT GAGAACAAGATCATCAGCTTCAAGGAGATGAACCCTCCCGACAACATC AAGGACACCAAAAGCGATATAATCTTCTTTCAGAGGAGCGTGCCCGGC CACGACAACAAGATGCAGTTTGAGTCCTCGAGCTACGAGGGCTACTTC CTGGCATGCGAAAAGGAACGGGACCTGTTCAAGCTGATCCTGAAGAAA GAGGACGAGCTGGGGGACCGGAGCATCATGTTCACCGTGCAGAATGAG GAT |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 614 | IL18_WT | ATGGCCGCCGAGCCCGTAGAAGATAACTGCATCAACTTCGTCGCGATG AAGTTTATCGACAATACGCTATACTTCATCGCCGAGGACGACGAAAAC CTCGAGTCCGACTACTTCGGAAAGCTTGAGAGCAAGCTCAGCGTCATC CGGAACCTCAACGACCAGGTCCTCTTTATCGACCAGGGCAACCGGCCG CTGTTCGAGGACATGACCGACTCCGACTGCCGGGACAACGCCCCGCGA ACCATATTCATCATCAGCATGTACAAGGACAGCCAGCCCCGCGGCATG GCCGTAACTATCAGCGTCAAGTGCGAGAAGATCAGCACCCTGAGCTGC GAAAATAAGATCATCTCCTTTAAGGAGATGAACCCGCCCGATAACATC AAGGATACCAAGTCCGACATCATCTTTTTCCAGAGGAGCGTGCCCGGC CACGATAATAAGATGCAGTTCGAGAGCAGCAGCTACGAGGGGTACTTC CTGGCCTGCGAGAAGGAGAGGGATCTCTTCAAGCTGATCCTGAAGAAA GAGGATGAACTGGGCGACAGAAGCATCATGTTCACCGTGCAAAACGAG GAC |
| 615 | IL18_WT | ATGGCCGCCGAGCCCGTTGAGGACAACTGCATTAACTTCGTCGCGATG AAGTTCATCGATAACACCCTCTACTTCATCGCCGAGGACGACGAGAAC CTCGAGAGCGATTACTTCGGGAAGCTTGAATCCAAGCTCAGCGTAATC AGGAACCTTAACGACCAGGTCCTCTTTATCGACCAGGGCAACAGGCCG CTGTTCGAGGATATGACCGACAGCGACTGCAGGGACAACGCCCCCAGG ACCATCTTCATCATCTCCATGTACAAGGACAGCCAGCCCAGGGGCATG GCCGTCACCATCAGCGTGAAGTGCGAGAAGATCAGCACCCTGTCCTGC GAAAACAAGATCATCTCCTTCAAGGAGATGAACCCGCCCGACAACATC AAGGATACAAAGTCCGACATCATCTTTTTCCAGCGGAGCGTGCCCGGC CACGACAACAAGATGCAGTTCGAGAGCAGCAGCTACGAGGGGTACTTC CTGGCGTGCGAGAAGGAGCGGGATCTGTTCAAGCTGATCCTGAAGAAG GAGGACGAGCTCGGCGACCGGTCCATCATGTTCACTGTCCAGAACGAA GAC |
| 616 | IL18_WT | ATGGCCGCGGAGCCCGTCGAGGACAACTGTATCAACTTCGTCGCGATG AAGTTCATCGACAATACCCTCTACTTCATCGCCGAGGACGACGAGAAC CTCGAAAGCGACTACTTCGGCAAGCTCGAGTCCAAGCTCTCCGTTATC AGGAACCTCAACGACCAGGTCCTCTTTATCGACCAGGGCAACAGGCCT CTCTTCGAGGACATGACCGACTCGGATTGTCGGGACAACGCCCCGCGG ACCATCTTTATCATCAGCATGTACAAGGATTCGCAGCCCAGGGGCATG GCCGTCACCATCAGCGTGAAATGCGAGAAAATTTCCACCCTGAGCTGC GAGAACAAGATAATCAGCTTCAAAGAGATGAACCCGCCCGACAACATC AAGGACACAAAGAGCGACATCATCTTCTTTCAGCGCAGCGTGCCCGGC CACGACAACAAGATGCAGTTCGAGAGCAGCAGCTATGAGGGGTACTTT CTGGCCTGCGAGAAGGAGAGGGATCTGTTCAAGCTCATACTCAAGAAG GAGGATGAGCTGGGGGACAGGAGCATTATGTTCACCGTGCAGAACGAG GAC |
| 617 | IL18_WT | ATGGCCGCCGAGCCCGTCGAGGACAACTGCATCAACTTCGTCGCCATG AAGTTCATCGACAACACGCTCTACTTCATCGCGGAGGACGACGAGAAT CTCGAGTCCGATTATTTCGGTAAGCTAGAGTCCAAACTCAGCGTAATC AGGAACCTCAACGATCAGGTTCTCTTTATCGACCAGGGGAACAGGCCC CTCTTCGAGGATATGACCGACAGCGACTGCAGGGATAACGCCCCGCGG ACCATCTTCATCATCTCCATGTATAAGGACTCCCAGCCCAGGGGCATG GCCGTCACCATAAGCGTCAAGTGCGAGAAGATCAGCACGCTCAGCTGT GAGAACAAGATCATCTCCTTCAAGGAGATGAATCCCCCCGACAACATC AAGGACACCAAGAGCGACATCATCTTTTTCCAAAGGAGCGTGCCCGGC CACGACAACAAGATGCAGTTCGAGTCCTCTTCCTACGAGGGGTATTTT CTGGCCTGCGAGAAGGAACGGGACCTGTTTAAGCTGATCCTGAAAAAG GAGGATGAGCTGGGCGACAGGAGCATCATGTTCACGGTGCAGAACGAG GAC |
| 618 | IL18_WT | ATGGCCGCCGAGCCGGTCGAGGACAACTGTATCAACTTCGTTGCCATG AAGTTTATCGACAATACCCTATACTTCATCGCGGAGGACGACGAGAAC CTCGAGTCCGATTACTTCGGCAAGCTCGAGAGCAAACTCTCCGTCATC CGGAACCTCAACGACCAGGTCCTCTTCATCGACCAGGGCAACAGGCCG CTATTCGAGGACATGACCGATAGCGATTGCAGGGACAACGCGCCGAGG ACCATCTTCATCATCTCCATGTACAAGGACAGCCAACCCCGCGGGATG GCCGTCACCATAAGCGTGAAGTGCGAAAAGATCAGCACACTGTCATGT GAGAACAAAATCATCTCGTTCAAGGAGATGAACCCACCCGACAACATC AAGGACACGAAGTCCGACATCATCTTTTTCCAGCGGAGCGTGCCCGGC CACGATAACAAGATGCAGTTCGAGAGCTCCAGCTACGAAGGTTACTTC CTGGCGTGCGAGAAGGAGCGGGATCTGTTTAAGCTGATCCTGAAAAAG GAGGATGAGCTGGGGGACCGCAGCATCATGTTCACCGTGCAGAATGAG GAC |
| 619 | IL18_WT | ATGGCCGCGGAGCCCGTTGAGGACAACTGCATCAACTTCGTTGCCATG AAGTTCATCGACAACACGTTGTACTTCATAGCCGAGGACGACGAGAAC CTCGAGTCCGATTACTTCGGCAAACTCGAGAGCAAGCTCAGCGTCATC AGGAATCTCAACGACCAGGTATTATTCATCGACCAGGGCAACAGGCCC |

TABLE 8-continued

| Sequence of fusions constructs encoding IL18 (SEQ ID NOS: 579-582) and their corresponding optimized ORFs (SEQ ID NO: 583-807) | | |
|---|---|---|
| SEQ ID NO | Name | Sequence |
| | | CTCTTCGAGGATATGACCGACAGCGACTGTCGGGACAACGCCCCGAGG ACCATCTTTATCATAAGCATGTACAAGGACTCCCAGCCCCGAGGCATG GCAGTCACCATCAGCGTAAAGTGCGAAAAAATCTCCACCCTGAGCTGC GAGAACAAGATCATCTCCTTCAAGGAGATGAACCCTCCCGACAACATC AAGGATACCAAGAGCGACATCATCTTCTTCCAGAGGTCCGTGCCCGGC CATGACAACAAGATGCAGTTCGAGAGCTCCAGCTACGAGGGGTACTTC CTGGCCTGCGAGAAGGAGAGAGATCTGTTCAAGCTGATCCTCAAGAAG GAGGACGAGCTGGGGGACCGGAGCATCATGTTCACAGTCCAGAATGAG GAC |
| 620 | IL18_WT | ATGGCCGCCGAGCCCGTCGAGGACAACTGCATCAACTTCGTCGCCATG AAGTTTATCGATAATACCCTCTACTTTATCGCCGAGGACGACGAGAAT CTCGAAAGCGATTACTTCGGAAAGCTCGAATCCAAGCTAAGCGTCATC CGGAACCTCAACGACCAGGTTCTCTTTATCGACCAGGGCAACCGCCCC CTCTTCGAGGACATGACCGACAGCGATTGCAGGGACAACGCACCCCGG ACGATCTTCATCATCAGCATGTACAAGGACAGCCAGCCCCGGGGCATG GCCGTCACCATCAGCGTGAAGTGTGAAAAGATCTCCACCCTCAGCTGC GAGAACAAGATCATCTCCTTCAAGGAGATGAACCCCCCAGACAACATC AAGGACACCAAGTCCGACATCATCTTCTTCCAAAGGAGCGTGCCGGGC CACGACAACAAGATGCAGTTCGAGTCCAGCTCATACGAGGGGTACTTC CTGGCGTGCGAGAAGGAGCGGGACCTGTTCAAGCTCATCCTCAAGAAG GAGGATGAGCTCGGGGACAGGTCCATAATGTTCACCGTCCAGAACGAA GAC |
| 621 | IL18_WT | ATGGCCGCCGAGCCCGTCGAGGATAATTGTATCAACTTCGTCGCGATG AAGTTCATCGACAACACCCTCTACTTCATCGCCGAGGACGACGAGAAC CTCGAATCCGACTACTTCGGCAAGCTCGAGTCCAAGCTCAGCGTCATC AGGAACCTTAACGACCAGGTCCTCTTCATCGATCAAGGGAATCGACCC CTATTCGAGGATATGACCGACAGCGACTGTCGGGACAACGCCCCCCGG ACCATCTTCATCATCAGCATGTACAAAGACTCCCAGCCGAGGGGGATG GCCGTCACCATCAGCGTGAAGTGCGAAAAAATAAGCACCCTGTCGTGT GAGAACAAAATCATCAGCTTCAAGGAGATGAACCCCCCGGACAACATA AAGGACACCAAGAGCGACATCATCTTCTTCCAGAGGAGTGTCCCCGGG CACGACAACAAGATGCAGTTTGAGAGCTCCAGCTACGAGGGCTACTTC CTGGCTTGCGAGAAGGAGAGGGACCTGTTCAAGCTCATCCTCAAAAAG GAGGACGAGCTGGGCGACAGGAGCATCATGTTCACCGTCCAGAACGAA GAC |
| 622 | IL18_WT | ATGGCCGCCGAACCCGTCGAAGACAACTGCATCAACTTCGTTGCCATG AAGTTCATCGACAACACCCTCTACTTTATCGCAGAGGACGACGAGAAC CTCGAGAGCGACTACTTCGGAAAGCTCGAGAGCAAGCTCAGCGTAATC AGGAACCTCAACGACCAGGTCCTGTTCATCGACCAGGGCAACAGGCCC CTCTTCGAAGACATGACGGACTCCGATTGCCGCGATAACGCCCCCAGG ACCATCTTCATCATCAGCATGTACAAGGACAGCCAGCCCCGAGGCATG GCCGTCACCATATCCGTCAAGTGCGAGAAGATCTCGACGCTGAGCTGC GAGAACAAGATCATCAGCTTCAAGGAGATGAACCCACCCGACAACATC AAGGACACGAAAAGCGATATCATCTTCTTCCAGAGGTCAGTTCCCGGG CACGACAATAAGATGCAGTTCGAGTCGAGCAGCTACGAGGGGTACTTC CTGGCGTGCGAGAAGGAGAGGGACCTGTTCAAGCTCATCCTGAAGAAG GAAGATGAGCTGGGTGACAGGAGCATCATGTTCACCGTGCAGAACGAA GAC |
| 623 | IL18_WT | ATGGCCGCCGAGCCCGTCGAGGATAATTGCATCAACTTCGTCGCCATG AAATTTATCGACAACACCCTCTACTTTATCGCCGAGGACGACGAGAAC CTCGAATCCGATTACTTCGGCAAGCTCGAGAGCAAGCTCTCGGTCATC CGGAACCTCAACGATCAAGTACTCTTCATCGACCAGGGCAACAGGCCC CTCTTCGAGGATATGACCGACTCCGACTGCAGGGACAACGCCCCCAGG ACCATCTTCATCATCAGCATGTACAAGGACAGCCAGCCCAGGGGGATG GCCGTAACCATCTCCGTGAAGTGCGAGAAAATAAGCACCCTGAGCTGT GAGAACAAGATCATCAGCTTCAAGGAGATGAACCCCCCGGACAACATC AAGGACACAAAGAGCGACATTATCTTCTTCCAGAGGAGCGTGCCAGGG CACGATAACAAGATGCAGTTCGAATCCTCCTCCTATGAGGGGTACTTC TTGGCGTGCGAGAAGGAGAGGGACCTCTTCAAGCTGATCCTCAAGAAA GAGGATGAGCTGGGGGATAGGAGCATCATGTTCACCGTCCAGAACGAG GAC |
| 624 | IL18_WT | ATGGCCGCCGAGCCCGTCGAGGACAACTGCATCAACTTCGTCGCCATG AAGTTTATCGACAACACCCTCTACTTCATCGCCGAGGACGACGAGAAC CTCGAAAGCGACTACTTCGGGAAGCTCGAGTCCAAGCTCAGCGTCATC AGGAACCTCAACGACCAGGTCCTGTTCATCGACCAGGGCAACAGGCCC CTCTTCGAGGACATGACCGACAGCGACTGCAGGGACAACGCCCCCAGG ACCATCTTCATTATCAGCATGTACAAGGACAGCCAGCCGCGCGGCATG GCCGTCACCATCAGCGTGAAGTGCGAGAAGATCAGCACCCTGAGCTGT GAGAACAAGATCATCAGCTTCAAGGAGATGAACCCGCCCGACAACATA |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | AAGGACACCAAGTCAGATATCATCTTTTTCCAGAGGAGCGTGCCCGGC CACGACAACAAGATGCAGTTCGAGAGCTCCAGCTACGAAGGGTATTTC CTGGCCTGCGAGAAGGAGAGGGACCTCTTCAAGCTGATTCTGAAGAAG GAGGACGAGCTGGGGGACAGGAGCATCATGTTCACCGTGCAGAACGAG GAC |
| 625 | IL18_WT | ATGGCCGCCGAGCCCGTAGAGGACAACTGCATCAACTTCGTGGCCATG AAGTTTATCGACAACACCCTCTACTTCATCGCCGAGGACGACGAGAAC CTCGAGTCCGACTACTTCGGGAAACTCGAGAGCAAGCTCTCGGTCATC CGGAATCTCAACGACCAGGTTCTCTTCATCGACCAGGGCAATAGGCCC CTCTTCGAAGACATGACCGATAGCGACTGTCGGGACAACGCCCCCCGT ACCATCTTCATCATCTCCATGTACAAGGATTCACAGCCCCGAGGCATG GCGGTCACGATCAGCGTGAAGTGCGAGAAGATCAGCACCCTGAGCTGC GAAAATAAGATCATAAGCTTCAAGGAGATGAACCCGCCGGACAACATC AAGGACACCAAAAGCGACATCATCTTCTTCCAGCGAAGCGTCCCCGGC CACGACAACAAGATGCAGTTCGAGTCCTCCTCCTACGAAGGGTACTTT CTGGCCTGTGAGAAGGAGAGGGATCTGTTCAAGCTGATCCTCAAGAAG GAGGATGAACTGGGCGACAGGAGCATCATGTTCACCGTCCAGAACGAG GAT |
| 626 | IL18_WT | ATGGCAGCCGAGCCAGTTGAGGACAATTGTATCAACTTCGTGGCGATG AAATTCATAGACAATACCTTGTACTTCATCGCCGAGGACGACGAAAAC TTAGAGAGCGACTACTTCGGCAAGCTTGAGAGCAAGCTCAGCGTCATC CGGAATCTCAACGACCAGGTCCTCTTCATCGATCAGGGGAACAGGCCC CTCTTCGAGGATATGACCGACTCGGACTGCAGGGACAACGCCCCCAGG ACGATCTTCATCATCTCCATGTACAAGGATTCCCAACCCCGCGGGATG GCCGTCACGATCAGCGTGAAGTGTGAGAAAATCAGCACCCTTTCCTGC GAGAATAAGATCATCTCCTTTAAGGAGATGAACCCGCCCGACAACATC AAGGACACCAAGTCCGACATCATCTTTTTCCAGCGCAGCGTGCCCGGC CACGACAACAAGATGCAGTTCGAGTCCAGCTCCTACGAGGGCTACTTC CTGGCCTGCGAGAAGGAGAGGGACCTCTTTAAGCTAATCCTCAAGAAG GAGGACGAGCTCGGGGACAGGAGCATCATGTTCACCGTGCAGAACGAG GAC |
| 627 | IL18_WT | ATGGCGGCGGAGCCCGTCGAGGACAATTGCATCAATTTCGTGGCCATG AAGTTCATCGACAATACACTCTACTTTATCGCCGAAGACGACGAGAAC CTCGAGTCCGACTACTTCGGCAAGCTCGAGAGCAAGCTCAGCGTCATC AGGAACCTCAACGACCAGGTCCTCTTCATCGACCAGGGGAACAGGCCC CTATTCGAGGACATGACCGACTCGGACTGCAGGGACAACGCCCCCAGG ACAATCTTCATCATCAGCATGTACAAGGACTCCCAGCCCAGGGGCATG GCCGTCACCATTAGCGTGAAGTGCGAGAAGATCTCCACCCTGAGCTGC GAGAACAAGATCATCTCCTTCAAGGAGATGAACCCTCCCGACAATATC AAGGACACGAAAAGCGACATCATCTTCTTCCAGAGGAGCGTGCCGGGT CACGATAACAAGATGCAGTTCGAGTCCTCGAGCTACGAGGGGTACTTT CTGGCCTGCGAAAAGGAGAGGGACCTGTTCAAACTGATCCTGAAGAAG GAGGACGAACTGGGCGACCGGAGCATCATGTTCACCGTCCAGAACGAG GAC |
| 628 | IL18_WT | ATGGCAGCGGAGCCCGTCGAGGACAACTGTATCAACTTCGTGGCCATG AAGTTTATCGACAATACGCTATACTTCATCGCCGAGGACGACGAGAAT CTCGAGTCCGACTACTTCGGCAAGCTCGAGAGCAAGCTCAGCGTCATC AGGAATCTCAACGATCAGGTCCTATTTATCGACCAGGGGAACAGGCCC CTCTTCGAGGACATGACCGACTCCGACTGCAGGGACAACGCCCCCAGG ACCATCTTTATCATTAGCATGTACAAGGACAGCCAGCCCAGGGGGATG GCCGTCACAATCAGTGTCAAGTGCGAGAAGATCAGCACGCTGTCATGC GAGAATAAGATCATCAGCTTTAAAGAGATGAACCCGCCCGACAATATA AAGGATACCAAATCCGACATCATCTTCTTCCAGAGGAGCGTTCCGGGC CACGACAACAAGATGCAGTTCGAGTCCTCCTCCTACGAGGGCTATTTC CTCGCCTGCGAGAAGGAGAGGGACCTGTTCAAGCTCATACTCAAGAAG GAGGACGAGCTCGGCGACAGAAGCATCATGTTCACCGTGCAAAACGAG GAT |
| 629 | IL18_WT | ATGGCCGCCGAGCCGGTCGAGGACAACTGCATAAATTTCGTCGCCATG AAGTTCATAGACAACACCCTATACTTCATCGCCGAAGACGACGAGAAC CTCGAGAGCGACTACTTCGGAAAGCTCGAGAGCAAGCTTTCGGTTATC AGGAATTTGAACGACCAGGTCCTCTTCATCGATCAGGGCAATAGGCCC CTCTTCGAGGATATGACCGACTCGGACTGCAGGGATAACGCCCCCAGG ACAATCTTCATAATCAGCATGTACAAGGACAGCCAGCCCAGAGGCATG GCCGTCACTATTTCTGTCAAGTGCGAGAAGATCAGCACGCTGAGCTGC GAGAACAAAATCATCAGCTTTAAAGAGATGAACCCGCCCGACAACATC AAGGACACCAAGAGCGACATCATCTTCTTCCAGAGGAGCGTCCCCGGG CATGACAACAAGATGCAGTTCGAGAGCAGCTCCTACGAGGGCTATTTT CTCGCCTGCGAGAAGGAGAGGGACCTGTTTAAGCTCATCCTGAAGAAG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GAGGACGAGCTGGGGGACAGGTCCATCATGTTTACGGTGCAGAACGAGGAC |
| 630 | IL18_WT | ATGGCCGCCGAGCCCGTCGAAGACAACTGCATCAACTTCGTAGCCATGAAGTTCATCGACAACACACTCTACTTCATCGCCGAGGACGACGAGAACTTGGAGTCCGACTACTTCGGCAAGCTCGAGAGCAAGTTGAGCGTCATCAGAAACCTCAACGACCAGGTCCTCTTCATAGACCAGGGGAACAGGCCCCTCTTCGAGGACATGACCGACAGCGACTGCCGGGACAACGCCCCCAGGACCATATTCATCATCAGCATGTATAAGGACAGCCAGCCCAGGGGCATGGCCGTCACGATCAGCGTCAAGTGCGAGAAGATCAGCACGCTGTCCTGCGAGAACAAGATCATCAGCTTCAAGGAGATGAACCCCCCGGACAACATCAAGGACACCAAATCCGACATCATCTTCTTCCAGCGAAGCGTGCCCGGCCACGATAACAAGATGCAGTTTGAGAGCAGCAGCTACGAGGGGTACTTCCTGGCCTGCGAGAAGGAGAGGGACCTCTTCAAGCTGATCCTGAAGAAAGAGGACGAGCTGGGCGACAGGAGCATCATGTTCACTGTTCAGAACGAGGAC |
| 631 | IL18_WT | ATGGCCGCCGAGCCGGTGGAGGATAACTGCATCAACTTCGTCGCCATGAAGTTCATAGACAATACCCTCTACTTCATCGCCGAGGACGACGAAAACCTCGAGTCCGATTATTTCGGGAAGCTCGAGAGCAAGCTCAGCGTCATCAGGAACCTCAACGACCAGGTCCTCTTTATCGACCAGGGGAACCGGCCCTTGTTCGAGGATATGACCGACTCAGACTGCAGGGATAACGCGCCCCGGACCATCTTCATCATTTCCATGTATAAGGACAGCCAGCCGCGGGGCATGGCCGTCACCATCAGCGTAAAGTGCGAGAAAATCAGTACCCTGAGCTGCGAGAACAAGATCATCAGCTTCAAGGAGATGAACCCGCCGGACAACATCAAAGACACCAAGTCCGATATCATCTTCTTCCAACGGTCCGTCCCCGGACACGACAATAAGATGCAGTTCGAGAGCAGCTCCTACGAGGGGTACTTCCTGGCCTGTGAAAAGGAGCGAGATCTGTTCAAGCTGATCCTGAAGAAGGAGGATGAGCTGGGCGACAGAAGCATTATGTTCACAGTCCAAAACGAGGAC |
| 632 | IL18_WT | ATGGCCGCCGAGCCCGTCGAAGACAACTGCATCAACTTCGTGGCCATGAAATTCATCGACAATACCCTTTACTTTATCGCCGAGGACGACGAAAACCTCGAAAGCGACTACTTCGGCAAGCTAGAGTCCAAGCTCAGCGTCATTAGGAACCTAAACGATCAAGTCCTCTTCATCGACCAGGGCAATAGGCCCCTCTTCGAGGACATGACCGATAGCGACTGCAGGGACAACGCCCCCAGGACCATCTTCATAATCAGCATGTACAAGGACAGCCAGCCCAGGGGCATGGCCGTCACCATCAGCGTCAAGTGTGAGAAGATCTCCACGCTGAGCTGCGAAAACAAGATCATCTCCTTCAAGGAGATGAACCCGCCCGACAACATCAAGGATACCAAGTCCGACATCATCTTCTTCCAACGGAGCGTGCCCGGCCACGACAACAAGATGCAGTTCGAGAGCAGCAGCTATGAGGGCTACTTCCTGGCGTGCGAGAAAGAGAGGGACCTCTTCAAGCTGATCCTGAAGAAGGAGGACGAGCTTGGGGACAGGAGCATCATGTTCACCGTCCAAAATGAGGAT |
| 633 | IL18_WT_SN | ATGGCCGCCGAGCCCGTCGAGGACAACTGCATCAACTTCGTGGCCATGAAGTTTATCGACAACACCCTCTACTTCATCGCCGAGGACGACGAGAATCTCGAGAGCGACTACTTCGGAAAGCTTGAGAGCAAGCTTTCCGTCATCCGGAACCTCAACGACCAGGTTCTCTTCATCGACCAGGGCAACAGGCCCCTCTTCGAGGACATGACCAGCAGCGACTGCAGGAACAACGCCCCCAGGACCATCTTCATCATCAGCATGTATAAGGACTCCCAGCCCAGGGGCATGGCCGTCACCATCTCCGTGAAGTGCGAGAAGATCTCCACCCTCAGCTGTGAGAACAAGATCATCAGCTTCAAGGAGATGAACCCACCCGACAACATCAAGGACACCAAGAGCGACATCATCTTCTTCCAGCGGTCAGTCCCCGGGCACGACAACAAGATGCAGTTCGAAAGCAGCTCCTATGAGGGCTATTTCCTGGCCTGCGAGAAGGAGCGGGACCTCTTCAAGCTGATACTGAAGAAGGAGGACGAGCTGGGGGATAGGTCCATCATGTTCACGGTGCAAAACGAGGAC |
| 634 | IL18_WT_SN | ATGGCCGCCGAGCCCGTTGAGGACAACTGCATCAACTTCGTGGCCATGAAGTTCATCGATAACACACTCTACTTCATCGCGGAAGACGACGAGAACCTCGAGTCCGATTACTTCGGGAAACTCGAGAGCAAGCTCAGCGTCATCCGCAACCTCAACGATCAGGTCCTTTTCATCGACCAGGGCAACAGGCCGTTGTTCGAGGACATGACAAGCAGCGACTGCCGGAATAACGCCCCGAGGACCATCTTTATCATCAGCATGTACAAGGACAGCCAGCCCCGGGGCATGGCCGTCACCATCAGCGTGAAGTGCGAGAAAATCAGCACCCTGTCCTGTGAGAACAAGATCATCAGCTTCAAGGAGATGAACCCACCCGATAACATCAAGGACACCAAGTCCGACATCATCTTCTTCCAGCGTTCCGTGCCGGGCCATGACAACAAGATGCAGTTCGAGAGCTCCAGCTACGAGGGGTACTTCCTGGCCTGCGAGAAGGAGCGGGATCTGTTCAAGCTGATCCTGAAGAAGGAGGACGAGCTGGGCGACCGCTCCATCATGTTCACCGTGCAGAACGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 635 | IL18_WT_SN | ATGGCCGCCGAGCCCGTCGAGGATAACTGCATCAACTTCGTCGCCATG<br>AAGTTCATAGACAACACCCTCTACTTCATCGCCGAGGACGACGAGAAT<br>CTCGAGTCCGACTACTTCGGTAAGCTCGAGAGCAAGCTCAGCGTTATT<br>CGCAACCTCAACGACCAAGTCCTCTTCATCGACCAGGGGAACCGGCCC<br>CTTTTCGAAGACATGACTAGCAGCGACTGCAGGAATAACGCGCCGCGG<br>ACGATCTTCATCATAAGCATGTACAAGGACAGCCAGCCCAGGGGCATG<br>GCCGTCACCATCAGCGTGAAGTGCGAGAAGATAAGCACGCTGAGCTGC<br>GAGAACAAGATCATCTCCTTCAAGGAGATGAACCCTCCCGATAATATC<br>AAAGACACCAAATCCGACATCATCTTCTTTCAGAGGAGCGTGCCCGGC<br>CACGACAACAAGATGCAGTTTGAGAGCAGCAGCTACGAGGGGTACTTC<br>CTGGCCTGCGAGAAGGAACGGGATCTGTTTAAGCTGATCCTGAAAAAG<br>GAGGACGAGCTGGGGGACCGCAGCATCATGTTTACCGTCCAGAACGAG<br>GAC |
| 636 | IL18_WT_SN | ATGGCCGCCGAACCAGTCGAGGACAATTGCATCAACTTCGTTGCCATG<br>AAGTTCATCGACAACACGCTCTACTTCATCGCCGAGGACGACGAAAAC<br>CTCGAGTCCGACTACTTCGGCAAGCTCGAATCCAAGCTCTCCGTCATC<br>CGGAACCTCAACGACCAGGTCCTCTTCATCGACCAGGGGAACCGCCCC<br>CTCTTCGAAGACATGACCAGCAGCGATTGTCGGAATAACGCCCCCAGG<br>ACCATCTTCATAATCTCCATGTACAAGGACTCGCAGCCCAGGGGCATG<br>GCCGTTACCATCAGCGTGAAGTGCGAGAAGATCTCCACCCTGAGCTGC<br>GAGAATAAGATCATCTCCTTCAAGGAGATGAACCCGCCCGATAACATC<br>AAGGACACCAAGTCCGACATCATCTTCTTCCAGAGGAGCGTGCCCGGC<br>CACGACAACAAGATGCAATTCGAAAGCAGCAGCTACGAGGGGTACTTC<br>CTGGCCTGCGAGAAGGAGCGGGACCTCTTCAAACTGATCCTCAAGAAG<br>GAGGACGAGCTGGGCGACCGGAGCATCATGTTCACCGTGCAGAACGAG<br>GAC |
| 637 | IL18_WT_SN | ATGGCCGCCGAGCCAGTCGAAGATAACTGCATCAATTTCGTCGCCATG<br>AAGTTCATCGACAACACGCTCTACTTCATCGCCGAGGACGACGAAAAC<br>TTGGAGAGCGACTACTTCGGGAAGCTCGAGTCCAAGCTCTCCGTCATC<br>CGGAATTTAAACGACCAGGTCCTCTTCATCGACCAGGGCAACAGGCCC<br>TTATTCGAAGACATGACCTCGTCCGACTGCCGGAACAACGCCCCACGG<br>ACCATCTTCATCATCAGCATGTACAAGGACAGCCAACCGCGGGGCATG<br>GCCGTCACCATCAGCGTGAAGTGCGAGAAAATCAGTACCCTGAGCTGT<br>GAGAACAAGATCATCAGCTTCAAGGAGATGAACCCACCCGACAACATC<br>AAGGACACCAAGTCCGACATTATCTTCTTCCAGAGGTCCGTGCCCGGA<br>CACGATAACAAAATGCAGTTCGAGAGCAGCAGCTACGAGGGGTATTTC<br>CTGGCCTGCGAGAAGGAGCGCGACCTGTTCAAGCTGATCCTGAAAAAG<br>GAGGACGAGCTGGGGGACAGGTCCATCATGTTCACCGTGCAAAACGAG<br>GAT |
| 638 | IL18_WT_SN | ATGGCCGCCGAGCCCGTTGAGGACAACTGCATCAACTTCGTAGCCATG<br>AAGTTCATCGACAACACGCTCTACTTCATCGCCGAGGACGACGAGAAT<br>CTCGAGAGCGACTACTTCGGGAAGCTCGAGAGCAAACTTAGCGTAATC<br>CGCAACCTCAACGACCAGGTCTTGTTCATCGACCAGGGCAACAGGCCC<br>CTCTTCGAGGACATGACCTCGTCGGACTGCAGGAACAACGCGCCCCGC<br>ACCATCTTTATTATCTCCATGTACAAGGATAGCCAACCCAGGGGCATG<br>GCCGTCACCATCAGCGTCAAGTGCGAGAAGATCTCCACTCTAAGCTGC<br>GAGAACAAGATAATCAGCTTCAAGGAGATGAACCCGCCCGATAATATC<br>AAGGACACCAAGAGCGACATCATCTTCTTTCAGCGGTCCGTGCCAGGG<br>CACGACAACAAGATGCAGTTCGAGAGCAGCTCCTACGAGGGGTACTTC<br>CTGGCCTGCGAGAAGGAGAGGGACCTGTTTAAGCTGATCCTGAAGAAG<br>GAGGACGAGCTGGGGGACAGGAGCATCATGTTCACTGTCCAGAATGAG<br>GAC |
| 639 | IL18_WT_SN | ATGGCCGCCGAGCCGGTCGAGGACAATTGCATCAATTTCGTCGCAATG<br>AAGTTCATCGATAATACCTTGTACTTCATCGCCGAGGACGACGAGAAC<br>CTCGAGAGCGACTACTTCGGGAAGCTCGAGAGCAAGCTCTCCGTCATC<br>AGGAACCTCAACGACCAGGTCTTATTCATCGATCAGGGCAATAGGCCC<br>CTCTTCGAGGACATGACCAGCTCAGATTGCAGGAACAACGCCCCAAGG<br>ACCATCTTTATAATCAGCATGTACAAGGACAGCCAGCCGAGGGGCATG<br>GCCGTCACCATCTCCGTGAAGTGCGAGAAGATCAGCACCCTGTCCTGC<br>GAGAACAAGATCATCAGTTTCAAGGAGATGAACCCCCCGGACAATATC<br>AAAGACACCAAGTCCGACATCATCTTCTTCCAAAGGAGCGTGCCCGGC<br>CACGACAACAAGATGCAGTTCGAGTCCTCCTCCTACGAGGGCTACTTC<br>CTGGCATGCGAGAAGGAGAGGGACCTGTTCAAGCTGATCCTGAAGAAG<br>GAGGACGAGCTGGGGGACAGGAGCATCATGTTCACCGTCCAAAACGAG<br>GAC |
| 640 | IL18_WT_SN | ATGGCCGCCGAGCCCGTCGAGGACAACTGCATCAATTTCGTCGCCATG<br>AAGTTCATCGACAACACGTTGTACTTCATCGCCGAGGACGACGAGAAC<br>CTCGAATCCGACTACTTCGGGAAGTTGGAGAGCAAGCTCAGCGTCATC<br>CGGAACCTCAACGACCAGGTACTCTTTATCGACCAGGGCAACCGCCCG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTGTTCGAGGACATGACCTCCTCAGACTGCAGGAATAACGCACCGAGG ACCATCTTCATCATCAGCATGTACAAAGACTCCCAACCTAGGGGCATG GCGGTAACCATTAGCGTCAAGTGCGAAAAGATCAGCACACTGTCGTGC GAGAACAAAATCATCAGCTTCAAGGAGATGAACCCCCCGGACAACATC AAGGACACCAAGTCCGACATCATCTTCTTCCAGCGGAGCGTGCCGGGA CACGACAACAAAATGCAGTTCGAGAGCTCCTCCTACGAGGGCTACTTC CTGGCCTGCGAGAAGGAGCGGGACCTGTTCAAGCTGATCCTGAAGAAG GAGGACGAGCTGGGGGACCGGAGCATCATGTTCACCGTCCAGAACGAG GAC |
| 641 | IL18_WT_SN | ATGGCCGCCGAGCCCGTAGAAGACAATTGCATCAACTTCGTAGCCATG AAGTTTATCGATAATACATTGTACTTTATCGCGGAGGACGACGAGAAC CTCGAGAGCGACTATTTCGGCAAACTCGAATCCAAACTCAGCGTCATC CGAAACCTAAACGATCAGGTTCTCTTCATCGACCAGGGGAACCGGCCC CTCTTCGAAGACATGACTTCCTCCGACTGCCGGAATAACGCCCCGAGG ACCATCTTCATCATTAGCATGTATAAGGACAGCCAGCCCAGGGGGATG GCCGTCACCATCAGCGTGAAGTGCGAGAAGATCTCCACCCTGAGCTGT GAGAACAAAATCATCAGCTTCAAGGAAATGAACCCACCCGACAACATC AAGGACACCAAGTCCGATATCATCTTCTTCCAGAGAAGCGTGCCCGGC CACGATAATAAGATGCAGTTCGAGAGCAGCAGCTACGAGGGGTACTTT CTGGCCTGCGAGAAGGAACGGGACCTGTTCAAGCTGATCCTGAAGAAG GAGGATGAGCTGGGGGACAGGAGCATCATGTTCACCGTCCAGAACGAG GAC |
| 642 | IL18_WT_SN | ATGGCCGCCGAGCCCGTCGAGGACAACTGCATCAACTTCGTCGCCATG AAGTTCATCGATAACACTTTATACTTCATCGCCGAGGACGACGAAAAT CTCGAGTCCGACTACTTCGGCAAACTCGAATCAAAGCTCTCCGTCATC AGGAACCTCAACGACCAAGTCCTCTTCATCGACCAGGGGAACCGGCCC CTCTTCGAGGACATGACGTCGAGCGACTGCCGCAACAACGCCCCGCGG ACCATATTCATTATCTCGATGTATAAGGACAGCCAGCCGCGGGGGATG GCCGTAACGATCTCCGTCAAGTGCGAAAAGATCTCGACCCTGTCCTGT GAGAACAAGATAATCAGCTTCAAGGAGATGAACCCTCCAGACAACATC AAGGACACCAAGAGCGATATCATATTCTTCCAGCGGAGCGTCCCCGGC CATGACAACAAGATGCAGTTCGAGTCCAGCAGCTACGAGGGGTACTTC CTGGCGTGCGAAAAGGAGCGGGATCTGTTCAAGCTGATCCTGAAAAAG GAGGACGAGCTGGGGGACAGGAGCATCATGTTTACCGTGCAAAACGAG GAC |
| 643 | IL18_WT_SN | ATGGCCGCCGAACCCGTAGAGGACAACTGCATCAACTTCGTCGCCATG AAGTTTATCGATAACACCCTCTATTTCATCGCCGAGGACGACGAGAAC CTCGAGAGCGACTACTTCGGCAAGCTCGAATCCAAGTTGTCGGTCATT AGGAACCTCAACGACCAGGTCCTATTCATCGACCAGGGGAACAGGCCC CTCTTCGAGGATATGACCAGCAGCGACTGTCGAAACAACGCCCCCCGG ACAATCTTCATCATCTCCATGTACAAGGACAGCCAGCCAAGGGGCATG GCCGTCACGATCAGCGTCAAGTGTGAGAAGATCTCCACCCTGAGCTGC GAGAATAAGATTATCAGCTTCAAGGAGATGAACCCACCCGATAATATC AAGGACACCAAAAGCGACATTATCTTTTTCCAAAGGTCCGTGCCGGGC CACGACAACAAGATGCAGTTCGAGTCCAGCTCCTACGAGGGCTACTTC CTGGCCTGCGAAAAGGAGCGGGACCTGTTCAAGCTGATCCTCAAGAAG GAGGACGAGCTGGGGGATCGCAGCATCATGTTCACGGTGCAGAACGAG GAC |
| 644 | IL18_WT_SN | ATGGCCGCCGAACCCGTCGAAGACAACTGCATCAATTTCGTCGCGATG AAGTTCATCGACAACACCCTCTATTTCATCGCCGAAGACGACGAGAAC TTAGAATCCGACTACTTCGGCAAATTGGAGTCCAAGCTCTCCGTAATA AGGAACCTCAACGATCAAGTCCTCTTCATCGATCAGGGCAACAGGCCC CTCTTCGAGGACATGACCAGCTCCGACTGCAGGAACAACGCCCCCCGG ACCATATTCATCATCAGCATGTATAAGGACAGCCAGCCGAGGGGCATG GCCGTCACCATTTCCGTGAAGTGCGAGAAGATCTCCACTCTGAGCTGC GAGAACAAAATCATCTCCTTCAAGGAGATGAATCCCCCCGACAATATC AAGGACACCAAGTCCGACATCATCTTCTTTCAGCGAAGCGTGCCCGGC CACGACAACAAGATGCAGTTTGAGTCCAGCTCGTATGAAGGCTACTTC CTCGCCTGCGAGAAGGAGAGGGATCTCTTCAAACTGATCCTGAAGAAG GAGGACGAGCTGGGCGACAGGAGCATCATGTTCACGGTGCAGAACGAG GAC |
| 645 | IL18_WT_SN | ATGGCCGCCGAACCCGTTGAAGACAATTGCATCAATTTCGTGGCCATG AAGTTCATCGACAACACCCTCTACTTCATCGCCGAGGACGACGAGAAC CTCGAGAGCGACTACTTCGGGAAGCTCGAAAGCAAGCTCTCGGTCATC CGCAATCTCAACGACCAGGTACTCTTCATCGATCAGGGGAACCGGCCC CTCTTCGAGGACATGACCAGCTCCGACTGCAGGAACAACGCCCCCAGG ACCATCTTTATTATCTCCATGTACAAAGACTCACAGCCGAGGGGGATG GCCGTTACGATCAGCGTGAAATGCGAAAAGATCAGCACCCTGAGCTGC GAGAATAAGATCATCTCCTTCAAGGAGATGAATCCCCCCGACAACATC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | AAAGATACCAAGTCGGACATCATATTCTTCCAACGTAGCGTGCCGGGG<br>CACGACAACAAGATGCAGTTCGAGAGCTCCTCCTACGAGGGGTATTTT<br>CTGGCGTGCGAGAAGGAGCGGGACCTGTTCAAGCTGATCCTGAAAAAG<br>GAGGACGAACTGGGGGACAGGAGCATCATGTTCACCGTGCAGAATGAG<br>GAC |
| 646 | IL18_WT_SN | ATGGCCGCCGAGCCCGTAGAGGACAATTGCATCAACTTCGTTGCGATG<br>AAGTTCATCGACAATACCCTATACTTCATCGCCGAGGACGACGAGAAC<br>CTCGAATCAGACTACTTCGGCAAGCTCGAGTCCAAGCTATCGGTCATC<br>AGGAACCTCAACGACCAGGTCCTCTTCATCGACCAGGGCAACAGGCCT<br>TTGTTCGAGGACATGACTAGCAGCGACTGCAGGAACAACGCGCCCCGC<br>ACCATCTTTATCATCAGCATGTACAAGGACAGCCAGCCCAGGGGCATG<br>GCCGTCACGATCTCCGTGAAATGCGAGAAAATCAGCACGCTGTCCTGT<br>GAGAACAAGATCATCTCTTTCAAGGAGATGAACCCGCCCGACAACATC<br>AAGGACACCAAGTCCGATATCATCTTCTTCCAGCGCAGCGTGCCCGGC<br>CACGACAACAAGATGCAGTTCGAGAGCAGCAGCTACGAGGGGTACTTT<br>CTGGCCTGCGAGAAGGAGAGGGATCTGTTCAAGCTGATCCTGAAGAAG<br>GAGGATGAGCTGGGCGACCGGAGCATCATGTTCACCGTCCAGAATGAG<br>GAC |
| 647 | IL18_WT_SN | ATGGCCGCCGAGCCCGTTGAGGATAACTGCATCAATTTCGTCGCCATG<br>AAGTTCATCGATAACACCCTTTACTTCATCGCCGAGGACGACGAGAAC<br>TTGGAAAGCGACTACTTCGGCAAGCTCGAGAGCAAGCTCAGCGTCATC<br>CGGAACCTCAACGATCAGGTCTTGTTCATCGACCAGGGCAATAGGCCC<br>CTCTTCGAGGACATGACCAGCTCCGACTGCCGCAATAACGCCCCCAGG<br>ACGATCTTTATCATCAGCATGTACAAGGACAGCCAGCCCCGGGGCATG<br>GCAGTCACCATCAGCGTGAAGTGCGAGAAGATCTCGACCCTGAGCTGC<br>GAGAATAAGATCATCTCCTTCAAGGAGATGAATCCCCCCGACAACATC<br>AAGGATACCAAGAGCGACATCATCTTCTTCCAGAGGTCCGTGCCCGGT<br>CACGACAACAAGATGCAGTTCGAATCCTCTAGCTACGAGGGGTACTTC<br>CTGGCCTGCGAGAAGGAGCGGGATCTGTTCAAGCTCATCCTGAAAAAG<br>GAAGATGAGCTGGGGGATAGGAGCATCATGTTCACCGTGCAAAATGAG<br>GAC |
| 648 | IL18_WT_SN | ATGGCCGCCGAGCCGGTGGAAGATAATTGTATCAACTTCGTCGCGATG<br>AAGTTCATCGACAATACCCTATATTTTATCGCCGAGGACGACGAGAAC<br>CTCGAATCCGACTATTTCGGGAAGCTCGAGTCCAAGCTCAGCGTTATC<br>CGCAACCTCAACGACCAGGTCCTCTTCATCGATCAGGGCAACAGGCCC<br>CTCTTCGAGGACATGACCAGCTCCGACTGCAGAAACAACGCCCCCAGG<br>ACCATCTTCATCATATCCATGTACAAGGACAGCCAGCCCCGGGGCATG<br>GCCGTCACCATCAGCGTGAAGTGCGAAAAGATCAGCACCCTCTCCTGC<br>GAGAACAAGATCATCTCCTTCAAGGAGATGAATCCCCCCGACAACATC<br>AAGGACACCAAGAGCGACATCATCTTCTTCCAGCGGAGCGTGCCCGGC<br>CACGACAACAAGATGCAGTTCGAAAGCTCCAGCTACGAGGGGTACTTC<br>CTGGCCTGCGAAAAGGAGAGGGACCTGTTCAAGCTCATCCTCAAGAAG<br>GAGGATGAGCTGGGGGACCGAAGCATCATGTTCACCGTCCAGAACGAG<br>GAC |
| 649 | IL18_WT_SN | ATGGCGGCCGAGCCGGTCGAGGACAACTGCATCAATTTCGTCGCGATG<br>AAGTTTATCGACAACACGCTCTACTTCATAGCAGAGGACGACGAGAAC<br>CTCGAGAGCGACTACTTCGGCAAGCTCGAGAGCAAGCTCTCCGTAATC<br>AGGAACCTCAACGACCAGGTCCTCTTCATCGACCAGGGCAATAGGCCG<br>CTGTTCGAAGACATGACCAGCAGCGACTGCAGGAACAACGCCCCGCGG<br>ACCATCTTCATCATCAGCATGTACAAGGACAGCCAGCCCCGGGGGATG<br>GCCGTCACCATCAGCGTGAAGTGCGAGAAAATCAGCACCCTCAGCTGC<br>GAGAATAAGATCATCTCCTTCAAGGAGATGAACCCCCCGGACAATATC<br>AAGGACACCAAGTCAGACATCATCTTCTTTCAGAGGAGCGTGCCCGGC<br>CACGACAACAAGATGCAGTTTGAGAGCAGCTCCTACGAGGGCTACTTT<br>CTCGCGTGCGAGAAGGAGAGAGATCTGTTCAAGCTCATTCTCAAGAAG<br>GAGGACGAGCTGGGCGACAGGAGCATTATGTTCACCGTGCAGAACGAG<br>GAT |
| 650 | IL18_WT_SN | ATGGCGGCCGAGCCCGTAGAGGACAACTGCATCAACTTCGTCGCCATG<br>AAATTCATCGACAACACCCTATATTTCATCGCCGAGGACGACGAGAAT<br>CTCGAAAGCGACTATTTCGGCAAGCTCGAAAGCAAGCTCAGCGTCATA<br>CGTAATCTCAACGATCAGGTCCTCTTCATCGATCAGGGCAATCGGCCT<br>CTCTTCGAGGATATGACCAGCAGCGACTGCAGGAACAACGCCCCCAGG<br>ACCATCTTCATCATCTCCATGTACAAGGACTCGCAGCCCAGGGGCATG<br>GCCGTCACCATCAGCGTGAAGTGCGAGAAGATCAGCACCCTGAGCTGC<br>GAAAATAAGATCATCTCCTTCAAGGAGATGAACCCTCCCGACAACATC<br>AAGGACACCAAGTCAGACATCATCTTCTTTCAGAGGTCCGTGCCGGGG<br>CATGATAACAAGATGCAGTTCGAGAGCTCCAGCTACGAGGGGTACTTC<br>CTGGCCTGCGAGAAGGAGAGGGATCTCTTCAAGCTGATCCTGAAGAAG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GAGGACGAGCTGGGCGACAGGAGCATCATGTTCACCGTCCAGAACGAGGAC |
| 651 | IL18_WT_SN | ATGGCCGCCGAACCCGTAGAGGACAACTGCATCAACTTCGTCGCCATGAAGTTCATCGACAACACCCTCTACTTCATCGCGGAGGACGACGAGAACCTCGAGAGCGACTACTTCGGCAAGCTCGAGTCCAAGCTCAGCGTCATCAGGAACCTCAACGATCAGGTCCTCTTCATCGACCAGGGCAACAGGCCCCTCTTCGAGGACATGACCTCGAGCGACTGCAGGAACAACGCCCCCCGCACGATCTTTATCATCTCTATGTATAAGGATTCCCAACCCAGGGGGATGGCCGTCACCATCTCCGTGAAGTGCGAAAAGATCAGCACGCTGTCCTGTGAGAATAAGATCATCAGCTTTAAGGAAATGAATCCCCCCGACAACATCAAGGATACCAAGAGCGACATCATCTTTTTCCAGAGGAGCGTGCCTGGGCACGATAACAAAATGCAGTTCGAGTCCAGCAGCTACGAGGGCTACTTCCTGGCCTGCGAGAAGGAGAGGGACCTGTTCAAACTGATCCTCAAGAAGGAGGATGAGCTCGGGGACAGGTCCATCATGTTCACGGTGCAGAACGAGGAC |
| 652 | IL18_WT_SN | ATGGCGGCAGAGCCCGTCGAGGATAACTGTATCAACTTCGTAGCCATGAAGTTCATAGACAACACCCTTTACTTCATCGCCGAGGACGACGAGAATCTTGAGTCCGACTACTTCGGAAAACTCGAGAGCAAGCTCAGCGTCATCAGGAACCTCAACGACCAGGTCTTGTTCATCGACCAAGGCAACAGGCCCTTGTTCGAGGATATGACCTCCTCAGACTGCAGGAATAACGCCCCTCGAACAATCTTCATCATCTCGATGTACAAGGACAGCCAGCCCAGGGGCATGGCGGTCACCATCTCCGTGAAGTGTGAGAAGATCTCCACACTCAGCTGTGAAAACAAGATCATCTCATTCAAGGAGATGAACCCGCCCGATAACATCAAGGACACGAAAAGCGATATCATCTTCTTCCAGAGGAGCGTCCCCGGGCACGACAACAAGATGCAATTCGAGTCCAGCAGCTACGAGGGCTACTTCCTGGCCTGCGAGAAGGAGAGGGACCTGTTTAAGCTGATCCTCAAGAAAGAAGATGAGCTGGGGGACCGGTCCATTATGTTCACCGTGCAGAACGAGGAC |
| 653 | IL18_WT_SN | ATGGCCGCCGAGCCCGTCGAGGACAACTGCATCAACTTCGTAGCGATGAAGTTCATCGACAACACCCTCTACTTCATCGCCGAGGACGACGAGAACCTCGAGAGCGATTACTTCGGTAAGCTCGAGAGCAAGCTCTCAGTCATAAGGAACCTCAACGATCAGGTCCTCTTTATCGACCAGGGGAATAGGCCCCTCTTCGAGGACATGACCTCGAGCGACTGTAGGAACAACGCCCCCAGGACCATCTTTATCATCAGCATGTACAAGGACTCCCAACCGAGGGGCATGGCCGTCACCATCAGCGTAAAGTGCGAGAAGATCTCGACCCTGAGCTGCGAGAATAAGATCATCTCCTTCAAGGAGATGAATCCCCCCGATAACATCAAAGACACCAAGAGCGATATAATCTTTTTTCAGAGGTCCGTACCGGGGCACGATAACAAAATGCAGTTTGAGTCCAGCAGCTATGAAGGCTACTTCCTGGCCTGCGAGAAGGAGAGGGACCTGTTTAAGCTGATCCTGAAAAAGGAGGACGAGCTGGGCGATAGGAGCATAATGTTCACGGTGCAGAACGAGGAC |
| 654 | IL18_WT_SN | ATGGCAGCGGAACCGGTCGAGGACAACTGCATCAATTTCGTGGCGATGAAGTTCATCGACAACACGCTTTACTTCATCGCCGAGGACGACGAGAACTTGGAAAGCGACTATTTCGGCAAGCTCGAAAGCAAGCTCTCGGTCATCCGAAACCTCAACGACCAAGTCCTCTTCATCGACCAGGGCAACAGGCCGCTGTTCGAAGACATGACCAGCAGCGACTGTCGGAACAACGCCCCCAGGACCATCTTTATCATCTCCATGTACAAGGATTCCCAGCCAAGGGGGATGGCGGTCACCATCTCCGTCAAGTGCGAAAAAATCAGCACCCTGAGCTGTGAGAACAAGATCATCAGCTTCAAGGAGATGAACCCCCCAGACAACATCAAGGACACCAAGTCTGACATAATTTTCTTCCAACGGAGCGTGCCGGGCCACGACAATAAGATGCAGTTCGAGTCCAGCTCCTACGAGGGATACTTCCTGGCCTGCGAGAAGGAGAGGGACCTGTTCAAGCTGATCCTCAAGAAAGAGGACGAGCTGGGCGACAGGAGCATCATGTTCACAGTCCAGAATGAGGAC |
| 655 | IL18_WT_SN | ATGGCGGCCGAACCGGTCGAAGATAACTGTATTAACTTCGTGGCCATGAAGTTCATCGACAACACCCTGTACTTCATCGCCGAGGACGACGAGAACCTCGAGAGCGATTACTTCGGCAAGCTCGAGTCCAAGCTCAGCGTTATCCGGAACCTCAACGACCAGGTCCTCTTTATCGACCAGGGCAACCGGCCCCTTTTCGAAGACATGACGAGCTCCGATTGCCGGAACAACGCCCCGAGGACCATCTTCATCATCTCCATGTACAAGGATAGCCAGCCCAGGGGCATGGCCGTCACGATCAGCGTGAAGTGCGAGAAGATCTCCACCCTGTCCTGCGAGAATAAGATCATCAGCTTCAAGGAGATGAACCCGCCCGACAACATCAAGGATACCAAGTCGGACATCATCTTCTTTCAGAGAAGCGTCCCCGGCCATGACAATAAGATGCAGTTTGAGAGCAGCAGCTACGAGGGGTACTTCCTGGCGTGCGAGAAGGAGCGGGACCTCTTTAAACTGATCCTGAAGAAGGAGGACGAGCTGGGCGACCGGTCCATCATGTTCACCGTCCAGAATGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 656 | IL18_WT_SN | ATGGCGGCCGAACCCGTAGAGGACAACTGCATCAACTTCGTCGCCATGAAGTTTATCGACAACACCTTGTATTTCATCGCGGAGGACGACGAGAACCTCGAGTCCGACTACTTCGGCAAACTCGAAAGCAAGCTCAGCGTCATCCGAAACCTCAACGACCAGGTTCTCTTCATCGACCAGGGGAATAGGCCCCTCTTCGAAGACATGACGAGCAGCGATTGCAGGAACAACGCCCCCAGGACCATCTTCATCATCTCCATGTACAAGGACAGCCAGCCACGAGGCATGGCCGTCACGATCTCCGTGAAGTGTGAGAAGATAAGCACGCTGTCCTGCGAGAACAAGATAATCAGCTTCAAGGAGATGAACCCCCCTGATAACATCAAAGATACCAAGAGCGACATAATCTTCTTCCAGAGGTCCGTGCCCGGACATGACAACAAGATGCAGTTTGAGAGCAGCAGCTACGAGGGGTACTTCCTCGCCTGCGAGAAGGAGAGGGACCTGTTCAAGCTGATCCTCAAGAAGGAGGACGAGCTGGGGGACAGGAGCATCATGTTCACCGTGCAGAACGAGGAC |
| 657 | IL18_WT_SN | ATGGCGGCCGAGCCCGTCGAGGACAACTGCATCAATTTCGTGGCCATGAAGTTCATCGACAACACCCTCTACTTCATCGCCGAGGACGACGAAAACCTCGAGAGCGACTACTTCGGCAAGCTCGAGAGCAAGCTCTCCGTTATAAGGAACCTAAACGACCAGGTCCTTTTCATCGACCAGGGCAACAGGCCCCTCTTCGAAGACATGACCAGCAGCGACTGTAGGAATAACGCCCCCCGCACGATCTTCATCATCAGCATGTACAAGGACTCCCAGCCCCGGGGCATGGCCGTCACTATCAGTGTGAAGTGCGAGAAGATCAGCACGCTATCGTGCGAGAACAAGATCATCAGCTTCAAGGAGATGAACCCACCCGACAACATCAAGGACACCAAGAGCGACATTATCTTCTTCCAGAGGAGCGTGCCGGGCCACGACAACAAGATGCAGTTCGAGTCCTCCAGCTACGAGGGATACTTCCTGGCCTGCGAGAAGGAGCGGGATCTGTTCAAGCTGATCCTGAAGAAGGAGGACGAGCTGGGCGACAGGAGCATCATGTTCACCGTGCAGAACGAGGAC |
| 658 | IL2sp_IL18 | ATGTACAGGATGCAGCTCCTCTCCTGCATCGCCCTTAGCTTGGCCCTCGTCACCAACAGCTACTTCGGCAAGCTCGAGTCGAAGCTCTCCGTCATCCGCAACCTCAACGACCAGGTCCTCTTCATAGACCAGGGCAACCGCCCCCTCTTCGAGGACATGACCGACTCCGATTGCAGGGACAACGCCCCCAGGACCATATTCATCATCAGCATGTACAAGGACAGCCAGCCCAGGGGGATGGCCGTCACCATCTCCGTTAAGTGCGAGAAGATCAGCACACTCTCCTGCGAAAATAAGATCATCTCCTTTAAGGAGATGAACCCGCCCGACAATATCAAGGACACCAAGTCCGATATTATCTTCTTCCAGCGGAGCGTCCCCGGCCACGACAACAAGATGCAGTTCGAGTCCTCGTCGTACGAGGGCTACTTCCTGGCGTGCGAAAAGGAGCGCGACCTGTTCAAGCTCATCCTGAAGAAGGAGGACGAGCTGGGAGACAGGTCCATCATGTTCACGGTGCAGAATGAGGAC |
| 659 | IL2sp_IL18 | ATGTACCGAATGCAGCTCCTCAGCTGCATCGCGCTCAGCCTCGCCCTCGTCACCAACAGCTACTTCGGGAAGCTCGAGTCGAAGCTCAGCGTCATCCGAAACCTCAACGACCAGGTCCTCTTTATCGACCAGGGCAACAGGCCCTTATTCGAAGACATGACCGACTCAGACTGCAGGGACAACGCCCCAAGGACCATCTTTATCATTTCCATGTACAAGGACAGCCAGCCGCGGGGGATGGCCGTCACCATCAGCGTCAAGTGTGAGAAGATCAGCACGCTCAGCTGCGAGAATAAGATCATCTCCTTCAAGGAGATGAACCCTCCCGATAACATCAAGGACACCAAGTCCGATATCATCTTCTTCCAGCGGAGCGTGCCCGGCCACGACAACAAGATGCAGTTCGAATCGAGCAGCTACGAGGGCTACTTCCTGGCCTGCGAGAAGGAAAGGGATCTGTTTAAGCTGATCCTGAAGAAAGAGGATGAGCTGGGGGACAGGAGCATCATGTTTACCGTGCAGAACGAAGAC |
| 660 | IL2sp_IL18 | ATGTACAGGATGCAGCTCCTCAGCTGCATCGCCCTCTCGCTCGCGCTCGTCACCAACTCCTACTTCGGGAAGCTCGAGTCCAAGCTCTCCGTCATCAGGAACCTCAACGACCAGGTCCTCTTCATAGACCAGGGCAATAGGCCCCTCTTCGAAGATATGACCGACAGCGATTGCAGGGATAACGCCCCCCGCACCATCTTCATCATCAGCATGTACAAAGATAGCCAGCCGAGGGGCATGGCCGTCACCATCAGCGTCAAGTGCGAGAAAATCAGCACCCTCTCCTGCGAGAACAAGATCATCTCCTTCAAGGAGATGAACCCGCCCGACAACATCAAGGACACCAAGAGCGACATCATATTCTTCCAGAGGTCCGTCCCCGGCCACGATAACAAGATGCAGTTCGAGTCCAGCAGCTACGAGGGGTACTTCCTCGCCTGCGAGAAGGAGAGGGACCTGTTCAAGCTGATCCTGAAAAAGGAAGATGAACTGGGGGACCGGAGCATCATGTTCACGGTGCAGAACGAGGAC |
| 661 | IL2sp_IL18 | ATGTACCGGATGCAGCTCCTCTCCTGCATCGCCCTCAGCCTCGCCCTAGTTACCAACTCGTACTTCGGCAAGCTGGAGAGCAAGCTCTCCGTCATACGTAACCTCAACGACCAGGTCCTCTTCATAGACCAGGGCAATAGGCCCCTTTTCGAGGACATGACGGACAGCGATTGCCGGGACAACGCCCCCAGAACCATCTTCATCATCAGCATGTACAAGGACTCCCAGCCGAGGGGCATGGCCGTCACCATCTCCGTAAAGTGCGAGAAGATCTCCACCCTCAGCTGCGAGAACAAGATCATCAGCTTTAAGGAGATGAACCCGCCGGATAATATA |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | AAGGACACCAAGTCCGACATTATCTTCTTCCAACGGTCGGTGCCCGGC CATGACAACAAGATGCAGTTCGAGAGCAGCTCCTACGAGGGGTACTTT CTGGCCTGCGAAAAGAGAGGGATCTGTTCAAGCTGATCCTCAAGAAG GAGGACGAGCTGGGGGACAGGTCGATCATGTTCACCGTGCAGAACGAG GAC |
| 662 | IL2sp_IL18 | ATGTACAGGATGCAGCTCCTAAGCTGCATCGCCCTCAGCCTCGCGCTC GTCACCAACAGCTATTTCGGCAAGCTAGAGAGCAAGCTCTCCGTCATC CGGAATTTAAACGACCAGGTCCTATTCATCGACCAGGGAAACCGCCCC CTCTTCGAGGACATGACCGACAGCGACTGCCGGGACAACGCTCCCAGG ACGATCTTTATCATCAGCATGTACAAGGACAGCCAGCCGCGCGGCATG GCCGTCACCATAAGCGTCAAGTGCGAAAAGATCAGCACGCTTAGCTGC GAGAACAAAATCATCTCCTTCAAGGAGATGAACCCTCCCGACAACATA AAGGATACCAAGAGTGACATCATCTTCTTTCAGCGGAGCGTCCCCGGC CACGACAACAAGATGCAGTTCGAGAGCAGCTCCTACGAGGGGTACTTC CTCGCCTGCGAGAAGGAGAGGGACCTGTTCAAGCTCATCCTGAAGAAG GAAGACGAGCTGGGGGATAGGAGCATCATGTTCACGGTGCAGAACGAG GAC |
| 663 | IL2sp_IL18 | ATGTACCGGATGCAGCTACTCAGCTGCATCGCCCTCAGCTTGGCCCTG GTCACCAACTCCTACTTCGGGAAGTTGGAATCCAAGCTCTCCGTTATC AGGAATCTCAACGACCAGGTCCTCTTCATCGACCAGGGCAACCGCCCC TTGTTCGAGGACATGACCGACTCCGACTGCAGGGACAACGCCCCCCGT ACCATCTTCATCATCAGCATGTACAAGGACAGCCAGCCCAGGGGTATG GCCGTCACCATCAGCGTCAAGTGCGAGAAGATTAGCACTCTCAGCTGT GAGAACAAAATAATCAGCTTCAAGGAGATGAACCCCCCGGACAACATA AAAGATACCAAGTCCGACATCATCTTCTTTCAGAGGAGCGTCCCCGGC CATGACAACAAGATGCAGTTCGAGAGCAGCAGTTACGAAGGCTACTTC CTGGCCTGCGAGAAGGAGAGGGACCTGTTCAAGCTGATCCTGAAGAAG GAGGACGAGCTGGGGGATCGGAGCATAATGTTCACCGTGCAGAATGAG GAC |
| 664 | IL2sp_IL18 | ATGTACAGGATGCAGCTCCTTAGCTGCATCGCGCTCTCCCTCGCCCTC GTCACCAACTCCTACTTCGGCAAATTGGAGTCCAAGCTCAGCGTCATC CGAAATCTAAACGATCAGGTCTTGTTTATCGACCAGGGGAACCGCCCC CTCTTCGAGGACATGACCGACTCCGACTGCAGGGACAACGCCCCCAGG ACTATCTTCATCATCAGCATGTACAAGGACAGCCAGCCCAGGGGTATG GCCGTAACCATCAGCGTCAAGTGCGAGAAGATCTCCACCCTCAGCTGT GAAAACAAGATAATCTCCTTCAAGGAGATGAACCCCCCAGATAACATA AAAGATACCAAGTCGGACATCATCTTCTTCCAGAGGTCGGTGCCCGGC CACGACAACAAGATGCAGTTCGAAAGCTCCAGCTACGAGGGCTACTTT TTAGCCTGTGAAAAGGAGCGGGACCTGTTCAAGCTGATTCTGAAGAAG GAGGACGAGCTGGGGGACAGGAGCATCATGTTCACCGTGCAGAACGAG GAC |
| 665 | IL2sp_IL18 | ATGTACAGGATGCAACTCCTAAGTTGCATCGCCCTCAGCCTCGCGCTC GTTACCAATAGCTACTTCGGCAAGCTCGAGAGCAAGCTCTCCGTCATT AGGAACCTAAACGACCAGGTCCTCTTCATCGACCAGGGGAATAGGCCC CTCTTCGAGGATATGACGGACAGCGACTGCAGAGACAACGCGCCCAGG ACGATCTTCATCATCAGCATGTACAAGGACAGCCAGCCCCGCGGCATG GCCGTCACAATCTCCGTCAAGTGCGAGAAGATCTCCACGCTCTCGTGC GAGAACAAGATCATCAGCTTCAAGGAGATGAACCCTCCCGACAATATC AAGGACACCAAGTCCGACATCATCTTCTTCCAGAGGTCCGTGCCCGGA CACGACAACAAGATGCAGTTCGAGTCCAGCTCCTACGAGGGCTATTTT CTGGCGTGCGAGAAGGAGCGGGACCTGTTCAAGCTGATCCTCAAGAAG GAGGATGAGCTGGGGGACAGGAGCATCATGTTCACCGTCCAGAACGAG GAC |
| 666 | IL2sp_IL18 | ATGTACAGGATGCAGTTGCTCAGCTGCATCGCCCTCAGCCTCGCCCTT GTAACCAACAGCTATTTCGGGAAGCTTGAGAGCAAGTTGAGCGTCATC AGGAACTTGAACGACCAGGTACTCTTCATCGACCAGGGCAACCGGCCT CTCTTCGAGGACATGACGGACTCGGATTGCAGGGACAACGCCCCCAGG ACCATCTTCATCATCAGCATGTACAAGGACTCCCAGCCCCGGGGGATG GCCGTCACGATCTCCGTAAAGTGCGAGAAAATCAGCACCCTCAGCTGC GAGAACAAAATCATCAGCTTCAAGGAGATGAACCCGCCCGACAATATC AAGGACACCAAGTCCGACATCATCTTCTTCCAGAGGTCGGTGCCCGGC CACGATAACAAGATGCAATTCGAGTCGAGCTCTTATGAGGGCTACTTC CTGGCCTGCGAAAAGGAGCGCGACCTGTTCAAGCTGATCCTGAAGAAG GAGGACGAGCTGGGCGATCGGAGCATCATGTTCACGGTGCAGAACGAG GAC |
| 667 | IL2sp_IL18 | ATGTACAGGATGCAGCTCCTTAGCTGCATCGCCCTCTCCCTCGCCCTC GTCACCAACTCCTACTTCGGCAAGCTCGAGAGTAAGCTTTCCGTCATT CGCAACCTTAACGACCAGGTACTCTTCATCGACCAGGGCAACCGCCCC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTCTTCGAGGACATGACCGACTCCGACTGCAGGGACAACGCGCCCCGA<br>ACCATTTTCATCATCAGCATGTACAAGGACTCCCAACCGAGGGGGATG<br>GCCGTCACAATCAGCGTCAAGTGCGAAAAGATAAGCACGCTCTCCTGC<br>GAGAATAAGATCATCTCCTTCAAGGAGATGAATCCGCCGGACAACATC<br>AAGGATACAAAGAGCGATATTATCTTCTTCCAGCGGAGCGTGCCGGGG<br>CACGACAACAAGATGCAGTTTGAGAGCTCCAGCTACGAGGGCTACTTC<br>CTGGCCTGCGAGAAGGAGCGTGACCTGTTCAAGCTCATCCTGAAGAAG<br>GAGGACGAGCTGGGGGACCGCAGCATCATGTTTACCGTGCAGAATGAG<br>GAC |
| 668 | IL2sp_IL18 | ATGTACCGTATGCAGCTCCTCAGTTGCATCGCCCTCAGCTTGGCCCTA<br>GTCACCAATAGCTACTTCGGGAAGCTCGAGAGCAAACTCTCCGTGATA<br>AGGAACCTCAACGATCAGGTCCTCTTCATCGACCAGGGCAACAGGCCG<br>CTGTTCGAGGACATGACCGATTCCGACTGCCGGGACAACGCCCCCCGG<br>ACCATCTTCATCATTAGCATGTATAAAGATAGCCAGCCGAGGGGCATG<br>GCCGTCACCATCAGCGTCAAGTGCGAGAAGATCAGCACCCTCAGCTGC<br>GAGAACAAGATCATCAGCTTTAAGGAGATGAATCCCCCTGACAACATA<br>AAGGACACCAAGAGCGATATTATCTTCTTCCAGCGCAGCGTGCCGGGG<br>CATGATAACAAGATGCAGTTCGAGAGCAGCAGCTACGAGGGGTATTTC<br>CTGGCCTGCGAGAAGGAGAGGGACCTCTTCAAGCTGATCCTGAAGAAG<br>GAGGACGAGCTGGGCGACCGGAGCATCATGTTTACGGTGCAGAACGAG<br>GAC |
| 669 | IL2sp_IL18 | ATGTACAGGATGCAGCTCCTCTCCTGCATCGCTCTCTCCCTCGCCCTC<br>GTCACCAACAGCTACTTCGGAAAGCTCGAGTCCAAGCTCAGCGTCATC<br>CGGAACCTAAACGACCAGGTCCTCTTCATCGATCAGGGGAACAGGCCC<br>CTCTTCGAGGACATGACCGACAGCGACTGCCGAGACAACGCCCCCCGG<br>ACCATCTTCATCATCAGTATGTACAAGGACAGCCAGCCCCGCGGCATG<br>GCCGTCACCATCTCCGTCAAGTGTGAGAAGATCAGCACGCTCAGCTGT<br>GAGAACAAGATCATCAGCTTCAAGGAGATGAACCCGCCCGATAACATC<br>AAGGACACCAAGAGCGACATCATCTTCTTCCAAAGGTCCGTCCCGGGT<br>CACGATAACAAGATGCAGTTCGAGAGCAGCAGCTACGAGGGCTACTTC<br>CTGGCCTGCGAGAAGGAGCGGGACCTGTTCAAGCTGATCCTGAAGAAA<br>GAGGACGAGCTCGGGGACCGCTCCATCATGTTCACCGTGCAGAACGAG<br>GAC |
| 670 | IL2sp_IL18 | ATGTACCGGATGCAGCTTCTCTCCTGCATCGCCCTCTCCCTAGCCCTC<br>GTAACCAACAGCTACTTCGGAAAGCTCGAGAGCAAGCTCTCCGTCATC<br>AGGAATCTCAACGACCAGGTTCTCTTTATCGACCAGGGGAATAGGCCC<br>CTATTCGAGGACATGACCGACAGCGACTGCAGGGATAACGCCCCCCGC<br>ACCATCTTCATCATCTCCATGTACAAGGACAGCCAGCCCAGGGGCATG<br>GCCGTCACCATCTCGGTCAAGTGCGAGAAAATCAGCACCCTCAGCTGC<br>GAGAACAAGATTATCAGCTTTAAGGAGATGAACCCCCCTGATAACATC<br>AAGGACACCAAAAGCGACATAATCTTCTTCCAGAGGAGCGTGCCCGGC<br>CACGATAACAAGATGCAATTCGAGTCCAGCAGCTACGAGGGCTACTTC<br>CTGGCCTGCGAGAAGGAGAGGGACCTGTTTAAGCTCATCCTGAAGAAG<br>GAGGACGAGCTGGGGGACCGGTCCATCATGTTCACTGTGCAGAACGAG<br>GAC |
| 671 | IL2sp_IL18 | ATGTACAGGATGCAACTCCTCTCGTGCATCGCCCTCAGCCTGGCACTC<br>GTAACCAACTCCTACTTCGGGAAGTTGGAGAGCAAGCTCTCGGTCATC<br>AGGAATCTCAACGACCAGGTCCTCTTCATAGACCAGGGCAACCGGCCC<br>CTCTTCGAGGACATGACCGACTCCGATTGCCGAGACAACGCCCCCAGG<br>ACCATCTTCATCATCAGCATGTACAAGGACTCCCAGCCCAGGGGGATG<br>GCCGTCACGATCTCCGTCAAGTGCGAGAAGATAAGCACCCTCAGCTGC<br>GAGAACAAAATCATATCCTTCAAGGAGATGAACCCGCCCGACAACATC<br>AAGGACACCAAGTCCGATATCATATTTTTCCAGCGGTCCGTGCCGGGG<br>CACGACAACAAGATGCAGTTCGAGTCCAGCTCCTATGAGGGGTATTTT<br>CTGGCGTGCGAGAAGGAGCGGGACCTGTTCAAGCTCATCCTGAAGAAG<br>GAGGACGAGCTGGGCGACCGCTCCATCATGTTCACCGTGCAGAACGAG<br>GAC |
| 672 | IL2sp_IL18 | ATGTACCGCATGCAGTTGCTTAGCTGCATCGCCCTCTCCCTAGCACTC<br>GTCACCAACAGCTACTTCGGCAAGCTCGAGTCCAAGCTCTCCGTCATA<br>AGGAACCTCAACGACCAGGTCCTCTTCATCGACCAGGGGAACAGGCCC<br>CTCTTCGAGGATATGACCGACTCCGACTGCAGGGACAACGCCCCCAGG<br>ACCATCTTTATCATCAGCATGTACAAGGATAGCCAGCCTCGGGGCATG<br>GCGGTCACCATCTCCGTCAAGTGTGAGAAGATCTCCACGTTGTCCTGC<br>GAGAACAAGATCATCTCCTTCAAGGAGATGAACCCGCCCGACAACATC<br>AAGGACACTAAATCCGACATCATTTTCTTCCAGAGGTCCGTGCCCGGG<br>CATGACAATAAGATGCAGTTCGAGAGCTCCAGCTACGAGGGCTACTTC<br>CTTGCCTGTGAGAAGGAGCGGGACCTGTTCAAGCTCATACTGAAGAAG<br>GAGGACGAGCTGGGGGACCGGAGCATTATGTTCACCGTGCAGAACGAG<br>GAT |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 673 | IL2sp_IL18 | ATGTACCGCATGCAGCTCTTAAGCTGTATCGCCCTCAGCCTCGCCCTC<br>GTGACCAACTCATACTTCGGCAAGCTCGAGAGCAAGCTTAGCGTCATC<br>AGGAACCTTAACGACCAGGTCCTTTTCATCGATCAGGGGAACCGGCCC<br>CTCTTCGAAGACATGACCGACAGCGACTGTAGGGACAACGCGCCCCGA<br>ACCATCTTCATAATCAGCATGTACAAGGACAGCCAGCCGAGGGGCATG<br>GCCGTCACCATCAGCGTCAAGTGCGAGAAGATCAGCACGCTCAGCTGC<br>GAGAACAAGATCATCTCCTTCAAGGAGATGAACCCGCCCGACAACATC<br>AAGGACACGAAGTCCGACATAATTTTCTTCCAGCGCTCCGTGCCGGGG<br>CATGACAACAAAATGCAGTTCGAGAGCAGCAGCTACGAGGGCTACTTC<br>CTCGCCTGCGAGAAGGAGAGGGACCTGTTTAAGCTGATCCTGAAAAAG<br>GAGGACGAACTGGGGGACAGGAGCATCATGTTTACCGTGCAGAATGAG<br>GAT |
| 674 | IL2sp_IL18 | ATGTACCGGATGCAGTTGCTCAGCTGCATCGCCCTCAGCCTCGCCCTC<br>GTCACCAACTCCTACTTCGGCAAGCTCGAAAGCAAGCTCTCCGTAATC<br>CGCAACCTCAACGATCAGGTTTTATTCATCGACCAGGGTAACAGGCCC<br>CTCTTCGAGGACATGACCGACAGCGACTGCAGGGACAACGCCCCCCGG<br>ACCATTTTTATCATCTCCATGTACAAAGATAGCCAGCCGAGGGGGATG<br>GCCGTCACCATCTCCGTCAAGTGCGAAAAGATCAGCACTCTCAGCTGC<br>GAGAACAAAATCATCAGCTTCAAGGAGATGAATCCCCCCGACAACATC<br>AAGGACACCAAGAGCGACATCATCTTCTTCCAGAGGAGCGTACCTGGC<br>CACGATAACAAGATGCAGTTCGAGTCCAGCAGCTACGAGGGGTACTTC<br>CTGGCCTGTGAGAAGGAGAGGGACCTGTTCAAGCTCATCCTCAAAAAG<br>GAGGACGAGCTGGGGGACCGGAGCATCATGTTCACGGTGCAGAACGAG<br>GAC |
| 675 | IL2sp_IL18 | ATGTACCGGATGCAGTTGCTCAGCTGCATCGCGCTCTCGCTCGCCCTC<br>GTCACCAATTCCTACTTCGGCAAGCTCGAGAGCAAGTTGTCCGTCATC<br>CGCAACCTCAACGATCAGGTCCTCTTCATCGATCAGGGCAACCGGCCC<br>CTCTTCGAGGACATGACGGACAGCGACTGCCGCGATAACGCCCCCCGC<br>ACCATCTTCATCATCAGCATGTACAAGGACAGCCAGCCCCGGGGCATG<br>GCCGTTACCATCAGCGTCAAGTGCGAGAAGATCAGCACCCTCTCGTGC<br>GAGAACAAAATCATCAGCTTCAAGGAGATGAACCCTCCCGATAACATC<br>AAAGACACCAAGAGCGACATCATCTTCTTCCAGCGGAGCGTGCCCGGC<br>CACGACAACAAGATGCAGTTCGAGTCCAGCAGCTACGAGGGCTACTTC<br>CTCGCCTGCGAGAAGGAAAGGGACCTGTTCAAGCTGATCCTGAAAAAG<br>GAGGACGAACTGGGGGACAGGAGCATTATGTTCACCGTCCAGAACGAG<br>GAC |
| 676 | IL2sp_IL18 | ATGTACCGCATGCAGCTCTTGAGCTGCATCGCCTTAAGCCTCGCCCTC<br>GTCACCAATAGCTATTTCGGCAAGCTCGAGAGCAAGCTCTCCGTAATT<br>AGGAACCTCAACGACCAGGTCCTCTTTATCGACCAGGGCAATAGGCCC<br>CTCTTCGAGGACATGACCGACTCCGACTGCAGGGACAACGCCCCCAGG<br>ACCATCTTCATCATCAGCATGTATAAAGACTCCCAACCCAGGGGTATG<br>GCCGTCACCATCAGCGTCAAGTGCGAGAAGATCAGCACCCTCTCCTGC<br>GAGAATAAGATAATAAGCTTCAAGGAAATGAACCCGCCCGACAACATC<br>AAAGACACGAAAAGCGACATCATTTTCTTCCAGAGGAGCGTGCCCGGC<br>CACGACAATAAGATGCAGTTCGAGAGCTCGAGCTACGAGGGGTATTTC<br>CTGGCGTGCGAGAAGGAGAGGGACCTGTTCAAGCTCATCCTCAAGAAG<br>GAGGATGAGCTGGGCGATCGCTCCATCATGTTCACCGTGCAGAACGAG<br>GAC |
| 677 | IL2sp_IL18 | ATGTACAGGATGCAGCTCCTCAGCTGCATCGCGCTCAGTCTAGCCCTT<br>GTAACCAACTCCTACTTCGGCAAACTAGAGAGTAAGCTCTCCGTCATC<br>CGGAATCTCAACGACCAGGTCCTCTTCATCGACCAGGGCAACCGGCCG<br>CTGTTCGAGGATATGACGGATAGCGATTGCAGGGACAACGCCCCCAGG<br>ACTATCTTCATCATCAGCATGTACAAGGACAGCCAGCCCCGAGGCATG<br>GCCGTAACCATCTCCGTAAAGTGCGAGAAAATCTCCACCCTCAGCTGC<br>GAGAACAAAATCATCTCCTTCAAGGAGATGAACCCACCCGATAACATC<br>AAGGACACGAAAAGCGACATCATCTTTTTCCAGAGGAGCGTCCCCGGC<br>CATGACAACAAAATGCAGTTCGAGAGTAGCAGCTACGAGGGCTACTTC<br>CTGGCGTGCGAGAAGGAGAGGGACCTGTTCAAGCTCATCCTCAAGAAG<br>GAGGACGAGCTGGGCGACAGGAGCATAATGTTCACGGTGCAGAACGAG<br>GAC |
| 678 | IL2sp_IL18 | ATGTACAGGATGCAGCTCCTAAGCTGCATCGCCCTCAGCCTAGCCCTT<br>GTCACCAACAGCTACTTCGGGAAGCTCGAGAGCAAACTCTCCGTCATC<br>CGGAACCTCAACGACCAGGTCCTCTTCATCGACCAGGGCAACAGGCCC<br>CTCTTCGAGGACATGACCGATAGCGACTGCAGGGACAACGCCCCCCGG<br>ACCATCTTCATCATCAGCATGTACAAGGACAGCCAGCCCCGAGGCATG<br>GCCGTAACCATAAGCGTCAAGTGCGAGAAGATCTCCACCCTCAGCTGC<br>GAGAACAAAATCATCAGCTTCAAGGAGATGAACCCCCCGGACAATATC<br>AAGGACACCAAGAGCGATATCATCTTCTTTCAGCGGTCCGTCCCAGGT<br>CACGACAACAAGATGCAGTTCGAGAGCAGCAGCTATGAGGGCTACTTC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTCGCCTGCGAGAAGGAGAGGGACCTGTTCAAGCTCATCCTGAAAAAG GAGGATGAGCTGGGGGACCGCAGCATCATGTTCACCGTGCAGAATGAG GAC |
| 679 | IL2sp_IL18 | ATGTACAGGATGCAGCTCCTCTCCTGCATAGCCCTCTCGCTCGCCCTC GTAACCAACTCCTACTTCGGCAAGTTGGAGTCCAAGTTGTCGGTAATC CGGAACTTGAACGATCAGGTCCTCTTCATAGATCAGGGCAACCGGCCC CTCTTCGAGGATATGACCGACTCCGACTGCCGGGACAACGCCCCGCGC ACCATCTTCATTATCTCCATGTACAAAGATAGCCAGCCGAGGGGTATG GCCGTCACCATCAGCGTAAAGTGTGAAAAGATCTCCACACTCTCGTGC GAGAACAAAATCATCTCCTTTAAGGAGATGAACCCTCCCGACAACATC AAGGACACCAAGAGCGATATCATATTCTTTCAAAGGTCCGTGCCCGGC CACGACAACAAGATGCAGTTCGAGAGCAGCAGCTACGAGGGGTACTTC CTGGCCTGCGAGAAAGAACGGGACCTCTTCAAGCTGATCCTCAAGAAG GAGGACGAGCTGGGGGACCGGAGCATCATGTTCACCGTCCAGAACGAA GAC |
| 680 | IL2sp_IL18 | ATGTATCGGATGCAGCTCTTGAGCTGTATCGCCCTCAGCCTTGCGCTA GTCACAAACTCCTACTTCGGCAAGCTCGAGAGCAAGCTCTCCGTCATC AGGAACCTCAACGACCAGGTCCTCTTTATCGATCAGGGGAACAGGCCG CTTTTCGAGGACATGACGGACAGCGATTGCAGGGATAACGCGCCGAGG ACCATCTTCATCATCTCCATGTACAAGGACAGCCAGCCCAGGGGCATG GCCGTAACCATCTCCGTAAAGTGCGAGAAGATCTCGACCCTCAGCTGC GAGAATAAGATCATCAGCTTCAAGGAGATGAACCCTCCCGACAACATC AAGGACACCAAGTCCGACATCATCTTTTTCCAACGGAGCGTTCCCGGA CACGATAACAAGATGCAGTTTGAGAGCTCCTCCTACGAGGGGTACTTC CTGGCGTGCGAGAAGGAGAGGGACCTGTTCAAGCTGATCCTGAAGAAG GAAGACGAGCTCGGCGACAGAAGCATCATGTTCACCGTGCAGAACGAA GAC |
| 681 | IL2sp_IL18 | ATGTACCGCATGCAGCTCCTCAGCTGCATCGCCCTAAGCTTGGCCCTT GTCACCAACAGCTACTTCGGCAAGCTCGAGAGCAAGTTGAGCGTTATC AGGAACTTGAACGACCAGGTCTTGTTCATCGACCAGGGCAACCGGCCC CTATTCGAGGACATGACCGATAGCGATTGCCGGGACAACGCACCGAGA ACCATCTTCATCATCAGCATGTACAAGGACAGCCAACCCCGGGGCATG GCGGTAACCATCAGCGTTAAGTGCGAGAAGATCAGTACCCTCAGCTGC GAGAACAAGATCATCAGCTTCAAGGAGATGAACCCGCCCGACAATATC AAGGATACAAAGAGCGACATCATCTTTTTCCAGCGAAGCGTGCCCGGC CACGACAACAAAATGCAGTTCGAGTCGTCGAGCTACGAGGGATATTTC CTGGCGTGCGAGAAGGAGAGGGACCTGTTCAAACTCATCCTCAAGAAG GAGGACGAGCTGGGGGATAGGAGCATCATGTTCACCGTGCAGAACGAG GAC |
| 682 | IL2sp_IL18 | ATGTATCGGATGCAGCTCCTAAGCTGCATAGCCCTAAGCCTTGCCTTG GTCACCAATAGCTACTTCGGGAAGCTTGAAAGCAAGCTCTCCGTCATC CGGAATTTAAACGACCAGGTCCTTTTCATCGATCAGGGCAACAGGCCC CTCTTCGAGGACATGACCGACAGCGACTGCCGGGACAACGCCCCCAGG ACGATTTTCATCATCAGCATGTACAAGGATTCCCAGCCCCGGGGCATG GCCGTCACCATCAGCGTCAAGTGCGAGAAGATCTCCACCCTTAGCTGT GAGAACAAGATCATTAGCTTCAAGGAGATGAACCCGCCCGACAACATC AAGGACACCAAAAGCGATATCATCTTCTTCCAGCGGAGCGTCCCGGGC CACGACAACAAAATGCAGTTCGAGAGCAGCAGCTACGAGGGCTACTTT CTCGCCTGCGAGAAAGAGAGGGATCTGTTCAAGCTCATCCTGAAGAAG GAGGACGAGCTGGGGGATCGGAGCATCATGTTCACCGTGCAGAACGAG GAC |
| 683 | IL2sp_IL18_SN | ATGTATAGGATGCAGCTCCTTAGCTGCATCGCCCTCAGCTTGGCCCTC GTCACCAACTCCTACTTCGGGAAGCTTGAGAGCAAGCTCAGCGTCATC AGGAACCTTAACGATCAGGTTCTATTCATCGACCAGGGGAACAGGCCC CTCTTCGAAGACATGACCAGCAGCGATTGCCGGAACAACGCCCCCCGG ACCATCTTCATCATCTCCATGTACAAGGACAGCCAACCCAGGGGCATG GCGGTCACCATCTCCGTCAAGTGCGAGAAGATCAGCACCCTCTCGTGC GAAAACAAGATCATATCGTTCAAGGAGATGAACCCGCCCGACAACATA AAGGACACCAAGTCCGACATCATCTTCTTTCAGCGGTCCGTGCCCGGG CATGATAACAAGATGCAATTCGAGAGCTCCAGCTACGAGGGGTACTTC CTGGCCTGCGAGAAGGAGAGGGACCTGTTCAAGCTGATCCTCAAGAAG GAGGACGAGCTCGGCGACCGGAGCATCATGTTCACCGTCCAGAACGAG GAT |
| 684 | IL2sp_IL18_SN | ATGTACAGGATGCAGCTCCTCAGCTGCATCGCCCTCTCCCTCGCGCTC GTCACGAACTCCTACTTCGGCAAGCTCGAGAGCAAGCTCTCCGTCATC AGGAATCTCAACGACCAAGTCCTCTTTATCGACCAGGGCAACCGGCCG CTGTTCGAGGACATGACCTCCTCCGACTGCCGGAACAACGCCCCTAGG ACGATCTTCATCATCAGCATGTACAAGGACTCACAGCCCAGGGGCATG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GCGGTAACCATCAGCGTCAAGTGCGAGAAAATCAGCACACTCAGCTGC GAGAACAAGATCATCTCCTTCAAGGAGATGAACCCGCCCGACAACATC AAGGACACGAAGTCCGACATCATCTTCTTTCAGAGGAGCGTGCCGGGC CACGACAACAAGATGCAGTTCGAAAGCTCCAGCTACGAGGGGTATTTC CTGGCCTGCGAGAAGGAACGCGATCTGTTCAAGCTCATCCTCAAGAAA GAGGACGAGCTGGGGGACCGGTCCATCATGTTCACCGTGCAGAACGAG GAC |
| 685 | IL2sp_IL18_SN | ATGTACAGGATGCAGCTCCTAAGCTGCATCGCCCTCTCCCTCGCGCTC GTCACCAACTCCTATTTCGGGAAGCTGGAGAGCAAGCTCAGCGTAATC AGAAATCTTAACGACCAGGTCTTATTCATCGATCAGGGGAATCGTCCC CTCTTCGAGGACATGACCTCGAGCGACTGCAGGAACAACGCCCCCCGA ACCATCTTCATAATCTCCATGTACAAGGACAGCCAGCCCAGGGGCATG GCCGTCACCATCAGCGTAAAGTGCGAGAAGATCAGCACTCTCTCCTGT GAGAATAAAATCATCAGCTTCAAGGAGATGAACCCGCCCGATAACATA AAGGACACGAAAAGCGACATCATCTTCTTCCAGAGGAGCGTCCCCGGG CATGACAACAAGATGCAGTTCGAGAGCAGCAGCTACGAGGGCTACTTC CTGGCCTGCGAAAAGGAAAGGGACCTGTTCAAACTGATCCTGAAGAAG GAGGACGAGCTGGGGGACAGGAGCATCATGTTCACGGTGCAGAATGAG GAC |
| 686 | IL2sp_IL18_SN | ATGTACAGGATGCAGCTCCTCAGCTGCATCGCGCTTTCTCTCGCCCTT GTCACCAACAGCTACTTCGGTAAGCTCGAGAGCAAGTTGAGCGTCATC AGGAACCTCAACGACCAGGTCCTCTTCATCGACCAGGGCAACCGGCCC TTGTTCGAGGACATGACGTCCTCCGACTGTAGGAACAACGCCCCGAGG ACCATCTTCATCATCTCCATGTACAAGGACAGCCAGCCCCGGGGGATG GCCGTCACCATCTCCGTCAAGTGCGAGAAGATCTCCACGCTCTCCTGC GAGAACAAGATAATCAGCTTCAAGGAGATGAACCCGCCCGACAATATT AAGGACACGAAGTCCGACATCATCTTTTTCCAACGTAGCGTGCCGGGC CACGACAACAAGATGCAGTTCGAGTCCAGCAGCTACGAGGGGTACTTC CTGGCCTGCGAGAAAGAGCGGGACCTGTTCAAGCTCATACTCAAGAAG GAGGACGAGCTGGGCGACCGGAGCATCATGTTCACCGTGCAAAATGAA GAC |
| 687 | IL2sp_IL18_SN | ATGTACAGGATGCAGCTACTCAGCTGCATCGCCCTCTCCCTCGCCCTC GTAACGAACTCCTACTTCGGCAAGCTAGAGAGCAAGCTCAGCGTCATC CGGAATCTCAACGACCAGGTCCTCTTCATAGACCAGGGCAATAGGCCC CTCTTCGAGGATATGACCAGCTCCGACTGTAGGAACAACGCCCCCAGG ACCATCTTCATAATCAGCATGTACAAGGACTCCCAGCCCCGGGGCATG GCCGTCACCATCTCGGTGAAGTGCGAGAAGATCAGCACGCTCAGCTGC GAAAACAAGATCATCTCCTTCAAGGAGATGAACCCTCCCGATAACATC AAAGACACCAAGTCCGACATCATCTTCTTCCAGAGGAGCGTCCCTGGC CATGACAACAAGATGCAGTTTGAGAGCTCGAGCTATGAGGGGTACTTC CTGGCCTGTGAGAAGGAGCGGGACCTCTTCAAGCTGATCCTGAAGAAG GAGGACGAGCTGGGGGACAGGTCCATCATGTTCACCGTGCAGAACGAG GAC |
| 688 | IL2sp_IL18_SN | ATGTACAGGATGCAGCTCCTCTCCTGCATCGCCCTTAGCTTAGCCCTC GTCACCAACTCCTATTTCGGGAAGCTTGAGAGCAAGCTCTCGGTCATC AGGAACCTTAACGACCAGGTCCTCTTCATCGACCAGGGCAACCGCCCC CTCTTCGAGGACATGACCAGCAGCGACTGCCGCAACAACGCCCCCCGG ACGATCTTCATTATCTCCATGTACAAGGACTCCCAGCCCAGGGGCATG GCCGTGACCATCTCGGTCAAGTGCGAGAAGATCAGCACGCTCTCCTGT GAGAACAAGATCATCTCGTTCAAGGAGATGAACCCTCCCGACAACATC AAGGATACCAAGTCAGACATAATCTTCTTCCAGAGGAGCGTGCCCGGC CACGACAACAAGATGCAGTTCGAGAGCTCCAGCTACGAGGGCTACTTT CTGGCCTGCGAAAAGGAGCGCGACCTCTTCAAGCTGATCCTGAAGAAG GAGGACGAGCTGGGGGACCGGAGCATCATGTTCACCGTGCAGAACGAG GAC |
| 689 | IL2sp_IL18_SN | ATGTACCGTATGCAGCTCTTGTCCTGCATCGCCCTTAGCCTCGCCCTA GTTACCAACAGCTATTTCGGCAAGCTCGAAAGCAAGCTTAGCGTCATC AGGAACCTCAACGACCAGGTTCTTTTCATCGACCAGGGCAACAGGCCC CTCTTCGAGGATATGACCTCCAGCGACTGCAGGAACAACGCACCCAGG ACCATCTTCATCATCTCCATGTACAAGGACAGCCAGCCCAGGGGCATG GCCGTCACCATCTCCGTCAAGTGTGAGAAGATCAGCACGCTCTCCTGC GAGAACAAGATCATCTCCTTCAAGGAGATGAACCCCCCAGATAACATC AAGGACACCAAGTCCGACATCATATTCTTCCAGCGGAGCGTGCCGGGG CACGACAACAAGATGCAGTTCGAGAGCAGCAGCTACGAGGGCTACTTC CTGGCGTGCGAGAAGGAGAGGGACCTGTTCAAGCTGATCCTCAAGAAG GAGGATGAGCTGGGTGATAGGAGCATCATGTTCACGGTGCAGAACGAG GAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 690 | IL2sp_IL18_SN | ATGTATCGGATGCAGTTACTCTCCTGCATAGCCTTGAGCCTCGCCCTC GTCACCAACTCCTACTTCGGCAAGCTAGAGAGCAAGCTCTCGGTCATC AGGAATCTCAACGACCAGGTCCTCTTTATCGATCAGGGCAACAGGCCC CTCTTCGAGGACATGACTTCGTCGGACTGCAGGAACAACGCCCCTAGG ACCATCTTCATCATTAGCATGTACAAGGACTCCCAGCCCAGGGGCATG GCCGTAACCATCAGCGTTAAGTGCGAGAAAATCAGCACCTTATCCTGC GAGAACAAGATCATCTCCTTCAAGGAGATGAACCCTCCCGACAACATC AAAGACACCAAGAGCGACATCATCTTTTTCCAGAGGTCGGTGCCCGGC CACGACAATAAGATGCAGTTTGAGAGCTCAAGCTACGAGGGCTACTTT CTGGCCTGCGAGAAGGAGAGGGATCTGTTCAAGCTGATCCTGAAGAAG GAGGACGAGCTGGGGGACAGGTCCATAATGTTCACCGTGCAGAACGAG GAC |
| 691 | IL2sp_IL18_SN | ATGTACAGGATGCAGCTCTTAAGCTGCATCGCCTTGTCCCTCGCCCTC GTCACCAATTCCTACTTCGGCAAGCTCGAAAGCAAGCTCTCCGTCATC CGGAACCTCAACGACCAGGTCTTGTTCATCGACCAGGGGAATCGTCCC CTCTTCGAGGACATGACCAGCTCCGACTGCAGGAACAACGCCCCCAGG ACCATCTTCATCATCTCCATGTACAAGGACAGCCAGCCACGGGGCATG GCCGTCACCATCAGCGTCAAGTGCGAGAAGATCAGCACGCTCAGCTGC GAAAATAAGATCATCAGCTTCAAGGAGATGAACCCGCCAGACAATATA AAGGACACCAAGAGCGACATCATCTTCTTCCAAAGGAGCGTCCCCGGC CACGACAACAAGATGCAGTTCGAGTCCAGCTCCTACGAGGGGTATTTC TTGGCGTGTGAGAAGGAGAGGGATCTCTTCAAGCTGATCCTGAAGAAA GAGGACGAGCTGGGCGATAGGAGCATCATGTTCACCGTGCAGAACGAG GAC |
| 692 | IL2sp_IL18_SN | ATGTACCGGATGCAGCTTCTCAGCTGCATCGCCCTCAGCCTAGCGCTC GTAACCAATAGCTATTTCGGGAAGCTCGAGAGCAAGCTCAGCGTCATC CGAAACCTCAACGACCAGGTCCTTTTCATCGACCAGGGGAACAGGCCC CTCTTCGAGGACATGACCTCCAGCGACTGCCGGAACAACGCCCCTCGG ACGATCTTCATCATCTCCATGTACAAGGACTCACAGCCCCGGGGCATG GCGGTTACCATCTCCGTTAAGTGCGAGAAGATCAGCACCCTCAGCTGC GAGAACAAGATCATCTCCTTCAAGGAGATGAACCCGCCCGACAATATC AAGGATACGAAAAGCGATATCATCTTCTTTCAGAGGAGCGTGCCGGGC CATGACAACAAGATGCAGTTCGAGAGCAGCAGCTATGAGGGCTATTTC CTGGCTTGCGAGAAGGAAAGGGACCTTTTCAAGCTCATCCTGAAGAAG GAGGATGAACTGGGGGACAGGAGCATCATGTTCACCGTCCAGAACGAG GAC |
| 693 | IL2sp_IL18_SN | ATGTACCGTATGCAGCTCCTTAGCTGCATCGCCCTTAGCCTCGCGCTC GTTACCAACTCCTACTTCGGCAAGCTCGAGAGCAAGCTCTCCGTTATC AGGAACCTCAACGACCAGGTCCTCTTCATCGACCAGGGCAACAGGCCC CTCTTCGAGGACATGACGTCCAGCGACTGCAGGAATAACGCCCCAAGG ACCATCTTCATCATCAGCATGTATAAGGACAGCCAGCCCCGAGGGATG GCCGTCACTATCAGCGTCAAGTGCGAAAAGATCAGCACCCTCTCCTGC GAGAACAAGATCATCTCCTTCAAGGAGATGAATCCCCCCGACAACATC AAGGATACCAAGAGCGACATCATCTTCTTCCAAAGGAGCGTGCCCGGC CACGACAACAAGATGCAGTTCGAGTCCTCCAGCTACGAGGGCTACTTT CTGGCCTGCGAGAAGGAGAGGGATCTGTTCAAGCTGATCCTGAAGAAG GAGGACGAGCTGGGTGACAGGAGCATCATGTTCACCGTCCAGAACGAG GAC |
| 694 | IL2sp_IL18_SN | ATGTACAGGATGCAGCTCCTCAGCTGCATCGCCTTATCCCTGGCCCTC GTCACCAACTCGTACTTCGGGAAGCTCGAGAGCAAGCTCAGCGTCATC CGGAACCTCAACGACCAAGTCCTCTTCATCGATCAGGGGAACCGACCC CTCTTCGAGGACATGACCAGCAGCGACTGTAGGAATAACGCCCCGCGC ACGATCTTCATCATCAGCATGTACAAGGATTCACAGCCAAGGGGCATG GCCGTTACCATCAGCGTCAAGTGCGAGAAGATCAGCACCCTTAGCTGC GAGAATAAGATCATCTCCTTTAAGGAGATGAACCCGCCCGACAACATC AAGGACACCAAGTCCGACATCATCTTCTTCCAGAGGAGCGTGCCCGGC CACGATAACAAAATGCAGTTCGAGAGCTCCTCCTACGAGGGCTACTTC CTCGCATGTGAGAAGGAGCGCGATCTCTTCAAGCTGATCCTGAAGAAG GAGGACGAGCTGGGGGACAGGTCCATTATGTTCACCGTGCAGAACGAG GAC |
| 695 | IL2sp_IL18_SN | ATGTACAGGATGCAGCTCCTCTCCTGCATAGCCCTCTCGCTTGCCCTC GTCACCAATAGCTACTTCGGCAAGTTGGAGTCCAAGCTCAGCGTCATC CGAAACCTCAACGACCAGGTCCTTTTCATCGATCAGGGGAACAGGCCC CTCTTCGAGGACATGACCTCGTCCGACTGTAGGAACAACGCCCCCCGG ACCATCTTTATCATCTCCATGTACAAGGACTCCCAACCCAGGGGGATG GCCGTCACCATCAGCGTCAAGTGCGAGAAGATCTCCACCCTCAGCTGC GAGAACAAGATCATCTCCTTCAAGGAGATGAATCCCCCCGATAATATC AAGGACACGAAGTCCGATATCATATTCTTCCAGAGGAGCGTCCCCGGC CACGACAACAAGATGCAGTTCGAAAGCTCCAGCTACGAGGGTTACTTC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTGGCCTGCGAAAAAGAGCGGGACCTCTTCAAGCTGATCCTCAAGAAG<br>GAGGACGAGCTGGGCGACCGCAGCATCATGTTTACGGTGCAGAACGAG<br>GAC |
| 696 | IL2sp_IL18_SN | ATGTACAGGATGCAGCTCCTCAGCTGTATCGCCCTCAGCCTCGCCCTC<br>GTAACTAACTCCTACTTCGGAAAGCTCGAGTCCAAGCTCTCCGTCATC<br>AGGAATCTTAACGATCAGGTTTTATTCATCGATCAGGGGAACAGGCCC<br>CTCTTCGAGGACATGACCAGCTCCGACTGCAGGAACAACGCCCCCAGG<br>ACCATATTCATCATCTCGATGTATAAAGACAGCCAGCCCAGGGGCATG<br>GCCGTCACCATCAGCGTCAAGTGCGAGAAGATCAGCACCCTCTCCTGT<br>GAGAACAAGATCATCTCCTTCAAGGAGATGAACCCGCCCGATAACATC<br>AAGGACACCAAGTCCGACATCATATTTTTCCAGCGGAGCGTGCCCGGG<br>CATGACAACAAGATGCAGTTCGAGAGCAGCTCCTACGAAGGCTACTTC<br>CTCGCCTGCGAAAAGGAGCGGGACCTGTTCAAGCTGATCCTGAAGAAG<br>GAGGACGAGCTGGGGGACCGGAGCATCATGTTCACCGTGCAGAACGAA<br>GAC |
| 697 | IL2sp_IL18_SN | ATGTACAGGATGCAGCTCCTCAGCTGCATCGCGCTCAGCCTCGCCCTT<br>GTCACCAACTCCTATTTCGGCAAGCTCGAGAGCAAGCTCAGCGTTATC<br>CGGAATCTCAACGACCAGGTCTTGTTTATAGACCAGGGCAACAGGCCC<br>CTCTTCGAGGACATGACCAGCAGCGACTGTCGGAACAACGCTCCCAGA<br>ACCATCTTCATCATATCCATGTATAAGGACAGCCAACCGAGGGGCATG<br>GCCGTCACGATCAGCGTCAAGTGCGAGAAGATCAGCACCCTTAGCTGC<br>GAGAATAAGATCATCTCCTTCAAGGAGATGAATCCGCCCGATAATATC<br>AAGGACACCAAGTCGGATATAATCTTCTTTCAGAGGTCCGTGCCCGGG<br>CATGACAACAAGATGCAGTTCGAGAGCAGCTCCTACGAGGGGTACTTT<br>CTGGCGTGCGAGAAGGAGCGTGACCTGTTCAAGCTGATCCTGAAGAAG<br>GAGGACGAGCTGGGGGACAGGAGCATTATGTTTACTGTGCAGAATGAG<br>GAC |
| 698 | IL2sp_IL18_SN | ATGTACCGGATGCAGCTCCTCAGCTGCATCGCGCTCAGCCTCGCCCTC<br>GTCACAAACTCCTATTTCGGCAAGCTCGAGTCGAAGCTAAGCGTCATA<br>AGGAATCTGAACGACCAGGTCCTCTTCATCGACCAGGGGAACAGGCCC<br>CTCTTCGAGGACATGACCAGCAGCGACTGTAGGAACAACGCCCCCAGG<br>ACCATATTTATCATCAGCATGTACAAGGATAGCCAGCCCAGGGGCATG<br>GCCGTCACGATCAGCGTAAAGTGCGAGAAGATCAGCACCCTCAGCTGC<br>GAGAACAAAATCATCAGCTTCAAAGAAATGAACCCACCCGACAACATC<br>AAGGATACCAAGTCCGATATCATCTTCTTTCAGAGGTCCGTGCCCGGC<br>CACGACAACAAGATGCAGTTCGAGTCGAGCAGCTACGAGGGCTATTTC<br>CTCGCCTGCGAAAAGGAGAGGGACCTCTTTAAGCTGATCCTCAAGAAG<br>GAGGACGAGCTGGGGGACAGGAGCATCATGTTCACCGTGCAGAACGAG<br>GAT |
| 699 | IL2sp_IL18_SN | ATGTACAGGATGCAGCTCCTCAGCTGCATAGCCCTCAGCCTAGCCTTA<br>GTCACCAACTCCTACTTCGGCAAGCTCGAGTCCAAGCTCTCCGTCATC<br>CGTAACCTTAACGATCAGGTCCTCTTTATCGACCAGGGGAACAGGCCC<br>CTCTTCGAGGACATGACGAGCAGCGACTGCAGGAACAACGCCCCGAGG<br>ACCATCTTCATCATCAGCATGTACAAAGACAGCCAGCCAAGGGGCATG<br>GCCGTCACCATCTCGGTCAAGTGCGAGAAGATCAGCACCCTCAGCTGC<br>GAGAACAAGATCATCAGCTTCAAGGAGATGAATCCGCCCGACAACATC<br>AAGGACACGAAGTCCGACATAATCTTCTTCCAGAGGAGCGTGCCCGGC<br>CACGACAACAAAATGCAGTTTGAGTCCTCCAGCTACGAAGGTTACTTT<br>CTCGCCTGCGAGAAAGAGAGGGACCTGTTCAAGCTGATCCTGAAGAAG<br>GAGGACGAGCTGGGGGACAGGTCCATCATGTTCACCGTCCAGAACGAG<br>GAT |
| 700 | IL2sp_IL18_SN | ATGTACAGGATGCAATTGCTCAGCTGTATCGCCCTCTCCCTCGCACTC<br>GTGACCAACTCCTACTTCGGGAAGCTCGAGAGCAAGCTCTCGGTGATC<br>CGGAATCTTAACGACCAGGTCCTCTTCATCGACCAGGGCAACCGGCCC<br>CTCTTCGAGGATATGACCTCCTCCGACTGCAGGAATAACGCCCCGCGC<br>ACCATCTTCATCATCAGCATGTACAAGGACTCCCAGCCCAGGGGCATG<br>GCCGTCACGATCAGCGTCAAGTGCGAGAAGATCAGCACCCTCTCCTGT<br>GAGAATAAGATCATCAGCTTCAAGGAGATGAACCCGCCCGACAACATC<br>AAGGACACCAAGTCTGATATCATCTTCTTTCAAAGGAGCGTCCCCGGC<br>CATGATAACAAGATGCAATTCGAGAGCAGCAGCTACGAGGGCTACTTC<br>CTGGCCTGTGAGAAGGAGAGGGACCTGTTCAAGCTGATCCTGAAGAAG<br>GAGGACGAGCTGGGGGACAGGTCCATCATGTTCACGGTCCAGAACGAG<br>GAC |
| 701 | IL2sp_IL18_SN | ATGTACAGGATGCAGTTATTAAGCTGCATCGCCCTCTCGCTCGCCTTG<br>GTCACCAACAGCTACTTCGGCAAGCTCGAGAGCAAGCTCTCCGTCATC<br>AGGAACCTCAACGACCAGGTCCTCTTCATCGACCAGGGCAACAGGCCC<br>CTTTTCGAGGACATGACCAGCAGCGACTGCCGAAACAACGCCCCCCGT<br>ACCATCTTCATCATCTCGATGTACAAGGACAGCCAGCCGAGGGGTATG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GCCGTCACCATCAGCGTCAAGTGCGAGAAAATCTCCACCCTCAGCTGC<br>GAAAACAAAATCATCTCCTTCAAGGAGATGAACCCCCCGGACAACATC<br>AAAGACACCAAAAGCGACATCATCTTCTTCCAGAGGTCCGTGCCCGGT<br>CACGACAATAAGATGCAGTTCGAGAGCTCGTCCTACGAGGGCTACTTC<br>CTCGCCTGCGAGAAGGAGAGGGACCTGTTCAAGCTGATCCTGAAGAAG<br>GAGGACGAGCTCGGCGACAGGAGCATCATGTTCACGGTGCAGAATGAG<br>GAC |
| 702 | IL2sp_IL18_SN | ATGTACAGGATGCAGCTCCTCAGCTGCATCGCCCTCTCCCTCGCCCTC<br>GTTACCAACTCCTACTTCGGCAAGCTCGAGAGCAAACTCTCGGTTATC<br>AGGAACCTAAACGATCAGGTCCTGTTCATCGACCAAGGCAACAGGCCC<br>CTCTTCGAGGACATGACCAGCTCCGACTGCAGGAACAACGCCCCCAGG<br>ACCATCTTCATCATCAGCATGTACAAGGACAGCCAGCCCCGGGGCATG<br>GCGGTCACGATCAGCGTAAAGTGCGAGAAAATCTCCACCCTTAGCTGT<br>GAGAACAAGATAATCAGCTTTAAGGAGATGAACCCGCCGGACAACATA<br>AAGGACACCAAGTCCGATATCATCTTCTTTCAGAGGTCCGTGCCTGGA<br>CACGACAACAAGATGCAGTTTGAGAGCAGCTCCTATGAGGGGTACTTT<br>CTGGCCTGCGAAAAGGAGAGGGACCTGTTCAAGCTGATCCTGAAGAAG<br>GAGGACGAGCTGGGGGATAGGAGCATCATGTTCACCGTGCAAAACGAG<br>GAC |
| 703 | IL2sp_IL18_SN | ATGTACAGGATGCAGCTTCTTAGCTGCATCGCGCTCAGCCTTGCTCTC<br>GTTACCAATAGCTACTTCGGCAAGCTTGAGTCCAAGTTGAGCGTAATC<br>AGGAACTTGAACGACCAGGTCCTCTTTATCGACCAGGGCAACAGGCCC<br>CTCTTCGAGGACATGACCAGTAGCGATTGTCGGAACAACGCCCCCAGG<br>ACCATATTCATCATCAGCATGTATAAGGACAGCCAGCCCAGGGGCATG<br>GCCGTCACGATCAGCGTCAAGTGTGAGAAGATCAGCACCCTCTCGTGC<br>GAGAACAAGATCATCTCCTTTAAGGAGATGAACCCGCCCGACAATATC<br>AAGGACACAAAGAGCGACATCATCTTCTTCCAGAGGAGCGTTCCTGGA<br>CACGACAACAAAATGCAGTTTGAGTCCAGCAGCTACGAAGGGTACTTT<br>CTGGCCTGCGAGAAGGAGCGGGACCTCTTTAAGCTCATCCTGAAGAAA<br>GAGGATGAGCTGGGCGACCGGAGCATCATGTTCACGGTGCAGAACGAA<br>GAC |
| 704 | IL2sp_IL18_SN | ATGTACAGGATGCAGCTCCTCAGCTGCATCGCCCTCAGCCTCGCACTC<br>GTCACCAACTCCTACTTCGGAAAGCTCGAGTCAAAACTCTCCGTCATC<br>CGGAACCTCAACGACCAGGTACTCTTTATCGACCAGGGGAACAGGCCC<br>CTCTTCGAGGACATGACGTCCAGCGACTGCCGAAACAACGCACCCAGG<br>ACCATCTTCATCATCTCCATGTACAAGGACTCCCAGCCCAGGGGGATG<br>GCCGTTACCATCAGCGTCAAGTGCGAGAAGATCTCCACACTCAGCTGC<br>GAGAATAAGATCATATCCTTTAAGGAAATGAACCCGCCCGACAACATC<br>AAGGACACCAAGTCAGACATCATCTTCTTCCAGCGAAGCGTGCCGGGC<br>CATGACAACAAGATGCAGTTTGAGTCAAGCTCGTACGAGGGCTACTTC<br>CTGGCGTGTGAGAAGGAGAGGGACCTGTTCAAGCTCATCCTGAAGAAG<br>GAGGACGAGCTGGGGGATAGGAGCATCATGTTCACGGTGCAGAACGAG<br>GAC |
| 705 | IL2sp_IL18_SN | ATGTACAGGATGCAGCTCCTCAGCTGCATCGCCCTCAGCCTTGCCTTG<br>GTCACCAACAGCTACTTCGGCAAGCTCGAGAGCAAGCTCAGCGTCATC<br>AGGAACCTCAACGACCAGGTCTTATTTATCGATCAGGGGAACCGCCCC<br>CTCTTCGAAGACATGACCTCCTCCGATTGTCGGAACAACGCCCCCAGG<br>ACCATCTTCATCATCAGCATGTACAAGGACAGCCAGCCCCGGGGGATG<br>GCCGTCACCATCAGCGTCAAGTGCGAGAAGATCTCCACCCTCTCGTGC<br>GAGAACAAGATCATCTCCTTCAAGGAGATGAACCCGCCCGACAACATC<br>AAGGACACCAAGTCCGACATCATCTTCTTCCAAAGGTCCGTGCCCGGC<br>CATGACAATAAGATGCAGTTCGAATCCAGCTCCTACGAGGGCTATTTC<br>CTGGCCTGCGAGAAGGAGCGGGACCTGTTCAAGCTGATCCTGAAGAAG<br>GAGGACGAACTGGGCGACAGGAGCATCATGTTCACCGTGCAGAACGAA<br>GAC |
| 706 | IL2sp_IL18_SN | ATGTACAGGATGCAGCTGCTTAGCTGCATCGCCCTCTCCCTCGCCCTC<br>GTTACCAACAGCTACTTCGGCAAGCTCGAGAGCAAACTCAGCGTCATC<br>AGGAACCTTAACGACCAGGTCCTCTTCATCGACCAGGGCAATAGGCCG<br>TTATTCGAGGATATGACGAGCTCCGATTGCAGGAACAACGCCCCCCGC<br>ACTATCTTCATCATCTCCATGTACAAGGACAGCCAGCCCCGGGGGATG<br>GCCGTAACCATCAGCGTCAAGTGCGAGAAGATCAGCACCTTGAGCTGC<br>GAGAACAAGATCATCAGCTTCAAAGAGATGAACCCGCCCGACAACATC<br>AAGGACACCAAGTCCGACATTATATTCTTCCAGAGGAGCGTGCCGGGC<br>CACGACAATAAAATGCAATTCGAGAGCAGTTCCTACGAGGGGTACTTT<br>CTGGCCTGCGAGAAGGAGAGGGATCTCTTCAAGCTCATCCTCAAGAAG<br>GAGGACGAGCTGGGCGACAGGAGCATCATGTTCACCGTGCAAAACGAG<br>GAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 707 | IL2sp_IL18_SN | ATGTACAGAATGCAGCTCCTCAGCTGCATCGCACTCAGCCTCGCCCTCGTAACCAATAGCTACTTCGGGAAGCTCGAGAGCAAGCTCTCCGTTATCAGGAACCTCAACGACCAGGTCCTCTTCATCGACCAGGGCAACCGGCCCTTATTCGAGGACATGACGAGCTCCGACTGTAGGAACAACGCGCCCAGGACCATCTTCATCATCTCCATGTACAAGGATTCGCAGCCGCGCGGGATGGCCGTCACCATCAGCGTCAAGTGCGAGAAGATCTCCACCCTCAGCTGCGAGAACAAGATCATCAGCTTTAAGGAGATGAACCCGCCCGACAACATCAAGGATACCAAGAGCGACATCATCTTCTTCCAGCGGTCCGTGCCCGGCCACGACAACAAGATGCAGTTCGAGAGCAGCAGCTACGAGGGATACTTCCTGGCCTGCGAGAAGGAGCGGGACCTGTTCAAGCTGATCCTGAAGAAAGAGGACGAACTGGGCGACCGCAGCATCATGTTCACGGTGCAGAACGAGGAC |
| 708 | IgLC_IL18 | ATGGCCTGGACAGTCCTCCTCCTGGGGCTCCTCTCCCACTGCACCGGAAGCGTCACGTCGTATTTCGGCAAGCTCGAGAGCAAGCTCTCCGTCATCAGGAACCTCAACGATCAGGTCCTCTTCATCGACCAGGGGAACAGGCCCCTTTTCGAGGACATGACCGACAGCGACTGCCGGGATAACGCCCCGCGGACGATCTTCATCATTTCCATGTACAAGGACAGCCAACCGCGGGGCATGGCCGTCACGATCTCCGTCAAGTGCGAGAAGATCTCCACCCTCTCGTGCGAGAACAAGATCATATCGTTCAAAGAGATGAATCCCCCCGACAACATAAAGGACACGAAAAGCGACATTATCTTCTTCCAAAGGAGCGTGCCCGGCCACGATAACAAGATGCAGTTCGAGAGCTCCAGCTACGAGGGCTACTTCCTGGCCTGCGAGAAGGAGAGGGACCTGTTCAAGCTCATCCTGAAGAAGGAGGATGAGCTAGGCGATCGGTCCATCATGTTCACCGTGCAGAACGAGGAC |
| 709 | IgLC_IL18 | ATGGCCTGGACGGTCCTCCTTCTAGGCCTCCTCTCCCACTGTACGGGGTCGGTAACGAGCTACTTCGGCAAGCTAGAGAGCAAGCTCAGCGTCATCCGCAACCTCAACGACCAAGTCCTCTTCATCGACCAGGGGAACCGCCCCCTCTTCGAGGACATGACCGACTCGGATTGCAGGGACAACGCGCCCCGCACCATCTTCATAATCAGCATGTACAAGGACTCCCAACCCAGGGGCATGGCCGTTACCATCAGCGTCAAGTGCGAGAAGATCAGCACCCTCAGCTGTGAGAATAAGATCATCAGCTTCAAGGAGATGAACCCCCCGGATAACATCAAGGACACCAAGTCCGATATCATCTTCTTCCAGAGGAGCGTCCCCGGGCACGATAATAAGATGCAGTTCGAGAGCTCCAGCTACGAGGGCTACTTCCTGGCCTGCGAGAAAGAGCGGGACCTGTTCAAGCTGATTCTGAAGAAGGAGGACGAGCTGGGGGATAGGTCCATCATGTTCACCGTGCAGAACGAGGAC |
| 710 | IgLC_IL18 | ATGGCCTGGACCGTCCTCCTCCTCGGCTTACTCAGCCACTGCACGGGGAGCGTCACGAGTTACTTCGGCAAACTCGAGAGCAAGCTTTCCGTTATCCGGAATCTCAACGACCAGGTCCTTTTCATCGACCAGGGTAACAGGCCCCTCTTCGAGGACATGACCGACAGCGACTGTCGGGACAACGCCCCCAGGACGATCTTCATCATCTCCATGTACAAGGATAGCCAGCCCAGAGGAATGGCCGTTACGATCAGCGTCAAGTGCGAGAAGATCAGCACGCTCTCCTGCGAGAACAAAATCATCTCCTTCAAGGAGATGAACCCGCCCGACAACATCAAGGACACCAAGTCAGACATCATCTTCTTCCAGCGGAGCGTGCCTGGCCACGACAATAAGATGCAGTTCGAGTCCTCGAGCTACGAGGGGTACTTCCTGGCCTGCGAGAAGGAGAGGGACCTGTTCAAGCTGATCCTCAAAAAGGAGGATGAGCTGGGCGACAGGTCCATCATGTTCACCGTCCAGAACGAGGAT |
| 711 | IgLC_IL18 | ATGGCGTGGACCGTCCTCCTCTTAGGCCTCCTTAGCCACTGCACGGGCAGCGTCACCAGCTACTTCGGAAAGCTCGAGTCCAAGCTCTCCGTCATCCGGAACCTCAACGATCAAGTCCTCTTCATAGACCAGGGCAACCGCCCCCTCTTCGAGGACATGACCGACTCCGACTGCAGGGACAACGCCCCCAGGACGATCTTCATCATCAGCATGTACAAGGACAGCCAGCCGCGCGGCATGGCGGTAACCATCAGCGTTAAGTGCGAGAAGATCAGCACCCTCTCCTGCGAGAACAAGATCATCTCCTTTAAGGAGATGAACCCGCCCGACAACATCAAAGACACAAAATCGGACATCATCTTCTTCCAGAGGTCCGTACCCGGCCACGACAATAAGATGCAGTTCGAGAGCAGCAGCTACGAGGGCTATTTCCTCGCGTGCGAGAAGGAGCGGGACCTCTTCAAGCTCATCCTCAAAAAAGAGGACGAGCTCGGCGACCGCTCCATCATGTTTACCGTCCAAAATGAGGAC |
| 712 | IgLC_IL18 | ATGGCCTGGACCGTCCTCCTCCTCGGCCTCCTCAGCCATTGTACGGGCTCCGTCACATCGTACTTCGGCAAGCTCGAGTCGAAACTCAGCGTCATACGGAATCTCAACGACCAGGTCCTCTTCATCGACCAGGGCAACAGGCCCTTGTTCGAGGATATGACCGACTCGGACTGCAGGGACAACGCCCCCAGAACGATCTTCATCATATCCATGTACAAGGACAGCCAGCCCAGGGGCATGGCCGTCACGATCAGCGTCAAGTGCGAGAAGATCAGTACCCTAAGCTGCGAGAACAAGATCATCAGCTTCAAGGAGATGAACCCTCCCGACAACATCAAAGATACCAAGAGCGACATCATCTTTTTTCAGAGGAGCGTGCCCGGCCACGACAACAAGATGCAGTTCGAGAGCAGCTCCTACGAGGGCTACTTT |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTCGCCTGTGAAAAGGAGAGGGACCTGTTCAAGTTGATCCTGAAAAAGGAGGACGAGCTGGGCGACCGGTCCATAATGTTTACCGTGCAGAACGAGGAC |
| 713 | IgLC_IL18 | ATGGCCTGGACCGTCCTACTCCTCGGCTTGCTCAGCCACTGCACCGGGTCCGTCACCAGCTACTTCGGCAAGCTCGAGAGCAAGCTCTCAGTCATCCGGAACCTCAACGACCAGGTACTCTTCATCGACCAGGGCAATAGGCCGCTTTTCGAGGATATGACCGATAGCGACTGCAGAGACAACGCCCCGCGGACCATCTTCATCATCTCCATGTACAAGGACAGCCAGCCCAGGGGCATGGCCGTCACTATCTCGGTCAAGTGCGAAAAGATCTCCACCCTCTCCTGTGAGAACAAGATCATCTCCTTCAAGGAGATGAACCCGCCCGACAACATCAAGGACACCAAGTCCGACATCATATTCTTCCAGCGGAGCGTTCCGGGCCATGACAACAAAATGCAGTTTGAATCCAGCAGCTACGAGGGCTACTTCCTGGCGTGCGAGAAGGAGAGGGACCTGTTCAAGCTCATCCTCAAAAAGGAGGATGAGCTGGGCGACCGGAGCATCATGTTCACCGTGCAGAACGAAGAC |
| 714 | IgLC_IL18 | ATGGCCTGGACCGTCCTCCTACTGGGATTGCTCAGCCACTGCACCGGCAGCGTAACTTCGTACTTCGGTAAGCTCGAGAGCAAGCTCAGCGTCATCAGGAATCTCAACGACCAGGTCCTTTTCATCGATCAGGGGAACAGGCCCCTCTTCGAGGACATGACCGATTCCGACTGTCGCGACAACGCCCCCAGGACCATCTTCATCATCTCCATGTACAAGGACAGCCAGCCCCGGGGCATGGCCGTCACCATCAGCGTTAAGTGCGAGAAGATCAGCACGTTGAGCTGTGAGAACAAAATCATAAGCTTCAAGGAAATGAACCCGCCCGACAACATCAAGGACACCAAGAGCGACATCATCTTCTTCCAACGGTCGGTGCCCGGCCACGATAACAAGATGCAGTTCGAGTCCTCCTCCTACGAGGGGTACTTCCTCGCGTGCGAGAAGGAGAGGGATCTGTTCAAGCTCATCCTGAAGAAGGAAGATGAGCTGGGCGATCGGTCCATCATGTTCACCGTGCAGAATGAGGAC |
| 715 | IgLC_IL18 | ATGGCCTGGACGGTCCTCCTCCTCGGTCTGCTATCGCACTGTACGGGCAGCGTCACCTCGTATTTCGGCAAACTCGAATCCAAGCTCTCGGTCATTAGGAACCTCAACGATCAGGTCCTCTTCATCGACCAGGGCAACAGGCCCCTCTTCGAGGATATGACCGATAGCGACTGCCGGGATAACGCCCCCAGGACCATCTTCATCATCAGCATGTACAAGGACTCGCAGCCCCGCGGCATGGCCGTGACCATCAGCGTCAAGTGCGAGAAAATCTCCACGCTAAGCTGCGAGAACAAGATCATCAGCTTCAAGGAGATGAACCCCCCAGACAACATCAAGGACACGAAAAGCGACATCATCTTCTTCCAGAGGAGCGTCCCCGGCCACGACAACAAGATGCAGTTCGAGTCGTCGAGCTATGAGGGGTACTTCCTGGCCTGCGAGAAGGAGAGGGACCTGTTCAAGCTGATCCTGAAAAAGGAGGATGAACTGGGCGACAGGAGCATCATGTTCACCGTGCAGAACGAAGAC |
| 716 | IgLC_IL18 | ATGGCCTGGACCGTATTGCTCCTCGGCCTCCTCAGCCACTGTACGGGCTCGGTCACCTCCTATTTCGGCAAGCTAGAATCCAAGCTCTCCGTAATCAGGAACTTGAACGATCAGGTCCTCTTTATCGATCAGGGAAATAGGCCCCTTTTCGAGGACATGACCGACTCGGACTGCCGGGACAACGCCCCCCGCACCATATTCATCATCAGCATGTATAAGGACTCCCAGCCCAGGGGCATGGCCGTAACCATCAGCGTCAAGTGTGAGAAGATCTCCACCCTCAGCTGCGAGAACAAGATCATCTCCTTCAAGGAGATGAACCCGCCCGACAACATCAAGGACACCAAGAGCGACATCATCTTCTTCCAACGTAGCGTGCCCGGTCACGACAACAAGATGCAGTTCGAGTCCTCATCGTACGAGGGCTACTTTCTCGCCTGCGAGAAGGAGCGGGATCTGTTCAAGCTCATCCTGAAGAAGGAGGACGAGCTGGGCGATAGGTCCATAATGTTCACCGTCCAGAACGAGGAC |
| 717 | IgLC_IL18 | ATGGCGTGGACCGTCCTCCTCCTAGGCCTCTTGAGCCACTGCACCGGCAGCGTCACCAGCTACTTCGGCAAACTCGAGTCCAAGCTCAGCGTGATCAGGAACCTCAACGATCAGGTCCTCTTTATCGACCAGGGGAATCGTCCCCTCTTCGAAGACATGACCGACTCCGACTGCCGGGATAACGCCCCGCGAACGATCTTTATCATCTCCATGTATAAGGACAGCCAGCCCAGAGGCATGGCCGTCACCATCAGCGTTAAGTGCGAGAAGATCTCCACCCTCAGCTGCGAGAACAAGATCATCAGCTTCAAGGAGATGAACCCACCCGACAACATCAAGGACACCAAGAGCGACATCATATTTTTCCAGCGGAGCGTGCCCGGCCATGACAACAAAATGCAGTTCGAGTCGTCAAGCTACGAGGGTTATTTCCTCGCCTGCGAGAAGGAGCGCGACCTCTTTAAGCTGATTCTCAAGAAGGAGGACGAGCTGGGCGACCGAAGCATCATGTTCACCGTCCAGAACGAGGAC |
| 718 | IgLC_IL18 | ATGGCCTGGACCGTCCTCCTCCTTGGACTCCTCTCCCATTGCACCGGGTCGGTCACGTCCTACTTCGGCAAGCTCGAGTCCAAACTCAGCGTCATAAGGAATCTCAACGACCAGGTCCTCTTCATCGACCAGGGAAACCGGCCCCTTTTCGAGGACATGACCGACTCGGACTGCAGGGACAACGCCCCGCGGACCATCTTCATCATCAGCATGTACAAGGACAGCCAGCCCAGGGGCATG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GCCGTCACCATAAGCGTCAAGTGCGAGAAGATCAGCACCCTCAGCTGT GAAAACAAGATCATCAGCTTCAAGGAGATGAACCCGCCCGACAACATC AAGGACACCAAGAGCGACATCATCTTCTTCCAGCGGTCCGTGCCGGGC CATGACAACAAGATGCAGTTCGAGTCCTCCAGCTACGAGGGGTACTTC CTGGCCTGCGAGAAGGAGCGAGATCTGTTCAAGCTAATCCTGAAGAAG GAGGACGAGCTGGGCGACCGCTCGATCATGTTCACCGTGCAGAATGAG GAT |
| 719 | IgLC_IL18 | ATGGCCTGGACCGTCCTCCTCCTCGGGCTCCTTAGCCACTGTACCGGG TCCGTGACCTCCTACTTCGGGAAACTCGAAAGCAAACTCAGCGTCATC CGGAACTTGAACGACCAGGTCCTCTTCATCGACCAGGGCAACCGGCCC CTCTTCGAGGATATGACCGATAGCGATTGCAGGGACAACGCCCCCAGG ACCATCTTCATCATATCCATGTACAAGGACAGCCAGCCGAGGGGCATG GCCGTAACCATCAGCGTCAAGTGTGAGAAGATCAGCACGCTAAGCTGC GAGAATAAAATCATCTCCTTTAAGGAGATGAACCCGCCCGACAACATC AAGGACACGAAGTCCGACATAATCTTCTTTCAGCGGAGCGTGCCAGGC CACGATAACAAGATGCAGTTCGAGTCCTCGAGCTACGAAGGCTACTTT CTGGCCTGTGAAAAAGAGAGGGACCTGTTCAAGCTGATCCTGAAGAAG GAGGACGAACTCGGCGACCGGAGCATCATGTTCACCGTGCAAAACGAA GAC |
| 720 | IgLC_IL18 | ATGGCGTGGACCGTCCTACTCCTCGGGCTCCTCTCCCACTGCACCGGA AGCGTCACCAGCTATTTCGGCAAGCTCGAAAGCAAGCTATCCGTCATC CGGAACCTCAACGACCAGGTCCTCTTCATCGATCAGGGGAACAGGCCC CTCTTCGAGGATATGACGGACAGCGATTGCAGGGACAACGCCCCGAGG ACCATCTTCATAATCAGCATGTACAAGGACAGCCAGCCCAGGGGGATG GCCGTCACCATCAGCGTAAAGTGCGAGAAGATCAGCACGCTCAGCTGC GAGAACAAGATCATCTCCTTCAAAGAGATGAACCCACCCGACAACATC AAGGACACAAAGAGCGACATAATATTTTTCCAGCGCTCCGTCCCGGGC CACGACAACAAAATGCAATTCGAGAGCTCAAGCTATGAGGGCTACTTC CTGGCCTGCGAGAAGGAAAGGGACCTGTTCAAGCTGATCCTCAAGAAG GAGGACGAGCTGGGCGATCGGTCGATCATGTTCACCGTCCAGAACGAG GAT |
| 721 | IgLC_IL18 | ATGGCGTGGACCGTACTCCTCCTCGGCCTTCTCAGCCATTGCACCGGC AGCGTCACCTCCTACTTCGGGAAGCTCGAAAGCAAGCTAAGCGTCATC CGCAACCTAAACGACCAGGTCTTGTTCATCGACCAGGGCAACAGGCCC CTCTTCGAGGACATGACCGACAGCGATTGCAGGGACAACGCCCCGAGG ACCATCTTCATCATCTCCATGTATAAGGACAGCCAGCCCAGGGGGATG GCCGTCACCATCAGCGTCAAGTGCGAAAAGATCAGCACGCTCTCCTGC GAGAACAAGATCATCTCCTTCAAGGAAATGAACCCGCCCGACAATATC AAAGACACGAAGTCCGATATCATCTTCTTTCAGAGGAGCGTGCCCGGC CATGACAACAAGATGCAGTTTGAGTCCTCCAGCTACGAGGGCTACTTC CTGGCCTGTGAAAAGGAGCGGGATCTCTTCAAGCTGATCCTGAAGAAG GAGGACGAGCTGGGGGACAGAAGCATCATGTTCACCGTGCAGAACGAG GAC |
| 722 | IgLC_IL18 | ATGGCCTGGACCGTCCTCCTTCTCGGCCTCCTCAGCCACTGCACCGGC AGCGTCACCAGCTACTTCGGTAAGCTGGAGAGTAAGTTGAGCGTAATC CGGAATCTCAACGACCAAGTCCTCTTCATCGACCAGGGGAACCGACCC CTCTTCGAGGACATGACCGATTCGGACTGCCGGGACAACGCCCCCCGG ACCATCTTCATCATCAGCATGTACAAGGACTCCCAACCCAGGGGAATG GCCGTAACCATCTCCGTTAAGTGCGAGAAGATCTCAACCCTTAGCTGC GAGAACAAAATCATCTCCTTTAAAGAGATGAACCCTCCCGACAACATC AAGGACACCAAGTCGGACATCATCTTCTTCCAGAGGTCCGTGCCCGGG CATGACAACAAGATGCAATTTGAGAGCAGCAGCTACGAGGGCTACTTT CTCGCCTGCGAGAAGGAGCGGGACCTGTTCAAGCTGATCCTGAAGAAA GAGGATGAGCTGGGCGACAGGTCCATAATGTTCACGGTGCAGAACGAA GAT |
| 723 | IgLC_IL18 | ATGGCCTGGACCGTCCTTCTCTTGGGCCTCCTCTCCCACTGCACCGGC TCCGTCACCTCCTACTTCGGCAAGCTCGAGAGCAAACTCAGCGTCATA AGGAACCTCAACGACCAGGTTCTCTTCATCGACCAGGGCAACCGCCCC TTATTCGAGGATATGACCGACAGCGATTGCCGGGACAACGCGCCCAGG ACCATCTTCATCATCTCCATGTACAAGGACAGCCAGCCTAGGGGCATG GCCGTCACCATCAGCGTCAAGTGTGAGAAGATCTCGACCTTGAGCTGC GAAAATAAGATTATCAGCTTCAAGGAGATGAACCCACCGGATAATATC AAGGACACCAAGAGCGACATAATCTTCTTCCAGCGGAGCGTGCCGGGG CACGACAACAAGATGCAGTTCGAGTCGAGCTCCTACGAGGGTTACTTC CTGGCCTGTGAGAAGGAGAGGGACCTGTTCAAGCTGATCCTGAAGAAG GAGGACGAGCTGGGGGACAGGAGCATCATGTTCACCGTCCAGAACGAG GAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 724 | IgLC_IL18 | ATGGCCTGGACAGTCCTCCTCCTCGGGCTCCTCAGCCACTGCACCGGC AGCGTCACCTCCTACTTCGGCAAGCTCGAGAGCAAGCTCAGCGTCATC AGGAACCTCAACGATCAGGTCCTCTTCATCGACCAGGGGAACAGGCCC CTCTTCGAGGATATGACCGACAGCGACTGCCGGGATAACGCGCCCCGG ACCATCTTCATCATCAGCATGTACAAGGACAGCCAACCCAGGGGCATG GCCGTCACCATCAGCGTCAAGTGCGAAAAGATCAGCACCCTCAGCTGC GAGAACAAAATCATAAGCTTTAAGGAGATGAACCCTCCCGACAACATC AAGGACACGAAGTCCGACATCATCTTCTTTCAGCGGAGCGTGCCCGGG CATGACAACAAAATGCAGTTCGAGAGCTCCAGCTATGAGGGGTACTTT CTGGCGTGCGAGAAGGAGAGGGATCTCTTCAAGCTGATCCTGAAAAAG GAGGACGAGCTGGGCGACCGGAGCATCATGTTCACCGTCCAGAATGAA GAC |
| 725 | IgLC_IL18 | ATGGCCTGGACCGTACTCCTCCTCGGGCTCCTCTCACACTGTACCGGC AGCGTCACCAGCTACTTCGGGAAGCTCGAGTCCAAGCTCAGCGTCATC CGGAACCTCAACGATCAGGTACTCTTCATCGACCAGGGCAACCGCCCG CTGTTCGAGGATATGACGGACAGCGACTGCCGGGACAACGCCCCTCGG ACCATCTTCATCATCAGCATGTACAAGGATAGCCAGCCCCGCGGTATG GCCGTAACTATCAGCGTAAAGTGCGAGAAGATCTCCACCCTCAGCTGC GAGAACAAGATCATAAGTTTCAAGGAGATGAACCCACCCGATAACATC AAGGACACCAAGAGTGATATCATCTTCTTCCAGAGGTCGGTGCCCGGC CACGACAACAAGATGCAGTTTGAAAGCAGCTCCTACGAGGGGTACTTC CTGGCCTGCGAGAAGGAGAGGGACCTGTTCAAGCTGATCCTGAAAAAG GAGGACGAGCTGGGCGACCGGAGCATCATGTTCACCGTGCAGAACGAG GAT |
| 726 | IgLC_IL18 | ATGGCCTGGACCGTCCTCCTCCTCGGACTCCTCAGCCATTGCACCGGC AGCGTCACCAGCTACTTCGGTAAGCTAGAGAGCAAGCTTAGCGTCATT CGCAACCTCAACGACCAGGTACTCTTCATCGACCAGGGCAATCGGCCC CTCTTCGAGGACATGACCGACAGCGACTGCCGGGACAACGCCCCCAGG ACCATCTTCATCATCAGCATGTACAAAGACTCCCAGCCGAGGGGGATG GCCGTTACCATCTCCGTAAAGTGCGAGAAGATTAGCACCCTCAGCTGC GAAAACAAGATCATCTCCTTCAAGGAGATGAACCCGCCCGATAACATC AAGGACACCAAGAGCGACATCATCTTCTTCCAGAGGAGCGTCCCCGGC CACGACAATAAGATGCAGTTCGAGAGCAGCAGCTACGAGGGCTACTTC CTGGCCTGCGAGAAGGAGAGGGACCTGTTCAAGCTCATCCTGAAAAAA GAGGACGAGCTGGGCGACCGAAGCATCATGTTCACCGTTCAGAACGAG GAC |
| 727 | IgLC_IL18 | ATGGCGTGGACCGTTCTCCTACTCGGATTGCTTAGCCACTGCACCGGC AGCGTCACAAGCTACTTCGGTAAGCTCGAGAGCAAGCTCAGCGTGATC CGGAACCTCAACGACCAGGTCCTCTTCATCGACCAGGGGAATCGGCCC CTCTTCGAAGACATGACCGACTCCGACTGTAGGGACAACGCCCCCAGG ACCATCTTCATCATCAGCATGTACAAGGACAGCCAGCCCCGCGGAATG GCCGTCACGATCTCCGTAAAGTGCGAGAAGATCTCCACCCTTTCCTGC GAGAACAAGATCATCAGCTTCAAGGAGATGAACCCGCCCGACAATATC AAGGACACCAAGAGCGACATCATCTTCTTTCAGAGGAGCGTGCCCGGC CATGACAATAAGATGCAGTTCGAGAGCAGCTCGTACGAGGGCTATTTC CTGGCCTGCGAGAAGGAGAGGGACCTGTTTAAGCTGATCCTGAAGAAG GAGGACGAGCTGGGGGACAGGAGCATCATGTTCACCGTGCAGAACGAG GAC |
| 728 | IgLC_IL18 | ATGGCCTGGACCGTCCTCCTCCTCGGCCTCCTCTCCCACTGTACCGGC TCCGTTACGAGCTACTTCGGCAAGCTAGAGAGCAAGCTCAGCGTTATC AGGAACCTCAACGACCAGGTCCTTTTCATCGACCAGGGCAATCGGCCC CTTTTCGAAGACATGACCGACAGCGACTGTCGGGACAACGCTCCGAGG ACCATCTTCATCATCAGCATGTACAAGGACAGCCAGCCCAGAGGGATG GCCGTCACCATCAGCGTCAAGTGCGAGAAGATAAGCACCCTCTCGTGC GAGAACAAAATCATCTCCTTCAAAGAGATGAACCCCCCGGACAACATC AAGGACACCAAGAGCGATATCATTTTCTTCCAACGTAGCGTCCCCGGG CACGACAACAAGATGCAGTTCGAGAGCAGCAGCTACGAGGGCTACTTC CTCGCCTGCGAAAAGGAAAGGGACCTCTTCAAGCTGATCCTGAAGAAG GAGGATGAGCTCGGGGACAGGTCCATCATGTTCACGGTGCAGAACGAA GAC |
| 729 | IgLC_IL18 | ATGGCCTGGACGGTCCTCCTCTTGGGGCTACTCAGCCATTGCACCGGC TCCGTCACCAGCTACTTCGGCAAGCTCGAGTCCAAGCTCTCCGTAATC AGGAATCTCAACGACCAGGTCCTCTTCATCGACCAGGGGAACCGGCCC CTCTTCGAAGACATGACCGACAGCGACTGTCGGGACAACGCCCCCAGG ACGATCTTCATAATCTCCATGTACAAGGATAGCCAGCCCAGGGGGATG GCCGTCACCATCAGCGTCAAGTGTGAGAAGATCTCCACGCTCAGCTGC GAGAATAAGATCATTTCCTTCAAGGAGATGAACCCGCCCGACAACATC AAGGACACGAAAAGCGACATCATCTTCTTTCAGCGCTCCGTCCCGGGC CACGACAACAAGATGCAGTTCGAGTCCAGCTCCTACGAGGGCTACTTT |

TABLE 8-continued

| Sequence of fusions constructs encoding IL18 (SEQ ID NOS: 579-582) and their corresponding optimized ORFs (SEQ ID NO: 583-807) | | |
|---|---|---|
| SEQ ID NO | Name | Sequence |
| | | CTGGCCTGCGAAAAGGAACGGGATCTCTTCAAGCTGATTCTCAAGAAG GAGGACGAGCTGGGTGACAGGAGCATCATGTTTACGGTGCAGAATGAG GAT |
| 730 | IgLC_IL18 | ATGGCGTGGACGGTCCTCCTCCTAGGCCTTCTCTCCCACTGCACCGGT AGCGTCACCAGCTACTTCGGCAAGCTCGAGTCGAAGCTCAGCGTCATA CGGAACCTCAACGACCAGGTTCTCTTCATCGACCAGGGAAACCGTCCC CTCTTCGAAGACATGACCGACTCCGACTGCCGGGACAACGCGCCCAGG ACGATCTTCATAATCAGCATGTACAAGGACTCGCAGCCCAGGGGCATG GCCGTAACCATCAGCGTCAAGTGCGAAAAGATCTCCACCCTCAGCTGC GAGAACAAGATAATCAGCTTCAAGGAGATGAACCCGCCCGACAACATC AAGGACACCAAGTCCGACATCATCTTCTTCCAGCGCTCCGTGCCCGGC CACGACAATAAGATGCAGTTTGAGAGCAGCTCCTACGAAGGCTACTTT CTGGCCTGCGAGAAGGAGCGGGACCTGTTCAAGCTGATCCTGAAGAAG GAGGACGAGCTGGGCGATCGGAGCATCATGTTCACGGTGCAGAACGAG GAC |
| 731 | IgLC_IL18 | ATGGCGTGGACGGTCCTCCTCCTCGGCCTCCTCTCACACTGCACCGGG AGCGTCACCAGCTACTTCGGCAAGCTCGAAAGCAAGCTCTCGGTCATC AGGAACCTCAACGACCAGGTCCTCTTCATCGACCAGGGTAATCGCCCA CTCTTCGAGGATATGACCGACAGCGATTGCCGGGACAACGCCCCGCGT ACAATCTTCATCATCAGTATGTACAAGGACAGCCAGCCGCGGGGCATG GCCGTCACCATCTCCGTCAAGTGCGAAAAGATCAGCACGCTTAGCTGC GAGAACAAGATCATCAGCTTCAAGGAGATGAATCCTCCCGACAACATC AAGGATACCAAGTCCGATATCATTTTCTTCCAGCGGTCCGTGCCAGGC CACGACAACAAGATGCAATTTGAAAGCTCCTCCTACGAGGGCTACTTC CTGGCCTGCGAGAAGGAAAGGGACCTGTTCAAGCTGATCCTGAAGAAG GAGGACGAGCTGGGCGACAGGTCCATCATGTTTACTGTGCAGAACGAG GAC |
| 732 | IgLC_IL18 | ATGGCCTGGACCGTACTACTCCTCGGCCTCCTTTCCCACTGCACCGGT TCGGTCACGAGCTACTTCGGCAAGCTGGAGAGCAAGCTCTCGGTCATC CGGAACCTCAACGACCAGGTCCTCTTCATCGACCAGGGCAACAGGCCC TTATTCGAGGACATGACCGACAGCGACTGCAGGGACAACGCGCCCAGG ACCATCTTCATCATCAGCATGTACAAGGACTCCCAGCCCAGGGGGATG GCCGTAACCATCTCCGTAAAGTGCGAGAAGATCAGCACCCTCAGCTGC GAAAACAAAATCATCAGCTTCAAGGAGATGAACCCGCCGGACAACATC AAAGACACCAAGTCCGACATTATCTTCTTTCAGCGCAGCGTCCCCGGG CACGACAACAAGATGCAGTTCGAGAGCAGCTCCTACGAGGGCTACTTC CTGGCCTGCGAGAAGGAACGGGACCTCTTCAAGCTGATCCTCAAGAAG GAGGATGAGCTCGGGGACCGCTCCATCATGTTTACCGTGCAGAACGAA GAT |
| 733 | IgLC_IL18_SN | ATGGCGTGGACGGTCTTGCTCCTCGGCCTCCTAAGCCACTGCACGGGC TCCGTCACGAGCTATTTCGGCAAGCTCGAGAGCAAGTTGAGCGTCATC AGGAACCTCAACGACCAAGTCCTCTTTATCGACCAGGGCAACCGGCCC CTCTTCGAGGACATGACGTCCAGCGACTGCAGGAACAACGCCCCCAGG ACCATCTTCATAATCAGCATGTATAAGGACTCCCAGCCCAGGGGGATG GCCGTAACCATCTCGGTGAAGTGCGAAAAAATCAGCACCCTCAGCTGT GAGAATAAGATCATCTCCTTCAAGGAGATGAACCCGCCGGACAACATA AAAGACACCAAAAGCGACATCATCTTCTTCCAGCGGAGCGTGCCGGGC CACGACAACAAAATGCAGTTCGAGAGCTCGAGCTATGAGGGCTACTTC CTCGCCTGTGAGAAGGAGAGGGACCTCTTCAAGCTGATTCTGAAGAAG GAGGACGAACTGGGGGACAGGAGCATCATGTTCACCGTGCAGAATGAG GAT |
| 734 | IgLC_IL18_SN | ATGGCCTGGACCGTCCTCCTCCTCGGCCTTCTCAGCCACTGCACCGGC AGCGTCACCTCCTACTTCGGGAAGCTCGAGAGCAAGCTCAGCGTAATA CGGAACCTCAACGACCAGGTCCTTTTCATCGATCAGGGTAACCGACCC CTCTTCGAGGACATGACCAGCTCGGATTGCAGGAACAACGCCCCCCGG ACCATCTTCATCATCAGCATGTACAAGGACAGCCAGCCCAGGGGCATG GCCGTTACTATCAGCGTTAAGTGCGAGAAGATCTCCACACTCAGCTGT GAGAACAAGATCATCTCCTTTAAGGAGATGAACCCCCCGGACAACATC AAGGACACCAAGTCCGACATCATCTTCTTCCAGAGGAGCGTGCCGGGC CATGACAATAAGATGCAATTCGAGTCCAGCAGCTACGAGGGCTACTTC CTCGCCTGCGAGAAGGAGAGGGACCTGTTCAAGCTGATCCTGAAGAAG GAGGATGAGCTCGGCGACCGAAGCATAATGTTTACCGTGCAGAACGAG GAC |
| 735 | IgLC_IL18_SN | ATGGCCTGGACCGTGCTCCTCTTAGGCCTTCTCAGCCACTGCACGGGC AGCGTCACCTCCTACTTCGGCAAGCTTGAGAGCAAGCTTAGCGTAATC AGGAACTTGAACGACCAGGTCCTCTTCATCGATCAGGGCAATAGGCCC CTCTTCGAGGATATGACAAGCAGCGACTGCCGCAACAACGCCCCGAGG ACCATCTTCATCATCAGCATGTACAAGGATAGCCAGCCCCGCGGGATG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GCCGTCACCATCTCCGTAAAGTGCGAGAAGATAAGCACCCTTAGCTGT GAGAACAAGATCATCTCATTCAAGGAGATGAACCCGCCCGACAACATC AAAGACACCAAGTCAGATATAATCTTCTTTCAGAGGAGCGTGCCCGGG CATGACAACAAGATGCAGTTCGAGAGCTCCTCCTATGAGGGGTACTTC CTCGCCTGCGAGAAGGAGCGGGACCTCTTCAAGCTGATCCTGAAGAAG GAGGACGAGCTGGGGGACAGGAGCATCATGTTCACCGTTCAGAACGAA GAC |
| 736 | IgLC_IL18_SN | ATGGCCTGGACGGTCCTCCTCCTCGGACTCCTCAGCCACTGCACCGGC AGCGTCACCTCGTATTTCGGCAAGCTCGAGAGCAAGCTCTCCGTTATC CGGAACCTAAACGACCAGGTCCTCTTCATCGACCAGGGCAACAGGCCC CTATTCGAGGATATGACCAGCAGCGACTGCCGAAACAACGCCCCCCGG ACCATCTTCATCATCAGCATGTACAAGGACAGCCAGCCCAGGGGCATG GCAGTCACCATCAGCGTCAAGTGCGAGAAGATAAGCACCCTTAGCTGC GAAAACAAGATCATCTCCTTCAAGGAGATGAACCCGCCCGACAACATC AAGGACACCAAGAGCGATATCATCTTCTTCCAGCGCTCCGTGCCTGGA CACGACAACAAGATGCAGTTCGAGAGCAGCTCCTACGAGGGCTATTTC CTGGCCTGCGAGAAGGAGCGGGACCTGTTCAAGCTGATCCTGAAGAAG GAGGATGAGCTGGGGGACAGGTCCATAATGTTCACCGTCCAGAACGAG GAT |
| 737 | IgLC_IL18_SN | ATGGCGTGGACCGTCCTCCTCCTTGGCCTCCTAAGCCACTGCACCGGC AGCGTCACAAGTTACTTCGGCAAGCTCGAGAGCAAGCTCTCGGTCATC CGGAACCTCAACGACCAGGTCCTCTTTATCGACCAGGGGAACCGGCCC CTCTTCGAGGATATGACCAGCTCCGACTGCAGGAACAACGCCCCGAGG ACCATCTTCATCATCTCCATGTATAAGGATAGCCAGCCCCGGGGCATG GCCGTCACCATCTCCGTCAAGTGCGAGAAGATCAGCACGCTCAGCTGT GAGAATAAGATCATCTCCTTCAAGGAGATGAACCCACCCGACAACATC AAGGACACCAAGAGCGACATCATCTTCTTCCAAAGGAGCGTCCCCGGC CACGACAACAAGATGCAGTTCGAGAGCTCATCCTATGAGGGCTATTTC CTGGCCTGTGAGAAGGAGAGGGACCTGTTCAAGCTGATACTCAAGAAA GAGGATGAGCTGGGGGACAGGTCCATCATGTTCACCGTGCAGAATGAG GAC |
| 738 | IgLC_IL18_SN | ATGGCCTGGACGGTCCTCCTCCTAGGGCTCCTCAGCCACTGCACGGGG AGCGTCACCAGCTACTTCGGGAAGCTAGAGTCCAAGTTGAGCGTCATC AGGAACCTCAACGATCAGGTCCTCTTCATCGACCAGGGGAATAGGCCC CTCTTCGAGGACATGACCAGCAGCGACTGCCGGAACAACGCCCCCCGC ACCATCTTCATCATCTCCATGTACAAGGACTCCCAGCCCAGGGGGATG GCGGTAACCATCTCCGTCAAGTGCGAGAAAATAAGCACCCTAAGCTGC GAGAACAAAATCATCAGCTTCAAGGAGATGAACCCGCCCGACAACATC AAGGACACCAAGAGCGACATCATCTTCTTCCAGCGTTCCGTGCCGGGA CACGACAATAAGATGCAGTTCGAGAGCTCCAGCTACGAGGGCTATTTC CTGGCATGCGAGAAGGAGAGGGACCTCTTCAAGCTGATCCTGAAGAAG GAGGACGAGCTGGGCGACAGGTCCATCATGTTCACCGTGCAAAACGAG GAC |
| 739 | IgLC_IL18_SN | ATGGCCTGGACCGTCCTACTCTTGGGCCTACTCAGCCACTGCACCGGC AGCGTCACGAGCTACTTCGGCAAGCTCGAGAGTAAACTCAGCGTCATA AGGAACCTCAACGACCAGGTCCTCTTCATCGACCAGGGCAATAGGCCC CTCTTCGAGGACATGACCAGCTCCGACTGTCGGAATAACGCCCCCCGG ACCATCTTCATCATCAGCATGTACAAGGACTCGCAGCCCCGCGGCATG GCCGTCACGATAAGCGTCAAGTGCGAGAAAATCTCGACACTCTCCTGC GAAAACAAGATCATCTCCTTCAAGGAGATGAATCCCCCCGACAACATC AAGGACACCAAGAGCGACATCATCTTCTTCCAGCGCAGCGTGCCCGGC CACGACAATAAGATGCAGTTCGAGAGCAGCTCCTATGAGGGGTACTTC CTCGCCTGCGAGAAGGAGAGGGATCTGTTCAAACTGATCTTGAAGAAG GAGGATGAGCTGGGGGACAGGTCCATCATGTTCACCGTGCAGAACGAG GAC |
| 740 | IgLC_IL18_SN | ATGGCCTGGACCGTCCTATTGCTAGGCCTCCTCAGCCACTGCACCGGA AGCGTAACCTCCTACTTCGGCAAGCTCGAGAGCAAACTCAGCGTGATC AGGAATCTAAACGATCAGGTCCTCTTCATCGACCAGGGCAACCGCCCC TTATTCGAGGACATGACGAGCAGCGACTGCCGAAACAACGCGCCCCGC ACCATCTTTATCATCAGCATGTACAAGGATTCCCAGCCCAGGGGCATG GCCGTCACGATATCCGTCAAGTGCGAAAAGATCAGCACCCTTAGCTGT GAGAACAAGATCATCTCCTTCAAGGAGATGAATCCCCCCGACAACATC AAGGACACCAAGTCCGACATCATTTTCTTCCAGAGGAGCGTCCCGGGG CACGATAACAAGATGCAGTTCGAGTCCAGCTCCTACGAGGGCTACTTC CTGGCCTGCGAGAAGGAGAGGGACCTGTTCAAGCTCATCCTCAAGAAG GAGGATGAGCTGGGGGACCGGTCCATCATGTTCACCGTGCAGAACGAG GAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 741 | IgLC_IL18_SN | ATGGCCTGGACCGTCCTCCTCCTCGGCCTACTCTCCCACTGTACCGGG TCCGTCACCTCATACTTCGGCAAGCTCGAGAGCAAGCTCAGCGTCATC AGGAACCTTAACGACCAGGTTCTTTTTATCGACCAGGGGAACAGGCCC CTATTCGAGGACATGACCTCCAGCGACTGCAGGAACAACGCCCCCAGG ACCATCTTCATCATCAGCATGTACAAGGACTCCCAGCCCCGGGGCATG GCCGTTACCATCTCCGTCAAGTGCGAAAAAATTAGCACCCTCAGCTGT GAGAACAAGATCATCAGCTTCAAAGAGATGAACCCGCCCGACAACATC AAGGACACCAAGAGCGATATCATCTTCTTTCAGCGGTCCGTCCCCGGC CACGACAACAAGATGCAGTTCGAGAGCAGCAGCTACGAGGGCTACTTC CTGGCCTGCGAAAAGGAGAGGGACCTGTTCAAGCTGATCCTGAAGAAG GAGGACGAGCTGGGGGACAGGTCCATCATGTTCACCGTCCAGAACGAG GAC |
| 742 | IgLC_IL18_SN | ATGGCCTGGACCGTCCTCCTCCTCGGCTTGCTCAGCCACTGCACCGGG AGCGTTACCAGCTACTTCGGCAAGCTCGAGAGCAAGCTGTCAGTGATC AGGAATCTCAACGACCAAGTCCTCTTCATCGATCAGGGGAACCGGCCC CTCTTCGAGGACATGACGTCCTCCGACTGCCGGAATAACGCCCCTCGC ACCATCTTCATCATCAGCATGTACAAGGATAGCCAGCCCAGGGGCATG GCCGTCACCATCAGCGTAAAGTGTGAGAAGATCTCGACGCTCAGCTGC GAAAATAAGATCATCAGCTTCAAGGAGATGAACCCGCCCGACAACATC AAGGACACAAAGAGCGACATCATTTTCTTTCAGCGGAGCGTGCCCGGC CACGACAATAAAATGCAGTTCGAGAGCAGCTCGTATGAAGGCTACTTC CTCGCGTGCGAGAAGGAGCGGGATCTGTTCAAGCTGATCCTGAAGAAG GAGGACGAGCTGGGGGACCGGAGCATCATGTTCACCGTGCAGAACGAA GAC |
| 743 | IgLC_IL18_SN | ATGGCCTGGACCGTCTTGCTCCTCGGGCTCCTGAGCCACTGCACCGGC TCCGTCACCTCCTACTTCGGAAAGCTCGAGAGCAAGTTGAGCGTCATC AGGAACCTCAACGACCAGGTCCTTTTTATCGACCAGGGGAACAGGCCC CTATTCGAGGACATGACCAGCAGCGACTGTCGGAATAACGCACCCAGG ACCATCTTCATCATCAGCATGTATAAGGACAGCCAGCCCAGGGGGATG GCGGTCACCATCTCCGTAAAGTGCGAGAAGATCAGCACCCTCTCCTGC GAGAATAAAATCATCTCGTTCAAGGAGATGAACCCTCCGGACAACATC AAGGACACGAAGTCCGACATCATCTTCTTCCAGCGGAGCGTACCCGGC CACGACAACAAAATGCAGTTTGAGAGCAGCAGCTACGAGGGGTACTTC CTCGCCTGTGAAAAGGAGAGGGACCTGTTTAAGCTGATCCTGAAAAAA GAAGACGAGCTCGGAGATCGGAGCATCATGTTTACGGTGCAGAATGAG GAT |
| 744 | IgLC_IL18_SN | ATGGCCTGGACCGTCCTACTCCTCGGCTTGCTAAGCCACTGTACGGGG AGCGTCACGAGCTACTTCGGGAAGCTCGAGAGCAAGCTCTCCGTAATC AGGAACCTCAACGACCAGGTACTCTTCATCGACCAGGGCAACAGGCCC CTCTTCGAGGACATGACCAGCTCCGATTGCCGGAACAACGCCCCAAGG ACGATCTTCATAATCAGCATGTACAAAGACAGCCAGCCCAGGGGCATG GCCGTCACGATCTCCGTTAAGTGCGAGAAGATCAGCACCCTCAGCTGC GAGAATAAGATCATAAGCTTCAAGGAGATGAACCCCCCGGATAACATC AAGGACACCAAGAGCGACATCATCTTCTTTCAACGGTCCGTCCCCGGC CACGACAACAAGATGCAGTTTGAGTCATCCTCCTACGAGGGTTACTTC CTGGCCTGCGAGAAGGAGAGGGACCTGTTCAAGCTCATCCTGAAAAAG GAGGATGAGCTGGGCGACAGGAGCATCATGTTCACCGTGCAGAACGAG GAT |
| 745 | IgLC_IL18_SN | ATGGCCTGGACGGTCCTCCTCCTCGGTCTGCTCAGCCACTGCACCGGC AGCGTCACCTCCTACTTCGGCAAGTTGGAGAGCAAGCTCTCGGTGATC CGGAACCTCAACGACCAGGTCCTCTTCATCGACCAGGGCAACAGGCCC CTCTTCGAGGACATGACGTCCTCCGACTGCAGGAACAACGCTCCCAGG ACCATCTTCATCATAAGCATGTACAAGGACTCCCAGCCCCGGGGCATG GCGGTCACCATCTCCGTCAAGTGTGAGAAGATCAGCACCCTCTCCTGT GAGAACAAGATCATCTCCTTCAAGGAGATGAATCCCCCCGACAACATC AAGGATACCAAGAGCGACATCATCTTCTTCCAGCGGAGCGTACCCGGG CACGACAATAAAATGCAGTTCGAGTCCAGCAGCTATGAGGGCTACTTC CTGGCGTGCGAGAAGGAGAGGGACCTGTTCAAACTGATACTGAAGAAG GAGGACGAGCTGGGCGACCGGAGCATCATGTTCACAGTGCAGAACGAG GAT |
| 746 | IgLC_IL18_SN | ATGGCCTGGACCGTCCTCCTCCTCGGCCTCCTCAGCCACTGCACCGGC AGCGTAACGAGCTACTTCGGTAAGCTCGAGAGCAAGCTCAGCGTCATC CGGAACCTCAACGACCAGGTCTTGTTCATCGACCAGGGCAACAGGCCC CTCTTCGAGGACATGACCTCGAGCGATTGTAGGAACAACGCCCCCAGG ACCATCTTCATCATCAGCATGTACAAAGATAGCCAGCCACGGGGCATG GCCGTCACCATCTCGGTTAAGTGCGAGAAAATCTCCACCCTCAGCTGC GAGAACAAAATAATCAGCTTCAAGGAGATGAATCCCCCCGATAACATA AAGGATACCAAAAGCGACATCATCTTCTTCCAGAGGTCCGTGCCGGGC CATGACAACAAGATGCAGTTCGAGTCCTCCAGCTACGAGGGCTACTTT |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CTGGCCTGCGAGAAGGAGAGGGACCTGTTCAAGCTGATCCTGAAGAAG GAGGATGAGCTGGGCGACAGGTCCATCATGTTCACCGTGCAGAATGAG GAC |
| 747 | IgLC_IL18_SN | ATGGCGTGGACAGTGCTCCTCCTCGGCCTCCTCAGCCACTGCACCGGT AGCGTCACCTCCTACTTCGGGAAGCTTGAGTCCAAGCTCAGCGTAATC AGGAACCTCAACGACCAGGTCCTCTTCATCGACCAGGGCAACCGCCCC CTCTTCGAGGATATGACCAGCAGCGATTGTCGAAACAACGCCCCCCGG ACCATCTTCATCATCAGCATGTACAAAGATAGCCAGCCCAGGGGGATG GCCGTCACCATCTCCGTCAAGTGTGAGAAGATCAGCACGCTCTCCTGC GAGAACAAGATCATCTCCTTCAAGGAGATGAACCCGCCCGACAACATC AAGGACACGAAGTCCGATATCATCTTCTTCCAGCGGAGCGTCCCCGGC CATGACAATAAGATGCAGTTCGAGTCCTCCAGTTACGAGGGCTATTTC CTGGCCTGCGAAAAGGAGAGGGACCTGTTCAAGCTGATCCTGAAGAAG GAAGACGAGCTGGGCGACAGGAGCATCATGTTCACCGTGCAGAACGAG GAC |
| 748 | IgLC_IL18_SN | ATGGCCTGGACCGTCCTCCTTCTCGGGCTACTCTCCCACTGCACCGGG AGCGTCACCTCATACTTCGGCAAGCTCGAGAGCAAGCTCTCGGTCATC AGGAACCTCAACGACCAGGTCCTCTTCATCGACCAGGGCAATAGGCCC CTCTTCGAGGACATGACCAGCTCCGACTGCAGGAACAACGCCCCCCGC ACCATCTTTATCATCAGCATGTATAAGGACAGCCAGCCGCGGGGCATG GCCGTCACGATCTCCGTCAAGTGCGAGAAAATCAGCACGCTCAGCTGC GAGAACAAAATCATCAGCTTTAAAGAGATGAATCCCCCCGACAACATC AAAGACACGAAAAGCGACATCATCTTCTTCCAACGTAGCGTGCCCGGC CACGACAACAAGATGCAGTTCGAGAGCAGCAGCTATGAGGGGTACTTC CTGGCGTGCGAGAAGGAGAGGGACCTGTTCAAGCTGATCCTGAAGAAA GAGGACGAGCTGGGCGACCGAAGCATCATGTTTACAGTCCAGAATGAG GAT |
| 749 | IgLC_IL18_SN | ATGGCCTGGACCGTTCTCCTCCTCGGCCTACTCAGCCACTGCACCGGC AGCGTCACCTCCTACTTCGGCAAGCTAGAAAGCAAGCTCAGCGTTATC AGGAATCTAAACGATCAGGTTCTCTTCATCGATCAAGGGAACCGCCCC CTCTTCGAGGATATGACCAGCTCGGACTGTAGGAACAACGCCCCCAGG ACCATTTTCATCATCTCCATGTACAAGGATAGCCAGCCCCGGGGGATG GCCGTCACCATCAGCGTCAAGTGCGAGAAAATCAGCACGCTCAGCTGC GAGAACAAAATCATATCCTTCAAGGAGATGAATCCGCCTGATAACATC AAAGACACAAAGAGCGACATCATCTTCTTCCAGAGGAGCGTGCCCGGC CACGATAACAAGATGCAGTTCGAGAGCAGCAGCTACGAGGGGTACTTC CTGGCTTGCGAGAAGGAGAGGGATCTGTTTAAGCTCATCCTGAAGAAG GAGGACGAGCTGGGGGACAGGAGCATCATGTTCACCGTCCAGAACGAG GAT |
| 750 | IgLC_IL18_SN | ATGGCGTGGACAGTCCTCCTCCTCGGACTTCTTAGCCACTGCACCGGC TCCGTCACCTCCTACTTCGGGAAACTCGAGAGCAAGCTTTCGGTCATC AGGAACCTCAACGACCAGGTCCTCTTCATCGACCAGGGGAACAGGCCC CTCTTCGAGGACATGACCAGCTCCGACTGCAGGAATAACGCCCCCAGG ACCATCTTCATCATCAGCATGTACAAGGACAGCCAGCCCCGGGGGATG GCCGTCACCATCAGCGTCAAGTGCGAGAAGATCAGCACCTTGTCCTGC GAGAATAAGATCATCTCCTTTAAGGAGATGAATCCCCCAGACAACATC AAGGACACCAAGTCCGATATCATCTTCTTCCAGCGGTCCGTGCCCGGC CACGACAACAAGATGCAGTTCGAGAGCTCCAGTTACGAGGGCTATTTC CTCGCCTGCGAGAAGGAGAGGGACCTGTTCAAGCTGATACTGAAAAAG GAGGACGAGCTGGGCGATCGGAGCATCATGTTCACCGTGCAGAACGAG GAC |
| 751 | IgLC_IL18_SN | ATGGCCTGGACCGTGCTCCTCCTCGGGCTCCTCAGCCACTGCACCGGC AGCGTTACAAGCTACTTCGGCAAGCTCGAAAGCAAGCTCTCCGTCATC AGGAACCTCAACGACCAGGTCCTCTTCATCGACCAGGGGAACAGGCCC CTCTTCGAGGACATGACCAGCAGCGACTGTAGGAATAACGCGCCCAGG ACCATCTTTATCATCAGTATGTACAAGGACAGCCAGCCCAGGGGAATG GCCGTCACCATCTCCGTCAAGTGCGAGAAAATCAGCACCCTCAGCTGT GAGAACAAGATCATCAGCTTCAAGGAGATGAACCCGCCCGATAACATC AAGGACACTAAGAGCGACATCATCTTCTTCCAGAGGAGCGTGCCCGGC CACGATAACAAGATGCAGTTCGAGTCCAGCTCATACGAGGGGTACTTT CTGGCCTGTGAGAAGGAGAGGGACCTGTTCAAGCTCATCCTGAAGAAG GAGGATGAGCTCGGCGACCGAAGCATCATGTTCACCGTGCAAAACGAG GAC |
| 752 | IgLC_IL18_SN | ATGGCCTGGACCGTCCTCCTCCTTGGCCTACTTAGCCACTGCACCGGT AGCGTCACCAGCTACTTCGGCAAGCTCGAGAGCAAGCTCAGCGTCATC AGGAACCTCAACGATCAGGTACTCTTCATCGACCAGGGGAATCGTCCC CTCTTCGAGGACATGACCTCATCCGACTGCCGCAACAACGCCCCCCGG ACCATCTTCATCATCTCGATGTACAAGGACTCCCAGCCCAGGGGGATG |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | GCCGTCACCATCTCCGTCAAGTGCGAGAAGATCAGCACCCTCAGCTGC GAAAACAAGATAATCTCCTTCAAGGAGATGAACCCGCCCGACAACATC AAGGACACGAAAAGCGACATTATCTTCTTCCAGAGGAGCGTGCCGGGG CACGACAACAAGATGCAGTTCGAGTCGTCCAGCTACGAGGGCTATTTC CTCGCCTGCGAGAAAGAGAGGGACCTGTTCAAGCTGATCCTGAAGAAG GAGGACGAGCTGGGGGATAGGAGCATCATGTTCACCGTCCAGAACGAA GAC |
| 753 | IgLC_IL18_SN | ATGGCCTGGACGGTCCTCCTCCTCGGGCTCCTTAGCCACTGTACCGGG TCGGTCACAAGCTACTTCGGCAAGCTCGAGAGCAAGCTTAGCGTAATC AGAAACCTTAACGATCAGGTCCTTTTTATAGACCAGGGCAACCGTCCG CTGTTCGAGGATATGACCAGCAGCGACTGCAGGAATAACGCCCCCCGG ACGATATTCATCATCAGCATGTATAAGGATAGCCAGCCGCGAGGGATG GCCGTCACCATCAGCGTCAAGTGCGAGAAGATCAGCACGCTCTCCTGC GAGAATAAGATCATCTCCTTCAAGGAGATGAACCCCCCGGACAACATC AAGGATACCAAGAGCGACATCATCTTCTTCCAGAGGAGCGTGCCAGGC CACGACAATAAGATGCAGTTTGAGAGCAGCTCCTACGAGGGGTATTTT CTGGCCTGCGAGAAGGAGAGGGACCTGTTTAAGCTGATCCTGAAGAAG GAGGACGAGCTGGGCGACCGAAGCATCATGTTCACCGTGCAAAACGAG GAT |
| 754 | IgLC_IL18_SN | ATGGCCTGGACGGTCCTCCTCCTCGGTTTGCTCAGCCACTGCACCGGC TCCGTCACGAGCTATTTCGGTAAGCTCGAGAGCAAGCTCTCCGTCATC AGGAATCTCAACGACCAGGTCCTCTTTATCGACCAGGGGAACAGGCCC CTCTTCGAAGACATGACCAGCTCCGACTGCAGGAACAACGCCCCCAGG ACCATCTTCATCATCAGCATGTACAAGGACTCACAGCCCCGGGGCATG GCGGTTACCATCAGCGTCAAGTGCGAGAAGATAAGCACGCTCAGCTGC GAGAACAAAATCATCAGCTTCAAGGAGATGAACCCGCCCGATAACATC AAAGACACCAAGAGCGATATCATCTTCTTCCAGCGCAGCGTGCCGGGG CACGATAATAAGATGCAGTTCGAGTCCTCCAGCTATGAGGGCTATTTC CTGGCCTGCGAGAAGGAGCGGGACCTGTTCAAGCTCATACTCAAGAAG GAGGACGAGCTGGGTGACAGGTCGATCATGTTCACCGTGCAGAACGAA GAT |
| 755 | IgLC_IL18_SN | ATGGCGTGGACGGTCCTCCTTCTTGGGCTCCTAAGCCACTGCACCGGC AGCGTAACCTCCTACTTCGGGAAGCTCGAGTCAAAGCTCAGCGTCATC AGGAACCTCAACGACCAGGTCTTGTTCATCGACCAGGGAAACCGGCCC CTATTCGAAGACATGACGAGCTCAGACTGCCGTAACAACGCCCCCAGG ACCATCTTCATCATCAGCATGTACAAGGATTCCCAGCCCAGGGGAATG GCCGTCACCATCAGCGTAAAGTGCGAGAAGATAAGCACCCTCAGCTGC GAGAATAAAATCATCTCCTTCAAGGAGATGAACCCACCCGACAACATC AAGGACACCAAGTCCGACATCATCTTCTTCCAGCGATCGGTGCCGGGG CACGACAACAAGATGCAGTTCGAGAGCTCCAGCTACGAAGGCTACTTC CTCGCCTGCGAGAAGGAGAGGGACCTCTTCAAGCTCATCCTGAAGAAG GAGGACGAACTGGGCGATAGGAGCATTATGTTCACTGTGCAGAATGAG GAC |
| 756 | IgLC_IL18_SN | ATGGCCTGGACCGTCCTTCTCCTAGGGTTGCTAAGCCACTGCACCGGG AGCGTCACCAGCTACTTCGGGAAGTTGGAGAGCAAGCTCAGCGTCATC CGCAACTTGAACGACCAGGTCCTATTCATCGACCAGGGCAATAGGCCC CTATTCGAGGATATGACCAGCTCCGACTGCCGGAACAACGCCCCCAGG ACCATCTTCATCATCTCCATGTACAAGGATAGCCAGCCCAGGGGCATG GCCGTAACGATCTCCGTAAAGTGCGAGAAGATCAGCACGCTCTCGTGT GAGAATAAGATCATCTCTTTCAAAGAGATGAACCCGCCCGACAACATC AAGGATACCAAGTCAGACATCATCTTCTTCCAGAGGTCCGTCCCCGGG CACGACAACAAGATGCAGTTCGAGAGCTCCAGCTATGAGGGCTACTTC CTGGCGTGCGAGAAGGAGAGGGACCTGTTCAAGCTGATCCTCAAAAAG GAGGACGAGCTCGGGGACAGGAGCATCATGTTCACAGTGCAGAACGAG GAC |
| 757 | IgLC_IL18_SN | ATGGCCTGGACGGTCCTCCTACTCGGCCTCCTCAGCCACTGCACCGGG TCCGTCACTAGCTACTTCGGCAAACTCGAATCCAAGCTAAGCGTCATC CGGAACCTCAACGACCAGGTCTTGTTCATCGATCAGGGCAACCGCCCC TTATTCGAAGACATGACCAGCTCCGACTGCCGGAACAACGCGCCCAGG ACCATCTTCATAATTTCGATGTACAAGGACAGCCAGCCCAGGGGCATG GCGGTCACCATCAGCGTCAAGTGCGAGAAGATATCCACCCTCTCGTGC GAGAACAAGATCATCTCGTTCAAGGAGATGAACCCGCCCGACAACATC AAAGACACCAAAAGCGACATCATCTTCTTTCAGCGCTCGGTGCCCGGG CATGACAACAAAATGCAGTTCGAGAGCAGCAGCTACGAGGGGTACTTC CTGGCCTGTGAAAAGGAGAGGGACCTGTTCAAGCTCATCCTCAAGAAA GAGGACGAACTGGGCGACAGGAGCATCATGTTTACCGTGCAGAATGAG GAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 758 | IL1ra_IL18 | ATGGAAATTTGCAGGGGCCTTCGCAGCCACCTAATCACCCTCCTCCTC<br>TTCCTCTTCCATAGCGAGACTATCTGCTACTTCGGGAAGCTAGAGAGC<br>AAGCTCAGCGTCATCAGGAACCTCAACGACCAGGTCCTATTCATAGAC<br>CAGGGGAACCGGCCACTCTTCGAGGATATGACCGACAGCGATTGCCGG<br>GACAACGCCCCCCGAACCATCTTCATCATCAGCATGTACAAGGACTCC<br>CAGCCCAGGGGCATGGCCGTCACAATAAGCGTCAAGTGCGAGAAGATC<br>AGCACGCTCAGCTGCGAGAATAAGATCATCTCCTTCAAGGAGATGAAT<br>CCCCCGGACAACATCAAGGACACCAAAAGCGACATCATATTCTTCCAG<br>AGGAGCGTGCCTGGGCACGACAACAAGATGCAGTTCGAAAGCTCCAGC<br>TACGAGGGCTACTTCCTCGCCTGCGAGAAGGAGCGGGACCTGTTCAAG<br>CTCATCCTCAAGAAGGAGGATGAGCTGGGGGACAGGAGCATCATGTTC<br>ACCGTCCAGAATGAAGAC |
| 759 | IL1ra_IL18 | ATGGAGATCTGCAGGGGGCTAAGGTCCCACTTAATAACCCTCCTCCTA<br>TTCCTTTTTCACTCCGAGACGATTTGCTACTTCGGCAAGCTCGAGTCG<br>AAGCTCTCCGTCATCCGGAACCTCAACGACCAGGTCTTGTTCATCGAC<br>CAGGGGAACAGGCCCTTGTTCGAGGACATGACCGATTCCGACTGCCGG<br>GACAACGCCCCCCGCACCATCTTCATCATCTCCATGTACAAGGACAGC<br>CAGCCCAGGGGCATGGCCGTTACCATCTCGGTCAAGTGCGAGAAGATC<br>AGCACCCTCTCCTGCGAGAACAAGATCATCTCCTTCAAGGAGATGAAT<br>CCCCCGGACAACATCAAGGACACCAAGAGCGACATCATCTTCTTCCAG<br>AGGTCCGTGCCCGGCCACGACAACAAGATGCAGTTCGAGAGCAGCAGC<br>TACGAGGGCTACTTCCTGGCCTGCGAGAAGGAACGGGACCTGTTCAAG<br>CTGATCCTGAAAAAGGAGGACGAGCTGGGGGACCGCAGCATCATGTTC<br>ACCGTGCAAAACGAGGAC |
| 760 | IL1ra_IL18 | ATGGAGATCTGCAGGGGCTTACGTAGCCACCTCATCACCCTCCTCCTC<br>TTCCTCTTCCACTCCGAGACGATCTGCTACTTCGGAAAGCTCGAGAGC<br>AAGCTCTCCGTCATCAGAAACCTTAACGACCAGGTCCTTTTCATCGAC<br>CAGGGGAACCGGCCCCTTTTCGAGGACATGACCGACTCGGACTGCAGG<br>GATAACGCCCCCAGGACCATCTTCATCATCAGCATGTACAAGGACAGC<br>CAGCCCAGGGGCATGGCCGTCACCATCAGCGTCAAGTGCGAGAAGATC<br>TCCACCCTAAGCTGCGAGAACAAGATCATCAGCTTCAAGGAGATGAAC<br>CCGCCGGACAACATCAAAGACACCAAGTCCGACATCATCTTCTTCCAG<br>AGAAGCGTGCCCGGCCATGATAACAAAATGCAATTCGAAAGCTCGAGC<br>TACGAGGGGTATTTCCTGGCCTGTGAGAAGGAGAGGGATCTGTTCAAG<br>CTGATACTGAAGAAGGAGGACGAGCTGGGGGATCGGAGCATCATGTTC<br>ACCGTGCAGAATGAGGAC |
| 761 | IL1ra_IL18 | ATGGAGATCTGTAGGGGGCTCAGGAGCCACCTTATCACCCTCTTGCTG<br>TTCCTCTTCCACAGCGAGACGATCTGCTACTTCGGGAAACTCGAAAGC<br>AAGCTTAGCGTCATCAGGAACCTCAACGATCAGGTCCTCTTCATCGAC<br>CAGGGCAACAGGCCCTTGTTCGAGGACATGACCGACAGCGATTGCCGG<br>GACAACGCCCCAAGGACAATCTTCATCATTAGCATGTACAAGGACTCG<br>CAGCCGCGGGGCATGGCGGTCACAATCAGCGTCAAGTGCGAGAAGATC<br>AGCACCCTCAGCTGCGAGAATAAGATCATCTCCTTCAAGGAGATGAAC<br>CCGCCCGACAATATCAAGGACACCAAGAGCGATATCATATTCTTCCAG<br>CGGAGCGTCCCCGGGCACGACAACAAGATGCAGTTTGAGTCCAGCTCC<br>TATGAGGGGTACTTCCTCGCCTGTGAGAAGGAGAGGGACCTGTTCAAG<br>CTCATCCTGAAGAAGGAGGACGAGCTGGGCGACAGGAGCATCATGTTT<br>ACCGTGCAGAACGAGGAC |
| 762 | IL1ra_IL18 | ATGGAGATCTGTCGGGGGCTCAGGAGCCATCTCATCACCCTCCTCCTC<br>TTCCTCTTCCACTCCGAGACGATTTGCTACTTCGGCAAGCTCGAGAGC<br>AAGCTCAGCGTCATCAGGAACCTCAACGATCAGGTCCTTTTCATCGAC<br>CAGGGGAACAGGCCGCTGTTCGAGGACATGACCGATAGCGATTGTCGG<br>GACAACGCCCCCAGGACCATTTTCATAATCTCCATGTACAAGGACAGC<br>CAGCCCAGGGGCATGGCCGTCACCATCTCCGTCAAGTGTGAGAAGATC<br>TCCACCTTGAGCTGTGAGAACAAAATCATCTCCTTCAAAGAGATGAAC<br>CCTCCCGACAACATCAAGGATACCAAGAGCGACATCATCTTCTTCCAG<br>AGGAGCGTGCCTGGTCACGACAACAAGATGCAGTTTGAGTCCAGCTCC<br>TACGAGGGGTACTTCCTGGCCTGCGAGAAGGAGAGGGACCTGTTCAAG<br>CTCATCCTGAAAAAGGAAGACGAGCTGGGGGACAGGAGCATCATGTTC<br>ACCGTCCAGAACGAGGAC |
| 763 | IL1ra_IL18 | ATGGAGATCTGCAGGGGCCTCCGGAGCCACCTCATCACCCTCCTCCTC<br>TTCTTGTTCCACAGCGAAACGATCTGCTACTTCGGTAAGCTCGAGAGC<br>AAGCTTTCGGTGATCCGGAATCTCAACGATCAGGTCCTATTCATCGAT<br>CAGGGAAACAGGCCACTTTTCGAAGACATGACCGACTCCGACTGCAGG<br>GACAACGCCCCCAGGACCATCTTCATCATCTCCATGTATAAGGACTCG<br>CAGCCCAGGGGGATGGCCGTGACCATCTCGGTCAAGTGCGAGAAGATC<br>AGCACCCTCAGCTGTGAGAACAAGATCATCTCCTTTAAGGAGATGAAT<br>CCCCCCGACAACATCAAGGACACAAAGAGCGACATCATCTTCTTCCAA<br>AGGAGCGTGCCCGGTCACGATAATAAGATGCAGTTTGAGTCCAGCAGC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | TATGAGGGCTACTTCCTGGCCTGCGAGAAGGAGAGGGACCTGTTTAAG CTGATCCTCAAAAAGGAGGACGAGCTGGGCGACAGGTCCATCATGTTC ACCGTGCAGAACGAGGAC |
| 764 | IL1ra_IL18 | ATGGAGATCTGCCGGGGCCTCAGGTCCCACCTCATCACCCTCTTACTC TTCCTCTTCCACTCCGAGACAATCTGCTACTTCGGCAAACTCGAGAGC AAGCTCTCCGTCATCAGGAACTTGAACGACCAAGTACTTTTCATCGAC CAGGGGAACAGGCCCCTTTTCGAGGATATGACCGACAGCGACTGCCGG GACAACGCCCCCCGCACCATCTTTATCATCAGCATGTACAAGGACAGC CAGCCCAGGGGCATGGCCGTCACGATCAGCGTCAAGTGCGAGAAAATC AGCACCCTCAGCTGCGAGAATAAGATCATCTCCTTCAAGGAGATGAAC CCCCCGGATAATATCAAGGATACCAAGAGCGACATTATCTTCTTCCAG CGGAGCGTCCCCGGACATGACAACAAAATGCAGTTCGAGTCCAGCTCG TACGAGGGCTACTTCCTCGCGTGCGAGAAGGAGAGGGACCTCTTCAAG CTGATCCTGAAGAAGGAGGACGAGCTGGGAGATAGGAGCATCATGTTC ACAGTGCAGAACGAAGAC |
| 765 | IL1ra_IL18 | ATGGAAATCTGCAGGGGCCTCAGGTCCCACCTCATCACGCTCCTTCTC TTCCTTTTTCATTCCGAAACCATCTGTTACTTCGGAAAGCTCGAGAGC AAGCTTAGCGTCATCAGGAACCTGAACGACCAGGTCCTATTCATAGAC CAGGGGAATAGGCCCCTCTTCGAGGACATGACCGACAGCGACTGCAGG GACAACGCGCCCCGGACCATCTTTATCATCTCAATGTATAAGGACAGC CAGCCCCGCGGCATGGCGGTCACCATCTCCGTCAAGTGCGAGAAGATT AGCACCCTCTCCTGTGAGAACAAGATCATCTCCTTCAAGGAGATGAAC CCGCCCGATAATATTAAGGACACCAAGTCTGACATTATCTTCTTCCAG AGGTCCGTCCCCGGACATGATAATAAGATGCAGTTCGAGAGCAGCAGC TACGAGGGCTACTTCCTGGCCTGCGAGAAGGAGCGGGACCTGTTCAAA CTGATCCTCAAAAAGGAGGATGAACTGGGCGATAGGAGCATCATGTTC ACCGTCCAAAACGAGGAT |
| 766 | IL1ra_IL18 | ATGGAAATCTGCAGAGGGCTCAGGAGCCACCTAATCACCCTTCTTCTC TTCCTCTTCCACTCCGAGACTATCTGCTACTTCGGGAAACTCGAGTCC AAGCTCAGCGTCATCAGGAACCTGAACGACCAGGTCCTATTCATCGAC CAGGGGAACAGGCCCCTCTTCGAGGACATGACCGACAGCGACTGCAGG GACAACGCCCCCAGGACTATCTTCATCATCAGCATGTACAAGGATAGC CAGCCCAGGGGCATGGCCGTCACCATCAGCGTCAAGTGCGAGAAGATC TCCACCCTAAGCTGCGAGAATAAGATTATCTCCTTCAAGGAGATGAAC CCACCCGACAACATCAAAGACACCAAGAGCGACATCATCTTCTTCCAG CGGAGCGTCCCCGGCCACGACAACAAGATGCAATTCGAAAGCTCGAGC TACGAGGGCTACTTCCTGGCCTGCGAGAAGGAGCGGGACTTGTTCAAG CTGATCCTGAAGAAGGAGGACGAGCTGGGCGACAGGTCCATAATGTTT ACTGTCCAGAACGAGGAC |
| 767 | IL1ra_IL18 | ATGGAGATCTGCAGGGGGTTGAGGAGCCACCTCATCACCCTCCTCCTC TTCTTATTCCACTCAGAAACCATCTGCTACTTCGGCAAGCTCGAGTCC AAACTCAGCGTCATCAGGAACCTCAACGACCAGGTTCTCTTCATCGAC CAGGGCAACCGGCCCTTGTTCGAGGACATGACAGACAGCGACTGCCGG GACAACGCCCCCCGCACCATATTCATCATCAGCATGTATAAAGACAGC CAGCCCAGGGGCATGGCCGTGACGATCAGCGTCAAGTGCGAGAAGATC AGCACGCTCAGCTGCGAGAATAAGATCATCTCCTTCAAGGAGATGAAC CCGCCCGACAACATCAAGGACACCAAAAGCGATATAATCTTCTTCCAA AGGTCCGTCCCCGGGCATGATAACAAGATGCAGTTCGAGAGCAGCAGC TACGAGGGCTATTTCCTGGCCTGCGAAAAGGAGAGGGACCTGTTCAAG CTGATCCTGAAGAAGGAGGATGAACTGGGCGACAGGTCCATCATGTTC ACCGTGCAGAACGAGGAC |
| 768 | IL1ra_IL18 | ATGGAGATCTGTAGGGGCCTCCGGAGCCACCTCATCACCCTCCTCCTC TTCCTCTTCCACAGCGAGACGATCTGCTACTTCGGCAAGCTCGAGTCG AAGCTCAGCGTCATCCGGAATCTAAACGACCAGGTCCTCTTCATCGAC CAGGGAAATCGCCCCCTCTTCGAGGACATGACCGATTCCGATTGCAGG GACAACGCCCCCCGCACCATCTTCATCATCTCGATGTACAAGGACAGC CAACCCCGGGGCATGGCCGTCACCATCAGCGTCAAGTGCGAGAAGATC TCCACCCTAAGCTGCGAGAATAAGATCATCAGCTTCAAGGAAATGAAT CCCCCCGACAACATCAAGGACACCAAGAGCGACATCATCTTCTTCCAG AGGAGCGTGCCCGGACACGACAACAAGATGCAGTTCGAGAGCTCGAGC TATGAGGGATACTTCCTGGCCTGCGAGAAGGAGCGGGATCTGTTTAAG CTGATTCTGAAGAAGGAGGACGAGCTGGGGGACAGGTCCATCATGTTC ACGGTCCAGAATGAGGAC |
| 769 | IL1ra_IL18 | ATGGAAATCTGTAGGGGGCTCCGGTCCCACCTCATCACCCTCCTCTTG TTCCTCTTCCACAGCGAAACCATCTGTTACTTCGGCAAGCTCGAGAGC AAGCTCAGCGTCATCAGGAACCTTAACGATCAGGTCCTCTTCATCGAC CAGGGCAACAGGCCCCTGTTCGAGGACATGACCGACAGCGACTGCCGG GACAACGCCCCGAGGACCATCTTTATCATATCCATGTATAAAGATTCC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CAGCCCAGGGGGATGGCCGTCACCATCTCCGTCAAGTGCGAGAAAATC TCCACCCTAAGCTGTGAAAACAAGATCATCAGCTTTAAGGAGATGAAC CCCCCGGACAATATCAAGGACACCAAATCCGACATCATCTTTTTCCAG AGGTCGGTGCCCGGCCACGATAACAAGATGCAGTTCGAGAGCAGCAGC TACGAGGGCTACTTCCTGGCCTGCGAGAAGGAGAGGGACCTGTTCAAG CTGATCCTGAAGAAGGAGGACGAACTGGGCGACCGGAGCATCATGTTC ACCGTGCAGAATGAGGAC |
| 770 | IL1ra_IL18 | ATGGAAATCTGCAGGGGACTCCGCAGCCACCTCATCACCCTCTTGCTG TTCCTTTTTCATAGCGAGACGATCTGCTACTTCGGCAAGCTCGAGAGC AAGCTCTCGGTCATAAGGAACCTCAACGACCAGGTCCTCTTCATAGAC CAGGGGAACCGGCCCCTCTTCGAAGACATGACCGACAGCGACTGCCGG GACAACGCTCCCCGCACCATCTTCATCATCAGCATGTATAAGGACTCC CAACCCAGGGGCATGGCCGTTACCATCTCCGTCAAGTGCGAGAAGATC TCCACGCTCAGCTGCGAGAACAAGATCATCTCCTTCAAGGAAATGAAC CCACCCGACAACATCAAGGACACCAAATCGGATATAATCTTCTTCCAG AGGAGCGTACCCGGCCATGACAACAAGATGCAGTTTGAGAGCAGCAGC TACGAGGGCTACTTTCTGGCCTGCGAGAAGGAGCGGGATCTGTTCAAG CTCATCCTGAAAAAAGAGGATGAGCTGGGCGACAGGAGCATCATGTTC ACCGTGCAGAACGAGGAC |
| 771 | IL1ra_IL18 | ATGGAGATCTGCCGGGGCCTACGCAGCCACCTAATCACCCTCCTTCTC TTCCTCTTCCACAGCGAGACGATCTGCTACTTCGGAAAACTAGAGAGC AAGCTCTCCGTTATCAGGAACCTAAACGATCAGGTCCTCTTCATCGAT CAGGGGAACCGTCCCCTCTTCGAGGATATGACCGACTCCGACTGCAGG GATAACGCCCCGCGGACCATATTCATCATCTCCATGTACAAGGATAGC CAGCCAAGGGGCATGGCCGTCACGATCAGCGTAAAGTGCGAGAAAATC TCCACACTCTCTTGCGAGAACAAGATCATCAGCTTCAAGGAGATGAAC CCCCCGGACAATATCAAGGACACCAAGAGCGACATCATCTTCTTTCAG AGGTCCGTCCCGGGGCATGACAACAAGATGCAGTTCGAATCCTCCAGC TACGAGGGCTACTTCCTCGCCTGCGAGAAGGAGCGGGACCTGTTCAAG CTGATCCTGAAGAAGGAGGACGAGCTGGGCGACCGCAGCATCATGTTC ACCGTGCAGAACGAGGAC |
| 772 | IL1ra_IL18 | ATGGAGATCTGCAGGGGGGTTGAGGAGCCACCTCATCACCCTCCTATTA TTCCTCTTCCACAGCGAGACGATCTGCTACTTCGGTAAGCTCGAGAGC AAGCTCTCCGTAATCAGGAACCTCAACGACCAGGTACTCTTCATCGAC CAGGGCAACCGCCCCCTCTTCGAAGATATGACCGACTCGGACTGTCGA GATAACGCCCCCAGGACCATCTTTATCATCTCGATGTATAAGGACAGC CAGCCCCGGGGCATGGCCGTCACCATAAGCGTCAAGTGCGAGAAGATC AGCACCCTCAGTTGTGAGAATAAGATAATCAGCTTTAAGGAGATGAAC CCGCCCGACAACATCAAGGACACTAAGAGCGACATCATCTTTTTTCAG CGGTCCGTGCCGGGGCATGACAACAAGATGCAGTTCGAGAGCAGCAGC TACGAGGGGTACTTTCTGGCCTGCGAGAAGGAGAGGGACCTGTTCAAG CTGATCCTGAAGAAAGAGGACGAGCTGGGCGATCGGTCCATCATGTTC ACCGTGCAGAACGAGGAT |
| 773 | IL1ra_IL18 | ATGGAGATCTGTAGGGGCCTCCGGAGCCACCTCATCACCCTCCTCCTC TTTCTCTTCCACTCGGAGACGATCTGCTACTTCGGGAAGCTCGAGTCC AAGCTCTCCGTCATCAGGAACCTCAACGACCAGGTTCTCTTCATCGAC CAGGGCAATCGGCCTCTCTTCGAGGACATGACCGATTCAGACTGTAGG GACAACGCCCCGCGCACCATCTTCATCATTAGCATGTACAAGGACAGC CAGCCCAGGGGCATGGCCGTAACCATAAGCGTCAAGTGCGAGAAGATC AGCACCTTGAGCTGCGAAAACAAAATCATCAGCTTCAAGGAGATGAAT CCCCCCGACAATATCAAGGACACCAAGTCCGATATCATCTTCTTCCAG AGGAGCGTGCCCGGCCATGACAACAAGATGCAGTTCGAGAGCTCAAGC TACGAGGGCTACTTCCTGGCCTGTGAGAAGGAGAGGGACCTGTTCAAG CTCATCCTGAAGAAGGAGGATGAGCTGGGCGATAGGAGCATCATGTTC ACCGTCCAAAACGAGGAC |
| 774 | IL1ra_IL18 | ATGGAGATCTGCAGGGGACTCAGGTCCCACCTCATCACCCTCCTCCTC TTCCTCTTCCACAGCGAGACGATCTGTTACTTCGGTAAGCTTGAGTCC AAGCTCAGCGTCATAAGGAACCTCAACGATCAGGTCCTTTTCATAGAC CAGGGCAACAGGCCCCCTTTTCGAGGACATGACCGACAGCGACTGTCGG GACAACGCCCCTAGGACGATCTTCATCATCAGCATGTACAAGGACAGC CAGCCCCGCGGCATGGCGGTAACCATCAGCGTAAAGTGCGAGAAGATC TCCACCCTCAGCTGTGAGAACAAGATCATCTCCTTCAAGGAAATGAAC CCCCCAGACAACATCAAGGATACAAAGAGCGATATCATCTTCTTTCAG CGCAGCGTGCCTGGCCATGATAACAAGATGCAGTTCGAGAGCTCAAGC TACGAGGGCTACTTCCTGGCCTGCGAGAAGGAGAGGGACCTGTTCAAG CTGATCCTGAAGAAAGAGGATGAGCTGGGGGACCGGTCCATCATGTTC ACGGTGCAGAATGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 775 | IL1ra_IL18 | ATGGAGATCTGCAGGGGGTTAAGGAGCCACTTAATCACCTTGTTGCTG<br>TTCCTCTTCCACTCCGAGACTATCTGCTATTTCGGCAAGCTTGAGTCG<br>AAGCTATCGGTCATCCGCAACCTCAACGATCAGGTCCTCTTCATAGAT<br>CAGGGCAACAGGCCCCTTTTCGAGGACATGACCGACAGCGACTGCAGG<br>GATAACGCCCCCAGGACGATCTTCATCATCTCGATGTACAAAGACAGC<br>CAGCCCAGGGGCATGGCCGTTACCATCAGCGTCAAGTGCGAGAAGATC<br>AGCACCCTCAGCTGCGAGAACAAGATCATCTCCTTCAAGGAGATGAAC<br>CCGCCCGACAACATCAAGGACACCAAAAGCGATATCATCTTCTTCCAA<br>CGGTCCGTCCCCGGCCACGATAACAAGATGCAGTTCGAAAGCAGCAGC<br>TACGAGGGCTACTTCCTGGCCTGCGAAAAGGAGAGGGACCTGTTTAAG<br>CTGATACTGAAGAAGGAAGACGAGCTGGGCGACCGCTCGATCATGTTC<br>ACGGTGCAGAACGAGGAC |
| 776 | IL1ra_IL18 | ATGGAGATCTGCAGGGGCCTCCGCAGCCACCTCATCACCCTCCTCCTC<br>TTTCTCTTCCACAGCGAGACGATCTGCTATTTCGGCAAGCTCGAGTCT<br>AAACTCAGCGTCATCCGGAATCTCAACGACCAGGTCCTATTCATCGAC<br>CAGGGCAACCGACCGCTGTTCGAAGACATGACAGACAGCGACTGCAGG<br>GATAACGCCCCCCGCACCATCTTCATAATCAGCATGTACAAGGACTCC<br>CAGCCCAGGGGCATGGCCGTCACGATCAGCGTAAAGTGCGAGAAGATC<br>TCCACCCTCAGCTGCGAGAACAAGATCATCTCCTTCAAGGAGATGAAT<br>CCCCCCGATAACATCAAGGACACCAAGAGCGACATCATATTCTTCCAG<br>CGGTCGGTGCCGGGCCACGACAATAAAATGCAGTTCGAAAGCAGCTCC<br>TACGAGGGCTACTTCCTCGCCTGCGAGAAAGAGCGGGACCTGTTCAAG<br>CTGATCCTGAAGAAAGAGGACGAGCTGGGCGACAGGAGCATCATGTTC<br>ACCGTGCAGAACGAGGAC |
| 777 | IL1ra_IL18 | ATGGAGATCTGCAGGGGGCTAAGGTCCCACCTCATCACGCTCCTCCTC<br>TTCTTGTTCCACAGCGAGACGATCTGCTACTTCGGAAAGCTCGAGAGC<br>AAGTTGAGCGTCATCAGGAACCTCAACGACCAGGTCCTTTTCATCGAT<br>CAGGGCAACAGGCCGCTGTTCGAAGACATGACGGATAGCGATTGCAGG<br>GACAACGCCCCCCGAACCATCTTCATCATCTCCATGTACAAGGACAGC<br>CAGCCGAGGGGCATGGCCGTCACCATCAGCGTCAAGTGCGAGAAGATC<br>AGCACCCTCAGCTGCGAGAATAAGATCATCAGCTTCAAGGAGATGAAC<br>CCACCCGACAACATCAAGGACACTAAAAGCGACATCATCTTCTTCCAG<br>AGGAGCGTCCCGGGTCACGACAACAAGATGCAGTTCGAGAGCAGCTCC<br>TACGAGGGCTACTTTCTCGCCTGCGAGAAGGAGAGGGACCTGTTTAAG<br>CTCATCCTGAAGAAGGAAGACGAGCTCGGCGATAGGTCGATCATGTTC<br>ACCGTGCAGAACGAGGAC |
| 778 | IL1ra_IL18 | ATGGAGATCTGTAGGGGCCTTCGGAGCCACCTCATCACCCTTCTCCTC<br>TTCCTCTTCCACAGCGAGACGATCTGCTACTTCGGCAAGCTCGAGAGC<br>AAGCTTTCCGTAATACGGAACCTTAACGACCAGGTCCTCTTTATCGAC<br>CAGGGCAACAGGCCCCTCTTCGAAGACATGACCGACTCCGACTGTAGG<br>GACAACGCGCCGCGGACTATATTCATCATCAGCATGTACAAGGACAGC<br>CAGCCCCGGGGCATGGCCGTCACAATTTCCGTCAAGTGCGAGAAGATC<br>AGCACCCTCTCCTGTGAAAATAAGATCATCAGCTTCAAGGAGATGAAC<br>CCACCCGACAACATCAAGGACACGAAGTCCGACATCATCTTCTTCCAG<br>AGGTCCGTGCCCGGCCACGACAACAAGATGCAGTTCGAGAGCAGCAGC<br>TACGAGGGGTACTTCCTGGCCTGCGAGAAGGAGAGGGACCTCTTCAAG<br>CTGATCCTGAAGAAGGAGGACGAGCTGGGGGACAGGTCGATCATGTTT<br>ACCGTGCAGAACGAGGAC |
| 779 | IL1ra_IL18 | ATGGAGATCTGCAGGGGCCTCCGGTCCCATCTCATCACCCTCCTCCTC<br>TTCCTCTTCCACTCCGAGACAATCTGCTACTTCGGGAAACTCGAGAGC<br>AAGCTCTCCGTAATCCGTAATCTAAACGACCAGGTCCTCTTCATCGAC<br>CAGGGTAACAGGCCACTCTTCGAGGATATGACCGACAGCGATTGCCGG<br>GATAACGCCCCTCGCACCATCTTCATCATAAGCATGTACAAGGACAGC<br>CAGCCCAGGGGCATGGCCGTCACCATCTCGGTCAAGTGCGAGAAGATA<br>AGCACGCTCTCCTGCGAGAACAAGATTATCTCCTTCAAGGAAATGAAC<br>CCGCCCGATAACATCAAGGACACCAAGTCCGACATCATCTTTTTCCAG<br>CGGAGCGTGCCCGGGCATGATAACAAAATGCAGTTCGAGAGCTCCAGC<br>TATGAGGGGTACTTCCTGGCTTGCGAGAAGGAGCGGGACCTGTTCAAG<br>CTGATTCTGAAGAAGGAGGACGAGCTGGGTGACAGGAGCATAATGTTC<br>ACCGTGCAGAACGAGGAC |
| 780 | IL1ra_IL18 | ATGGAGATCTGCAGGGGCCTCCGCAGCCACCTCATCACCCTCCTCCTC<br>TTCCTCTTCCACTCGGAGACGATCTGCTACTTCGGGAAGCTCGAGTCC<br>AAGCTCAGCGTAATTAGGAACCTCAACGACCAGGTTCTCTTCATCGAT<br>CAGGGCAACCGTCCCTTGTTCGAGGACATGACCGACTCGGACTGCAGG<br>GATAACGCCCCCCGGACCATCTTCATAATCTCCATGTACAAGGATAGC<br>CAGCCCCGCGGCATGGCCGTCACCATAAGCGTCAAGTGCGAGAAGATC<br>TCCACCCTTAGCTGCGAGAACAAGATAATAAGCTTTAAGGAGATGAAC<br>CCGCCCGACAACATCAAGGACACGAAATCTGACATCATCTTCTTCCAG<br>CGCTCCGTGCCCGGCCACGACAACAAGATGCAGTTCGAGTCCTCCTCC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | TACGAGGGCTATTTTCTGGCCTGTGAGAAGGAGAGGGACCTGTTCAAA CTGATCCTGAAGAAGGAGGACGAGCTGGGGGACAGGTCCATCATGTTC ACCGTGCAGAACGAGGAC |
| 781 | IL1ra_IL18 | ATGGAGATCTGCAGGGGACTTAGGTCCCACCTTATCACACTCTTACTC TTCCTCTTCCACTCCGAGACGATCTGCTACTTCGGGAAACTCGAGAGC AAGCTCAGCGTCATCAGGAACCTCAACGACCAGGTCCTCTTCATCGAC CAGGGCAACAGGCCCCTCTTCGAGGACATGACCGACAGCGACTGCCGG GACAACGCCCCCAGGACCATCTTCATCATCTCCATGTATAAGGACAGC CAACCCCGCGGGATGGCGGTAACCATCAGCGTCAAGTGCGAGAAGATC AGCACTTTGAGCTGCGAGAACAAGATCATCTCCTTCAAGGAGATGAAC CCGCCCGACAACATCAAGGACACCAAGTCCGATATTATCTTCTTTCAG AGGAGCGTGCCCGGCCACGACAACAAGATGCAGTTTGAGTCTAGCTCC TACGAGGGCTACTTCCTGGCTTGCGAGAAAGAGAGGGATCTGTTTAAG CTGATCCTGAAGAAGGAGGATGAGCTGGGTGACCGCAGCATAATGTTT ACCGTGCAGAACGAGGAT |
| 782 | IL1ra_IL18 | ATGGAAATCTGTAGGGGGCTCAGGAGCCACCTCATCACCCTCCTACTC TTCCTCTTCCACTCGGAAACCATTTGCTATTTCGGCAAGCTCGAAAGC AAGCTCAGCGTCATCCGGAACCTCAACGACCAGGTTCTCTTCATCGAC CAGGGCAACCGGCCCCTCTTCGAGGACATGACCGACAGCGACTGCAGG GACAACGCCCCCCGGACGATCTTTATCATCAGCATGTATAAGGACAGC CAGCCCAGGGGCATGGCCGTCACCATCTCCGTTAAGTGCGAAAAGATA TCCACCCTCAGTTGTGAGAACAAGATCATCAGCTTCAAGGAGATGAAC CCACCCGACAACATCAAGGACACCAAGAGCGACATCATCTTCTTCCAA AGGAGCGTACCCGGCCACGATAACAAGATGCAGTTCGAGTCCTCCAGC TACGAGGGATACTTCCTGGCCTGCGAGAAGGAGAGGGATCTGTTCAAG CTCATCCTGAAGAAGGAGGATGAGCTGGGGGATAGGAGCATAATGTTC ACCGTCCAGAACGAAGAC |
| 783 | IL1ra_IL18_SN | ATGGAGATCTGCCGAGGCCTCCGCTCCCACTTGATTACCCTCCTCCTC TTCCTCTTCCACAGCGAGACGATCTGCTACTTCGGCAAGTTGGAGAGC AAGCTCTCGGTTATCAGGAACCTCAACGACCAGGTCCTCTTCATCGAC CAGGGGAATCGCCCGCTGTTCGAGGACATGACCAGCTCCGACTGTCGG AACAACGCGCCCCGGACCATCTTCATTATCTCCATGTACAAGGACTCC CAACCCAGGGGCATGGCCGTCACCATCTCGGTCAAGTGCGAGAAAATC AGCACCCTCAGCTGCGAGAACAAGATCATCTCCTTCAAGGAGATGAAT CCCCCCGACAACATCAAGGACACCAAGAGCGACATCATCTTCTTCCAG CGCAGCGTCCCCGGGCACGACAACAAGATGCAGTTCGAGAGCAGCAGC TACGAGGGGTACTTCCTCGCCTGCGAGAAGGAGAGGGACCTGTTCAAG CTCATCCTGAAGAAAGAGGACGAGCTGGGGGACCGGAGCATCATGTTC ACCGTGCAAAATGAGGAC |
| 784 | IL1ra_IL18_SN | ATGGAGATCTGCAGGGGGGTTGAGGAGCCACCTCATCACGCTCCTTTTG TTCCTCTTCCACAGCGAGACGATCTGCTACTTCGGGAAGCTTGAGTCC AAGCTCTCCGTCATCCGGAACCTCAACGACCAGGTCCTCTTCATCGAT CAGGGGAACCGGCCGCTTTTCGAAGATATGACGTCCAGCGACTGTAGG AACAACGCCCCCCGCACCATCTTCATCATCTCCATGTACAAGGACTCC CAACCCAGGGGCATGGCCGTCACCATCAGCGTTAAGTGCGAGAAGATC AGCACGCTAAGCTGCGAGAACAAGATCATCAGCTTCAAGGAGATGAAC CCGCCCGACAACATTAAGGACACCAAAAGCGACATCATTTTCTTCCAA AGGAGCGTGCCCGGCCACGACAATAAGATGCAGTTCGAAAGCAGCTCC TACGAGGGCTACTTCCTCGCCTGCGAGAAGGAGCGGGACCTGTTCAAG CTGATCCTGAAAAAGGAGGACGAGCTGGGGGACAGGAGCATCATGTTC ACCGTGCAGAACGAGGAC |
| 785 | IL1ra_IL18_SN | ATGGAGATCTGCCGGGGCTTGAGGAGCCACCTAATCACGCTCCTCCTC TTCTTATTCCACAGCGAGACGATCTGCTACTTCGGCAAGCTTGAGTCC AAGCTCAGCGTTATCCGGAACCTAAACGACCAAGTCCTCTTCATCGAC CAGGGCAACCGGCCGCTGTTCGAGGACATGACCTCCAGCGACTGCAGG AATAACGCCCCCAGGACCATCTTCATCATCAGCATGTACAAAGACAGC CAGCCCCGGGGCATGGCCGTCACGATCTCCGTAAAGTGTGAGAAGATC TCCACCCTCTCCTGCGAGAACAAGATCATAAGCTTCAAGGAGATGAAC CCGCCCGACAACATCAAGGACACCAAGAGCGACATCATTTTCTTCCAA CGGAGCGTGCCCGGCCATGACAACAAGATGCAGTTTGAGTCCAGCTCC TACGAGGGCTACTTCCTGGCCTGCGAAAAGGAGCGGGACCTGTTCAAG CTGATCCTGAAGAAGGAAGACGAGCTGGGGGACAGGTCCATCATGTTC ACCGTGCAGAATGAGGAC |
| 786 | IL1ra_IL18_SN | ATGGAGATCTGCCGCGGGCTCCGGTCCCATCTCATCACGCTCCTCCTC TTCCTCTTCCACAGCGAGACTATCTGTTACTTCGGGAAGCTTGAGTCC AAGCTCAGCGTCATCCGGAACCTCAACGACCAGGTCCTCTTCATCGAT CAGGGGAACCGGCCCCTCTTCGAAGACATGACCTCGTCCGACTGCCGG AACAACGCACCCAGGACCATATTCATCATCTCCATGTACAAGGACTCC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CAGCCCAGGGGCATGGCCGTTACCATCAGCGTAAAGTGCGAGAAGATC AGCACCCTCAGCTGCGAGAATAAGATCATCTCCTTCAAGGAGATGAAC CCCCCGGACAACATCAAGGACACCAAGTCCGACATCATCTTCTTTCAG CGCAGCGTCCCCGGGCACGATAACAAGATGCAGTTCGAGTCCAGCAGC TACGAGGGGTACTTCCTGGCCTGCGAAAAGGAGCGCGACCTGTTCAAG CTGATCCTGAAGAAGGAGGACGAGCTCGGCGATAGATCCATCATGTTC ACGGTGCAGAACGAGGAC |
| 787 | IL1ra_IL18_SN | ATGGAGATCTGTAGGGGGCTCAGGTCCCACCTTATCACGCTCCTCCTC TTTCTTTTCCACAGCGAGACGATCTGCTACTTCGGCAAGCTTGAGAGC AAACTCTCGGTCATCAGGAACCTCAACGACCAGGTCCTCTTCATCGAT CAGGGGAACAGGCCCTTGTTCGAGGACATGACCTCCAGCGACTGCAGG AACAACGCCCCCCGGACCATCTTCATCATCTCCATGTACAAGGATAGC CAGCCGCGGGGGATGGCCGTCACCATCTCGGTCAAGTGCGAGAAGATC AGCACCCTTTCCTGCGAGAACAAGATCATCAGCTTCAAGGAGATGAAC CCACCCGACAATATCAAAGACACGAAAAGCGATATCATCTTCTTCCAG AGGAGCGTGCCGGGCCATGACAACAAGATGCAGTTCGAGAGCAGCAGC TACGAGGGCTATTTTCTGGCCTGCGAGAAGGAGAGGGACCTGTTCAAG CTGATCCTGAAGAAAGAGGACGAGCTGGGGGACAGGAGCATCATGTTC ACCGTGCAGAACGAGGAC |
| 788 | IL1ra_IL18_SN | ATGGAGATCTGCAGGGGCCTCAGGAGCCACCTCATCACCCTCCTCCTC TTCCTCTTCCATAGCGAGACAATCTGCTACTTCGGGAAGCTTGAGTCC AAGCTCAGCGTCATCAGGAATCTCAACGATCAGGTCCTCTTCATCGAC CAAGGGAACCGGCCCCTCTTCGAGGACATGACCTCCAGCGATTGCAGG AACAACGCTCCCAGGACCATATTCATCATCTCCATGTACAAGGACTCC CAGCCCAGGGGCATGGCCGTCACCATCTCGGTCAAGTGCGAGAAGATC AGCACGCTCAGCTGCGAGAACAAAATCATCTCCTTCAAGGAGATGAAC CCACCCGACAACATCAAAGACACCAAGAGCGACATCATCTTCTTCCAG AGGAGCGTGCCGGGCCACGACAACAAAATGCAGTTTGAGTCGTCCAGC TACGAGGGCTACTTCCTGGCCTGCGAGAAGGAGCGGGACCTATTCAAG CTCATCCTGAAGAAGGAGGACGAGCTGGGGGATAGGAGCATCATGTTC ACGGTGCAGAACGAGGAC |
| 789 | IL1ra_IL18_SN | ATGGAGATCTGCAGGGGGCTCAGGAGCCACCTCATCACGCTCCTACTC TTCCTATTCCATAGCGAAACCATCTGTTACTTCGGCAAGCTTGAGAGC AAGCTTAGCGTCATCCGGAACCTTAACGACCAGGTCCTCTTTATCGAC CAGGGCAACCGACCCCTCTTCGAGGATATGACGTCCAGCGACTGCCGG AACAACGCCCCCCGGACCATATTCATCATCAGCATGTACAAAGATAGC CAGCCCAGGGGGATGGCCGTAACCATCAGCGTCAAGTGCGAGAAGATC TCCACCTTGTCGTGCGAGAATAAGATCATCTCCTTCAAGGAGATGAAC CCGCCCGATAACATCAAGGACACCAAGAGCGATATCATCTTCTTCCAG AGGAGTGTGCCCGGCCACGACAACAAGATGCAGTTCGAGAGCAGCTCC TACGAGGGCTACTTCCTGGCCTGTGAAAAGGAGAGGGATCTGTTCAAA CTGATTCTCAAGAAGGAGGACGAGCTGGGGGACCGGAGCATCATGTTC ACCGTGCAGAACGAGGAC |
| 790 | IL1ra_IL18_SN | ATGGAGATCTGTAGGGGGCTCAGGAGCCACCTCATCACCCTACTCCTC TTCCTCTTCCATAGCGAAACCATCTGCTACTTCGGCAAGCTAGAGAGC AAGTTGAGCGTAATCCGGAACCTCAACGATCAAGTCCTCTTTATCGAT CAGGGGAACCGGCCCCTCTTCGAGGACATGACCAGCAGCGACTGCAGG AACAACGCCCCCAGGACCATCTTCATCATCTCCATGTACAAGGACAGC CAGCCGCGCGGCATGGCCGTCACAATCTCCGTAAAGTGCGAGAAGATT AGCACGCTAAGCTGCGAGAACAAGATCATCAGCTTCAAGGAGATGAAC CCGCCCGACAACATTAAGGACACCAAGTCCGATATCATCTTCTTCCAG AGGAGCGTCCCTGGGCACGACAACAAGATGCAGTTTGAAAGTAGCAGC TACGAGGGGTATTTCCTCGCGTGCGAGAAGGAGAGGGATCTGTTCAAG CTGATTCTGAAAAAGGAAGACGAGCTCGGCGACAGGAGCATCATGTTC ACCGTGCAGAACGAAGAC |
| 791 | IL1ra_IL18_SN | ATGGAGATCTGCAGGGGCCTCAGGAGCCACCTCATAACGCTCCTCCTC TTCTTATTCCACAGCGAGACGATCTGCTACTTCGGAAAACTCGAGAGC AAGCTCAGCGTCATCAGGAACCTCAACGACCAGGTCCTCTTCATCGAC CAGGGCAACAGGCCGCTGTTCGAGGACATGACCAGCAGCGACTGCCGC AACAACGCCCCCAGGACGATCTTCATCATCAGCATGTATAAAGACAGC CAGCCGAGGGGCATGGCAGTAACCATCTCCGTAAAGTGCGAAAAGATC AGCACACTCTCGTGCGAGAACAAGATCATCTCGTTCAAGGAGATGAAC CCGCCCGACAACATCAAAGACACCAAGAGCGACATCATCTTTTTCCAG CGGAGCGTACCTGGCCACGACAACAAAATGCAGTTCGAATCCAGCAGC TACGAGGGCTATTTCCTGGCGTGCGAGAAGGAGCGCGACCTGTTCAAG CTCATCCTGAAGAAGGAGGATGAGCTGGGGGACCGGTCGATCATGTTC ACCGTGCAGAACGAGGAC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| 792 | IL1ra_IL18_SN | ATGGAGATCTGCAGGGGGCTCAGGTCCCACCTCATCACCCTCCTCCTATTTCTCTTCCACTCCGAGACTATCTGCTACTTCGGGAAGCTCGAGAGCAAGCTCAGCGTCATCCGGAACTTGAACGACCAGGTACTCTTTATCGACCAGGGCAATCGGCCGCTGTTCGAGGACATGACCAGCAGCGACTGCCGCAATAACGCCCCCAGGACCATCTTCATCATCAGCATGTATAAGGACAGCCAGCCCAGGGGCATGGCCGTAACCATCAGCGTAAAGTGCGAGAAAATCAGCACCCTTAGCTGCGAGAATAAGATAATAAGCTTCAAGGAGATGAACCCACCCGACAATATCAAGGACACCAAGAGCGACATCATCTTCTTCCAGAGGAGCGTGCCCGGACATGATAATAAAATGCAGTTCGAGAGCAGCTCCTATGAGGGCTACTTCCTCGCCTGCGAGAAGGAGAGGGACCTGTTCAAGCTCATCCTGAAGAAGGAGGATGAGCTGGGGGACAGGTCCATCATGTTCACGGTGCAGAACGAGGAC |
| 793 | IL1ra_IL18_SN | ATGGAGATCTGCCGGGGCCTCAGGTCCCACCTCATCACCTTGCTCCTCTTTTTGTTCCACAGCGAGACGATCTGCTATTTCGGCAAACTCGAGTCGAAGCTCAGCGTCATCAGGAACCTCAACGATCAGGTCCTCTTTATCGACCAGGGCAACAGGCCCCTCTTCGAGGACATGACCTCCAGCGACTGTCGGAACAACGCCCCCAGGACGATCTTCATCATCAGCATGTACAAGGATTCCCAGCCCAGGGGGATGGCCGTTACCATCTCCGTAAAGTGCGAAAAGATTTCCACCCTCTCCTGTGAGAATAAGATCATCAGCTTCAAGGAGATGAATCCCCCGGACAACATCAAGGACACCAAGAGCGACATCATCTTCTTCCAGAGGAGCGTGCCCGGCCACGACAACAAGATGCAGTTCGAATCCTCCTCCTATGAGGGCTACTTCCTCGCCTGCGAGAAGGAAAGGGACCTGTTCAAGCTGATCCTGAAGAAGGAGGACGAGCTGGGGGACCGGTCCATCATGTTTACCGTACAGAACGAGGAT |
| 794 | IL1ra_IL18_SN | ATGGAGATCTGCAGGGGCTTGAGGAGCCATCTCATCACCCTCCTCCTCTTCCTCTTTCACAGCGAGACGATCTGCTACTTCGGCAAGCTCGAGTCCAAGCTCAGCGTCATCCGGAATCTCAACGACCAGGTACTTTTCATCGACCAGGGCAACCGGCCGCTGTTCGAGGACATGACCTCGAGCGACTGCCGGAACAACGCCCCCAGGACCATCTTCATCATCTCCATGTACAAGGACAGCCAGCCGCGGGGGATGGCCGTCACCATCAGCGTCAAGTGCGAGAAGATCTCCACCCTCAGCTGCGAAAATAAAATCATCTCCTTCAAGGAGATGAACCCGCCCGACAACATCAAAGACACCAAGAGCGACATCATATTTTTCCAGAGGAGCGTGCCCGGCCACGATAACAAGATGCAGTTCGAGTCATCGAGCTACGAGGGGTATTTCCTCGCCTGCGAAAAGGAACGGGACCTCTTCAAGCTGATCCTCAAGAAGGAGGATGAACTTGGAGATCGGAGCATCATGTTCACCGTGCAGAACGAGGAC |
| 795 | IL1ra_IL18_SN | ATGGAAATCTGCAGGGGGCTCAGGTCCCACCTCATTACCCTCCTCCTCTTCCTCTTTCACAGCGAGACTATCTGCTACTTCGGCAAGTTGGAGTCCAAGCTCTCGGTCATCCGGAATCTCAACGACCAGGTACTCTTCATCGACCAGGGCAACCGGCCGCTGTTCGAAGACATGACCAGCTCCGACTGCCGAAACAACGCCCCCAGGACCATCTTCATCATCTCCATGTATAAGGACTCCCAGCCCCGCGGCATGGCCGTAACCATCAGCGTCAAGTGCGAGAAGATCTCCACGTTGAGCTGTGAAAACAAGATTATATCCTTCAAGGAGATGAACCCTCCCGACAACATTAAGGACACCAAATCGGACATCATCTTCTTTCAGAGGAGCGTGCCCGGCCACGACAACAAGATGCAGTTCGAGAGCTCCAGTTATGAGGGGTACTTCCTGGCCTGCGAGAAGGAGAGGGACCTGTTCAAGCTGATCCTGAAAAAGGAGGACGAGCTGGGGGACCGGTCCATCATGTTCACCGTGCAGAACGAGGAC |
| 796 | IL1ra_IL18_SN | ATGGAGATCTGCCGGGGATTACGCAGCCACCTTATCACCCTCTTGCTCTTTCTCTTTCACAGCGAGACAATCTGCTACTTCGGCAAGCTCGAGAGCAAGTTGTCCGTCATCAGGAACCTCAACGATCAGGTCCTCTTTATCGACCAGGGCAACAGGCCCCTCTTCGAGGACATGACCAGCAGCGACTGCAGGAACAACGCCCCGCGGACCATCTTCATCATTTCCATGTACAAGGACAGCCAGCCGAGGGGTATGGCCGTCACTATCTCCGTAAAGTGCGAGAAGATCAGCACGTTGTCCTGCGAAAACAAAATCATCTCCTTCAAGGAGATGAACCCCCCGGACAATATAAAGGACACCAAAAGCGACATCATCTTCTTCCAGAGGAGCGTGCCCGGCCACGATAATAAAATGCAGTTCGAGAGCTCCTCCTACGAGGGGTACTTTCTCGCCTGCGAGAAGGAGAGGGACCTGTTCAAACTCATCCTCAAGAAGGAGGACGAGCTGGGCGACCGGTCCATCATGTTCACGGTGCAGAACGAGGAC |
| 797 | IL1ra_IL18_SN | ATGGAAATCTGCCGGGGGCTACGGAGCCATCTCATAACCCTCCTCCTCTTCCTCTTCCACAGCGAGACAATCTGTTACTTCGGCAAGCTCGAGTCCAAGCTCAGCGTCATCCGGAACCTCAACGACCAAGTCCTCTTCATAGATCAGGGCAACAGGCCGCTGTTCGAGGACATGACCTCCTCCGACTGCCGCAACAACGCCCCCAGGACCATCTTCATCATCAGCATGTACAAGGACAGCCAGCCCAGGGGCATGGCCGTCACCATCTCGGTCAAGTGCGAGAAAATCTCGACGCTCAGCTGCGAGAACAAGATCATCAGCTTCAAGGAGATGAACCCGCCCGACAACATCAAGGATACCAAGAGCGACATCATCTTCTTCCAGAGGAGCGTGCCCGGCCACGACAACAAGATGCAGTTCGAGTCCTCCAGC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | TACGAGGGGTACTTCCTCGCCTGTGAGAAGGAGAGGGACCTCTTCAAG CTGATACTCAAGAAAGAGGACGAGCTGGGGGACCGAAGCATAATGTTC ACGGTGCAGAACGAGGAT |
| 798 | IL1ra_IL18_SN | ATGGAGATCTGCAGGGGCCTCCGGAGCCACCTCATCACACTACTCCTC TTCCTCTTCCATAGCGAAACCATCTGCTACTTCGGCAAGCTCGAGAGC AAGCTCAGCGTCATCCGGAACCTCAACGACCAGGTCCTCTTTATCGAC CAGGGCAACCGGCCGTTGTTCGAGGACATGACCAGCTCCGACTGCCGG AACAACGCCCCGCGGACGATCTTCATCATTAGCATGTACAAGGACAGT CAACCTAGGGGCATGGCCGTCACGATTAGCGTCAAGTGCGAAAAGATC AGCACTCTCAGCTGCGAGAACAAAATCATCTCCTTCAAGGAGATGAAC CCGCCCGACAACATCAAGGACACCAAGAGCGACATCATCTTCTTCCAG CGGAGTGTGCCCGGCCACGATAACAAAATGCAGTTCGAAAGCTCCTCC TACGAGGGCTACTTCCTGGCCTGTGAGAAGGAGCGGGATCTGTTCAAG CTCATCCTGAAGAAGGAGGATGAGCTGGGCGACAGGAGCATCATGTTC ACCGTGCAGAATGAGGAC |
| 799 | IL1ra_IL18_SN | ATGGAGATCTGTAGGGGCCTCCGATCCCACCTCATCACCTTGCTACTC TTCCTCTTCCACAGCGAGACGATCTGCTATTTCGGCAAGCTCGAGAGC AAGTTGAGCGTCATCCGGAATCTCAACGACCAGGTCTTGTTCATCGAT CAGGGGAACAGGCCCCTCTTCGAGGACATGACCTCCAGCGACTGCCGG AACAACGCCCCCCGGACCATATTCATCATATCCATGTACAAGGACTCC CAGCCCAGAGGCATGGCCGTCACCATTAGCGTGAAGTGCGAGAAGATC AGCACCCTCAGCTGCGAGAACAAGATCATCTCTTTCAAGGAGATGAAC CCGCCCGACAATATCAAGGATACTAAGTCCGACATCATCTTCTTCCAG AGGAGCGTGCCCGGCCACGACAACAAAATGCAGTTCGAGAGCTCAAGC TACGAGGGCTACTTCCTGGCGTGCGAGAAGGAGCGGGACCTGTTCAAG CTGATCCTGAAGAAAGAGGATGAGCTGGGGGACAGGAGCATCATGTTC ACCGTGCAGAACGAGGAC |
| 800 | IL1ra_IL18_SN | ATGGAGATCTGTAGGGGCCTCCGGTCCCACCTCATCACCCTCCTCCTT TTCCTCTTCCACTCCGAGACGATCTGCTATTTCGGCAAGCTCGAGAGC AAGCTCAGCGTAATACGCAACCTCAACGACCAGGTCCTCTTTATAGAT CAGGGGAACCGTCCCCTCTTCGAGGACATGACCAGCAGCGATTGTAGG AACAACGCCCCCCGGACCATCTTCATCATATCCATGTACAAGGACAGC CAACCGCGGGGCATGGCCGTCACCATCAGCGTTAAGTGCGAGAAAATC AGCACCCTTAGCTGTGAAAACAAGATCATCTCCTTCAAGGAGATGAAC CCTCCCGACAACATCAAGGACACCAAGTCCGACATCATATTCTTTCAG AGGAGCGTGCCCGGCCATGATAACAAGATGCAGTTCGAGAGCTCCTCG TACGAAGGTTACTTCCTGGCCTGCGAGAAGGAGAGGGACCTGTTTAAG CTCATCCTGAAGAAAGAGGACGAGCTGGGCGACAGGAGCATCATGTTC ACCGTGCAGAACGAGGAC |
| 801 | IL1ra_IL18_SN | ATGGAAATCTGCAGGGGGCTCAGGTCCCACCTAATAACCCTCCTTCTC TTCCTCTTCCACTCGGAGACTATCTGCTACTTCGGCAAGCTCGAGTCG AAGCTCAGCGTTATCAGGAACCTCAACGACCAGGTCTTGTTCATCGAT CAGGGCAATCGGCCCCTCTTCGAGGACATGACCAGCAGCGACTGCAGG AACAACGCCCCGAGGACTATCTTCATAATCAGCATGTACAAGGATAGC CAGCCTAGGGGCATGGCCGTCACCATAAGCGTAAAGTGCGAAAAGATC AGCACCCTTAGCTGCGAAAACAAGATCATCAGCTTCAAGGAGATGAAC CCGCCCGACAACATAAAGGACACCAAATCCGACATCATCTTCTTCCAG AGGAGCGTGCCTGGCCACGACAACAAAATGCAGTTCGAGAGCTCCAGC TACGAGGGCTATTTCCTGGCATGTGAGAAGGAGAGGGACCTCTTTAAG CTCATCCTGAAGAAGGAGGATGAGCTCGGGGACAGGAGCATCATGTTC ACCGTGCAAAACGAGGAT |
| 802 | IL1ra_IL18_SN | ATGGAGATCTGCCGGGGCCTCAGGAGCCACCTCATCACGCTCCTCTTG TTCCTCTTCCATAGCGAGACAATCTGCTATTTCGGCAAGCTCGAATCC AAACTCAGCGTAATCCGGAACCTTAACGACCAGGTCCTCTTTATCGAC CAGGGGAACCGGCCGCTTTTCGAGGACATGACGTCCAGCGACTGCCGA AACAACGCCCCCAGGACCATCTTTATCATCAGCATGTACAAGGACAGC CAGCCCCGGGGCATGGCCGTCACGATCTCCGTCAAGTGCGAGAAGATC AGCACCCTTAGCTGTGAGAACAAGATCATCAGCTTCAAGGAGATGAAC CCGCCCGACAACATAAAGGACACCAAGAGCGACATCATCTTCTTCCAG CGGTCTGTGCCCGGCCACGACAACAAGATGCAGTTCGAGAGCTCCAGC TACGAGGGCTACTTCCTGGCCTGTGAAAAGGAGAGGGACCTGTTCAAG CTGATCCTCAAGAAGGAGGACGAGCTCGGAGACAGGAGCATCATGTTC ACGGTGCAGAATGAGGAT |
| 803 | IL1ra_IL18_SN | ATGGAGATCTGCAGGGGCCTCAGGTCCCACCTTATCACCCTACTTCTC TTTCTCTTTCACAGCGAAACTATCTGTTACTTCGGCAAGCTCGAGAGC AAGCTCTCCGTCATCAGGAACCTCAACGACCAGGTCCTCTTCATCGAT CAGGGCAACAGGCCCCTATTCGAGGACATGACGAGCAGCGACTGCCGA AATAACGCCCCCAGGACGATCTTCATCATCTCCATGTACAAGGACTCC |

TABLE 8-continued

Sequence of fusions constructs encoding IL18 (SEQ ID NOS: 579-582) and their corresponding optimized ORFs (SEQ ID NO: 583-807)

| SEQ ID NO | Name | Sequence |
|---|---|---|
| | | CAACCCCGCGGCATGGCCGTCACCATCTCGGTTAAGTGCGAGAAGATC<br>AGCACCCTCAGCTGCGAGAACAAGATCATCAGCTTCAAAGAGATGAAT<br>CCCCCAGACAACATCAAGGACACCAAGTCCGACATCATCTTCTTTCAG<br>AGGTCCGTCCCCGGACACGATAACAAAATGCAGTTCGAGTCCAGCAGC<br>TACGAGGGCTACTTCCTCGCCTGCGAGAAGGAGCGGGATCTCTTCAAG<br>CTGATCCTGAAGAAAGAGGACGAGCTCGGCGACCGCTCCATCATGTTC<br>ACGGTGCAGAACGAGGAC |
| 804 | IL1ra_IL18_SN | ATGGAAATTTGCCGCGGGCTACGGTCCCACCTCATCACCCTTCTCTTA<br>TTCCTATTCCACTCGGAGACAATCTGCTACTTCGGCAAGCTCGAGAGC<br>AAGCTCTCCGTCATACGGAACCTCAACGACCAGGTCCTCTTCATCGAC<br>CAGGGGAATCGACCCCTCTTCGAAGACATGACCAGCAGCGACTGCAGG<br>AACAACGCCCCCCGCACCATCTTCATCATCAGCATGTACAAGGATTCG<br>CAGCCCCGGGGCATGGCCGTCACCATCTCCGTGAAGTGTGAGAAAATC<br>AGCACCCTCAGTTGTGAGAACAAGATTATCTCCTTCAAGGAGATGAAC<br>CCGCCCGACAACATTAAGGACACCAAGAGCGACATCATCTTCTTCCAG<br>AGGTCGGTGCCCGGCCACGATAACAAGATGCAGTTCGAGTCCAGCTCC<br>TACGAGGGCTATTTCCTGGCCTGCGAGAAGGAGCGGGACCTGTTTAAG<br>CTTATCCTGAAGAAGGAGGATGAGCTGGGCGACAGGAGCATCATGTTT<br>ACCGTGCAAAACGAGGAT |
| 805 | IL1ra_IL18_SN | ATGGAGATTTGCCGCGGGCTCAGGAGCCACCTTATCACCCTCCTCCTC<br>TTCCTATTCCACTCAGAGACGATCTGCTATTTCGGAAAGCTCGAGAGC<br>AAGCTCTCCGTAATCAGGAACCTCAACGACCAGGTTCTCTTCATCGAC<br>CAGGGCAACAGGCCCCTCTTCGAGGACATGACGTCCAGCGACTGCCGC<br>AACAACGCCCCCCGGACCATCTTCATCATCTCCATGTACAAAGACAGC<br>CAGCCCAGGGGCATGGCCGTCACCATCAGCGTCAAGTGCGAGAAGATC<br>TCCACCCTAAGCTGTGAGAACAAGATTATCTCGTTCAAGGAGATGAAC<br>CCACCCGACAACATCAAGGACACCAAGTCCGACATCATCTTCTTCCAG<br>AGGAGCGTACCCGGCCACGATAACAAGATGCAGTTCGAGAGCTCCTCC<br>TACGAGGGCTACTTCCTGGCCTGCGAAAAGGAGAGGGACCTGTTCAAG<br>CTGATCCTGAAGAAAGAGGATGAGCTGGGTGACCGCTCCATAATGTTC<br>ACGGTGCAGAACGAGGAC |
| 806 | IL1ra_IL18_SN | ATGGAGATCTGCCGGGGCCTCAGGTCCCACCTCATCACCCTCCTACTC<br>TTCTTATTCCACTCGGAGACGATCTGTTACTTCGGAAAGCTCGAGAGC<br>AAGCTCAGCGTCATCCGTAACCTCAACGACCAGGTCCTCTTCATCGAT<br>CAGGGCAACAGGCCGCTATTCGAGGACATGACCTCCAGCGACTGCCGG<br>AACAACGCCCCGCGGACCATATTCATCATCAGCATGTACAAGGACTCC<br>CAACCCCGGGGCATGGCCGTCACTATCAGCGTTAAGTGCGAGAAAATC<br>TCCACCCTTAGCTGCGAGAACAAGATCATCTCGTTCAAGGAGATGAAC<br>CCGCCCGACAACATCAAGGACACCAAGTCGGACATAATCTTCTTCCAG<br>CGGTCAGTCCCCGGCCATGACAACAAGATGCAGTTTGAGTCCAGCTCC<br>TACGAGGGCTACTTTCTGGCCTGCGAGAAGGAGAGGGACCTCTTTAAG<br>CTGATCCTCAAGAAGGAGGACGAGCTGGGCGACAGGTCCATCATGTTC<br>ACCGTCCAGAACGAGGAC |
| 807 | IL1ra_IL18_SN | ATGGAGATCTGCAGGGGCCTCCGCTCCCACCTCATCACCCTCCTCCTC<br>TTCCTCTTCCACAGCGAGACGATCTGCTACTTCGGCAAGCTAGAGTCC<br>AAGCTCTCGGTCATCCGGAACCTAAACGACCAGGTACTCTTCATCGAC<br>CAGGGGAACAGGCCCCTCTTCGAAGACATGACTAGCAGCGATTGCAGG<br>AACAACGCCCCGAGGACCATCTTCATCATCAGCATGTATAAGGATAGC<br>CAGCCCCGGGGCATGGCCGTCACCATCTCGGTGAAGTGCGAGAAGATC<br>AGCACCTTGTCCTGCGAGAACAAGATAATCTCATTCAAGGAGATGAAC<br>CCTCCCGACAATATAAAGGACACTAAGTCCGACATCATCTTCTTCCAG<br>AGGAGCGTGCCAGGGCACGACAACAAGATGCAGTTCGAAAGCAGCAGC<br>TACGAGGGGTATTTCCTGGCCTGCGAAAAGGAGCGGGACCTGTTCAAG<br>CTGATCCTGAAGAAGGAGGATGAACTGGGGGACCGCTCCATCATGTTC<br>ACCGTGCAGAACGAGGAC |

The sequence-optimized IL18 polynucleotide sequences disclosed herein are distinct from the corresponding wild type IL18 polynucleotide sequences and from other known sequence-optimized IL18 polynucleotide sequences, e.g., these sequence-optimized nucleic acids have unique compositional characteristics. See FIGS. 100A to 101E.

In some embodiments, the percentage of uracil or thymine nucleobases in a sequence-optimized IL18 polynucleotide sequence (e.g., encoding an IL18 polypeptide, a functional fragment, or a variant thereof) is modified (e.g., reduced) with respect to the percentage of uracil or thymine nucleobases in the reference wild-type polynucleotide sequence. Such a sequence is referred to as a uracil-modified or thymine-modified sequence. In some embodiments, the sequence-optimized IL18 polynucleotide sequence has a lower uracil or thymine content than the uracil or thymine content in the reference wild-type sequence. In some embodiments, the uracil or thymine content in a sequence-optimized IL18 polynucleotide sequence of the disclosure is greater than the uracil or thymine content in the reference wild-type sequence and still maintain beneficial effects, e.g., increased expression of interferon-γ when compared to the reference wild-type sequence.

The uracil or thymine content of the wild type IL 18 polypeptide (e.g., SEQ ID NO: 564) without the signal peptide is about 28%. In some embodiments, the uracil or thymine content of a uracil- or thymine-modified sequence encoding an IL18 polypeptide is less than the uracil or thymidine content of the wild type IL18, e.g., less than 28%. In some embodiments, the uracil or thymine content of a uracil- or thymine-modified sequence encoding an IL18 polypeptide of the disclosure is less than 28%, less than 25%, less than 24%, less than 23%, less than 22%, less than 21%, less than 20%, less than 19%, less than 18%, less than 17%, or less than 16%. In some embodiments, the uracil or thymine content is not less than 18%, 17%, or 16%. The uracil or thymine content of a sequence disclosed herein, i.e., its total uracil or thymine content is abbreviated herein as % $U_{TL}$ or % $T_{TL}$. In some embodiments, the uracil or thymine content (% $U_{TL}$ or % $T_{TL}$) of a uracil- or thymine-modified sequence encoding an IL18 polypeptide of the disclosure is less than about 50%, less than about 40%, less than about 30%, less than about 25%, or less than about 20%.

In some embodiments, the uracil or thymine content (% $U_{TL}$ or % $T_{TL}$) of a uracil- or thymine-modified sequence encoding an IL18 polypeptide of the disclosure is between 12% and 25%, between 12% and 24%, between 13% and 24%, between 13% and 23%, between 14% and 23%, between 14% and 22%, between 15% and 22%, between 15% and 21%, between 16% and 21%, between 16% and 20%, or between 17% and 20%.

In some embodiments, the uracil or thymine content (% $U_{TL}$ or % $T_{TL}$) of a uracil- or thymine-modified sequence encoding an IL18 polypeptide of the disclosure is between 15% and 22%, between 15% and 21%, 16% and 21%, 16% and 20%, or between 17% and 20%.

In a particular embodiment, the uracil or thymine content (% $U_{TL}$ or % $T_{TL}$) of a uracil- or thymine modified sequence encoding an IL18 polypeptide of the disclosure is between about 17% and about 20%.

The uracil or thymine content of IL2sp IL18 wt (e.g., SEQ ID NO: 575) is about 30%. In some embodiments, the uracil or thymine content of a uracil- or thymine-modified sequence encoding an IL18 polypeptide is less than 30%. In some embodiments, the uracil or thymine content of a uracil- or thymine-modified sequence encoding an IL18 polypeptide of the disclosure is less than 30%, less than 25%, less than 24%, less than 23%, less than 22%, less than 21%, less than 20%, less than 19%, less than 18%, less than 17%, or less than 16%. In some embodiments, the uracil or thymine content is not less than 18%, 17%, or 16%. The uracil or thymine content of a sequence disclosed herein, i.e., its total uracil or thymine content is abbreviated herein as % $U_{TL}$ or % $T_{TL}$.

In some embodiments, the uracil or thymine content (% $U_{TL}$ or % $T_{TL}$) of a uracil- or thymine-modified sequence encoding an IL18 polypeptide of the disclosure is between 12% and 25%, between 12% and 24%, between 13% and 24%, between 13% and 23%, between 14% and 23%, between 14% and 22%, between 15% and 22%, between 15% and 21%, between 16% and 21%, between 16% and 20%, or between 17% and 20%.

In some embodiments, the uracil or thymine content (% $U_{TL}$ or % $T_{TL}$) of a uracil- or thymine-modified sequence encoding an IL18 polypeptide of the disclosure is between 15% and 22%, between 16% and 21%, between 15% and 20%, between 16% and 20%, between 15% and 21%, between 16% and 21%, between 17% and 21%, or between 17% and 20%.

In a particular embodiment, the uracil or thymine content (% $U_{TL}$ or % $T_{TL}$) of a uracil- or thymine modified sequence encoding an IL18 polypeptide of the disclosure is between about 17% and about 20%.

A uracil- or thymine-modified sequence encoding an IL18 polypeptide of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

In some embodiments, the % $U_{WT}$ or % $T_{WT}$ of a uracil- or thymine-modified sequence encoding an IL18 polypeptide of the disclosure is above 50%, above 55%, above 60%, or above 65%. In some embodiments, the % $U_{WT}$ or % $T_{WT}$ of a uracil- or thymine-modified sequence encoding an IL18 polypeptide of the disclosure is less than about 95%, less than about 90%, less than about 85%, less than 80%, less than 75%, less than 70%, or less than 66%.

In some embodiments, the % $U_{WT}$ or % $T_{WT}$ of a uracil- or thymine modified sequence encoding an IL18 polypeptide of the disclosure is between 50% and 80%, between 51% and 79%, between 52% and 78%, between 53% and 77%, between 54% and 76%, between 55% and 75%, between 56% and 74%, between 57% and 73%, between 58% and 72%, between 59% and 71%, between 59% and 70%, or between 60% and 69%.

In some embodiments, the % $U_{WT}$ or % $T_{WT}$ of a uracil- or thymine-modified sequence encoding an IL18 polypeptide of the disclosure is between 58% and 71%, between 58% and 72%, between 58% and 70%, between 59% and 70%, between 59% and 71%, between 59% and 72%, between 60% and 69%, between 60% and 70%, between 60% and 71%, between 60% and 72%, or between 60% and 69%.

In a particular embodiment, the % $U_{WT}$ or % $T_{WT}$ of a uracil- or thymine-modified sequence encoding an IL18 polypeptide of the disclosure is between about 50% and about 70%, or between about 55% and about 66%.

In some embodiments, the % $U_{WT}$ or % $T_{WT}$ of a uracil- or thymine modified sequence encoding an IL18 polypeptide of the disclosure is between 50% and 80%, between 51% and 79%, between 52% and 78%, between 53% and 77%, between 54% and 76%, between 55% and 75%, between 56% and 74%, between 57% and 73%, between 57% and 72%, between 57% and 71%, between 57% and 70%, between 57% and 69%, between 57% and 68%, or between 57% and 67%.

In some embodiments, the % $U_{WT}$ or % $T_{WT}$ of a uracil- or thymine-modified sequence encoding an IL18 polypeptide of the disclosure is between 55% and 69%, between 55% and 68%, between 55% and 67%, between 56% and 69%, between 56% and 68%, between 56% and 67%, between 55% and 69%, between 55% and 68%, between 55% and 67%, or between 57% and 67%.

In a particular embodiment, the % $U_{WT}$ or % $T_{WT}$ of a uracil- or thymine-modified sequence encoding an IL18 polypeptide of the disclosure is between about 57% and about 67%.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding an IL18 polypeptide of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, or below 120%.

In some embodiments, the % $U_{TM}$ of a uracil-modified sequence encoding an IL18 polypeptide of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, above 130%, above 131%, above 132%, above 133%, above 134%, above 135%, above 136%, above 137%, above 138%, above 139%, above 140%, above 141%, above 142%, above 143%, above 144%, or above 145%.

In some embodiments, the % $U_{TM}$ of a uracil-modified sequence encoding an IL18 polypeptide of the disclosure is between 133% and 136%, between 132% and 137%, between 131% and 138%, between 130% and 139%, between 129% and 140%, between 128% and 141%, between 127% and 142%, between 126% and 143%, between 125% and 144%, between 124% and 145%, between 123% and 146%, between 122% and 147%, or between 121% and 148%.

In some embodiments, the % $U_{TM}$ of a uracil-modified sequence encoding an IL18 polypeptide of the disclosure is between about 115% and about 160%, between about 120% and about 160%, between about 125% and about 160%, between about 115% and about 155%, between about 120% and about 155%, between about 125% and about 155%, between about 115% and about 150%, between about 120% and about 150%, or between about 125% and about 150%.

In some embodiments, the % $U_{TM}$ of a uracil-modified sequence encoding an IL18 polypeptide of the disclosure is between (i) 118%, 119%, 120%, 121%, 122%, 123%, 124%, or 125% and (ii) 139%, 140%, 141%, 142%, 143%, 144%, 145%, or 146%.

In some embodiments, the % $U_{TM}$ of a uracil-modified sequence encoding an IL18 polypeptide of the disclosure is between about 127% and about 146%.

In some embodiments, the % $U_{TM}$ of a uracil-modified sequence encoding an IL18 polypeptide of the disclosure is between about 123% and about 144%.

In some embodiments, a uracil-modified sequence encoding an IL18polypeptide of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

As discussed above, the number of phenylalanines in a sequence establishes a minimum number of uracil pairs (UU) that cannot be eliminated without altering the number of phenylalanines in the encoded polypeptide.

tPA IL18 wt (e.g., SEQ ID NO: 573) contains 16 uracil pairs (UU), and 11 uracil triplets (UUU). IL2sp IL18 wt (e.g., SEQ ID NO: 575) contains 19 uracil pairs (UU), and 10 uracil triplets (UUU). In some embodiments, a uracil-modified sequence encoding an IL18 polypeptide of the disclosure has a reduced number of uracil triplets (UUU) with respect to the wild-type nucleic acid sequence. In some embodiments, a uracil-modified sequence encoding an IL18 polypeptide of the disclosure contains 8, 7, 6, 5, 4, 3, 2, 1 or no uracil triplets (UUU).

In some embodiments, a uracil-modified sequence encoding an IL18 polypeptide has a reduced number of uracil pairs (UU) with respect to the number of uracil pairs (UU) in the wild-type nucleic acid sequence. In some embodiments, a uracil-modified sequence encoding an IL18 polypeptide of the disclosure has a number of uracil pairs (UU) corresponding to the minimum possible number of uracil pairs (UU) in the wild-type nucleic acid sequence, e.g., 35 uracil pairs in the case of wild type IL18 (e.g., SEQ ID NO: 565).

In some embodiments, a uracil-modified sequence encoding an IL18 polypeptide of the disclosure has at least 1, 2, 3, 4, 5, 6, 7, 8, 9, 10, 11, or 12 uracil pairs (UU) less than the number of uracil pairs (UU) in the wild-type nucleic acid sequence. In some embodiments, a uracil-modified sequence encoding an IL18 polypeptide of the disclosure has between 10 and 19 uracil pairs (UU). In some embodiments, a uracil-modified sequence encoding an IL18 polypeptide of the disclosure has between 7 and 16 uracil pairs (UU).

In some embodiments, a uracil-modified sequence encoding an IL18 polypeptide of the disclosure has a % $UU_{wt}$less than 120%, less than 115%, less than 110%, less than 105%, less than 100%, less than 99%, less than 95%, less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding an IL18 polypeptide has a % $UU_{wt}$ between 62% and 119%. In a particular embodiment, a uracil-modified sequence encoding an IL18 polypeptide of the disclosure has a % $UU_{wt}$ between 62% and 119%.

In some embodiments, a uracil-modified sequence encoding an IL18 polypeptide has a % $UU_{wt}$ between 36% and 85%. In a particular embodiment, a uracil-modified sequence encoding an IL18 polypeptide of the disclosure has a % $UU_{wt}$ between 36% and 85%.

In some embodiments, the polynucleotide of the disclosure comprises a uracil-modified sequence encoding an IL18 polypeptide disclosed herein. In some embodiments, the uracil-modified sequence encoding an IL18 polypeptide comprises at least one chemically modified nucleobase, e.g., 5-methoxyuracil. In some embodiments, at least 95% of a nucleobase (e.g., uracil) in a uracil-modified sequence encoding an IL18 polypeptide of the disclosure are modified nucleobases. In some embodiments, at least 95% of uracil in a uracil-modified sequence encoding an IL18 polypeptide is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding IL18 with respect to the theoretical maximum guanine content of a nucleotide sequence encoding the IL18 polypeptide," abbreviated as % $G_{TMX}$ is at least 69%, at least 70%, at least 71%, at least 75%, at least about 80%, at least about 85%, at least about 90%, at least about 95%, or about 100%. In some embodiments, the % $G_{TMX}$ is between about 65% and about 85%, between about 67% and about 83%, between about 69% and about 81%, or between about 71% and about 80%. In some embodiments, the % $G_{TMX}$ is less than 100%, less than about 90%, less than about 85%, or less than about 83%. In some embodiments, the % $G_{TMX}$ is between about 65% and about 87%, between about 69% and about 85%, or between about 71% and about 83%.

In some embodiments, the "cytosine content of the ORF relative to the theoretical maximum cytosine content of a nucleotide sequence encoding the IL18 polypeptide," abbreviated as % $C_{TMX}$, is at least 60%, at least about 65%, at least about 70%, at least about 75%, at least about 80%, at least about 85%, at least about 90%, at least about 95%, or about 100%. In some embodiments, the % $C_{TMX}$ is between about 60% and about 85%, between about 65% and about 82%, between about 69% and about 78%, or between about 69% and about 80%. In some embodiments, the % $C_{TMX}$ is less than 95%, less than 90%, or less than 85%. In some embodiments, is between about 60% and about 85%, between about 65% and about 83%, or between about 67% and about 81%.

In some embodiments, the "guanine and cytosine content (G/C) of the ORF relative to the theoretical maximum G/C content in a nucleotide sequence encoding the IL18 polypeptide," abbreviated as % $G/C_{TMX}$ is at least about 85%, at least about 89% at least about 90%, at least about 95%, or about 100%. In some embodiments, the % $G/C_{TMX}$ is between about 80% and about 100%, between about 85% and about 99%, between about 89% and about 95%, or between about 89% and about 94%. In some embodiments, the % $G/C_{TMX}$ is less than 100%, less than 99%, less than 98%, less than 97%, less than 96%, or less than 95%. In some embodiments, the % $G/C_{TMX}$ is between about 87% and about 96% or between about 88% and about 95%.

In some embodiments, the "G/C content in the ORF relative to the G/C content in the corresponding wild-type ORF," abbreviated as % $G/C_{WT}$ is at least 100%, at least 102%, at least 103%, at least 104%, at least 105%, at least 106%, at least 107%, at least 110%, at least 115%, or at least 120%, at least 125%, at least 130%, at least 135%, at least 140%, at least 145%, at least 150%, at least 155%, or at least 157%.

In some embodiments, the average G/C content in the 3rd codon position in the ORF is at least 20%, at least 21%, at least 22%, at least 23%, at least 24%, at least 25%, at least 26%, at least 27%, at least 28%, at least 29%, at least 30%, at least 35%, at least 40%, at least 45%, or at least 50% higher than the average G/C content in the 3rd codon position in the corresponding wild-type ORF.

In some embodiments, the average G/C content in the 3rd codon position in the ORF is at least 45%, at least 46%, at least 47%, at least 48%, at least 49%, at least 50%, at least 51%, at least 52%, at least 53%, at least 54%, at least 55%, at least 56%, at least 57%, or at least 58% higher than the average G/C content in the $3^{rd}$ codon position in the corresponding wild type IL18 ORF.

In some embodiments, the IL18 polynucleotide of the disclosure comprises an open reading frame (ORF) encoding an IL18 polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

Modified Nucleotide Sequences Encoding IL18 Polypeptides:

In some embodiments, the IL18 polynucleotide (e.g., a RNA, e.g., a mRNA) comprises a chemically modified nucleobase, e.g., 5-methoxyuracil. In some embodiments, the mRNA is a uracil-modified sequence comprising an ORF encoding an IL18 polypeptide, wherein the mRNA comprises a chemically modified nucleobase, e.g., 5-methoxyuracil.

In certain aspects of the present disclosure, when the 5-methoxyuracil base is connected to a ribose sugar, as it is in polynucleotides, the resulting modified nucleoside or nucleotide is referred to as 5-methoxyuridine. In some embodiments, uracil in the IL18 polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the IL18 polynucleotide is at least 95% 5-methoxyuracil. In another embodiment, uracil in the polynucleotide is 100% 5-methoxyuracil.

In embodiments where uracil in the IL18 polynucleotide is at least 95% 5-methoxyuracil, overall uracil content can be adjusted such that an mRNA provides suitable protein expression levels while inducing little to no immune response. In some embodiments, the uracil content of the ORF is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140% of the theoretical minimum uracil content in the corresponding wild-type ORF (% $U_{TM}$). In other embodiments, the uracil content of the ORF is between about 117% and about 134% or between 118% and 132% of the % $U_{TM}$. In some embodiments, the uracil content of the ORF encoding an IL18 polypeptide is about 115%, about 120%, about 125%, about 130%, about 135%, about 140%, about 145%, or about 150% of the % Um v. In this context, the term "uracil" can refer to 5-methoxyuracil and/or naturally occurring uracil.

In some embodiments, the uracil content in the ORF of the mRNA encoding an IL18 polypeptide disclosed herein is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 18% and about 21% of the total nucleobase content in the ORF. In one embodiment, the uracil content in the ORF of the mRNA encoding an IL18 polypeptide is less than about 21% of the total nucleobase content in the open reading frame. In this context, the term "uracil" can refer to 5-methoxyuracil and/or naturally occurring uracil.

In further embodiments, the ORF of the mRNA encoding an IL18 polypeptide having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF. In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the PBDG polypeptide (% $G_{TMX}$; % $C_{TMX}$, or % $G/C_{TMX}$).

In other embodiments, the G, the C, or the G/C content in the ORF is between about 70% and about 80%, between about 71% and about 79%, between about 71% and about 78%, between about 71% and about 77%, or between about 90% and about 95% of the % $G_{TMX}$, % $C_{TMX}$, or % $G/C_{TMX}$. In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding an IL18 polypeptide disclosed herein comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the IL18 polypeptide. In some embodiments, the ORF of the mRNA encoding an IL18 polypeptide of the disclosure contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the IL18 polypeptide. In a particular embodiment, the ORF of the mRNA encoding the IL18 polypeptide of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the IL18 polypeptide contains no non-phenylalanine uracil pairs and/or triplets.

In further embodiments, the ORF of the mRNA encoding an IL18 polypeptide of the disclosure comprises 5-methoxyuracil and has an adjusted uracil content containing less uracil-rich clusters than the corresponding wild-type nucleotide sequence encoding the IL18 polypeptide. In some embodiments, the ORF of the mRNA encoding the IL18 polypeptide of the disclosure contains uracil-rich clusters that are shorter in length than corresponding uracil-rich clusters in the corresponding wild-type nucleotide sequence encoding the IL18 polypeptide.

Polynucleotide Comprising an mRNA Encoding an IL18 Polypeptide:

In certain embodiments, an IL18 polynucleotide of the present disclosure, for example an IL18 polynucleotide comprising an mRNA nucleotide sequence encoding an IL18 polypeptide, comprises from 5' to 3' end:

(i) a 5' UTR, such as the sequences provided below, comprising a 5' cap provided below;

(ii) an open reading frame encoding an IL18 polypeptide, e.g., a sequence optimized nucleic acid sequence encoding IL18 disclosed herein;

(iii) at least one stop codon;

(iv) a 3' UTR, such as the sequences provided below; and (v) a poly-A tail provided below.

In some embodiments, the IL18 polynucleotide further comprises a miRNA binding site, e.g, a miRNA binding site that binds to miRNA-122. In some embodiments, the 3'UTR comprises the miRNA binding site.

In some embodiments, a IL18 polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type IL18 (e.g, isoform 1, 2, 3, or 4).

IL18 Compositions and Formulations for Use:

Certain aspects of the present disclosure are directed to compositions or formulations comprising any of the IL18 polynucleotides disclosed above. In some embodiments, the composition or formulation comprises:

(i) an IL18 polynucleotide (e.g., a RNA, e.g., a mRNA) comprising a sequence-optimized nucleotide sequence (e.g., an ORF) encoding an IL18 polypeptide (e.g., the wild-type sequence, functional fragment, or variant thereof), wherein the polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the IL18 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the IL18 polypeptide (% Um or % T w), is between about 100% and about 150%. In some embodiments, the polynucleotides, compositions or formulations above are used to treat a cancer.

E. Interleukin-15 (IL15)

In some embodiments, the combination therapies disclosed herein comprise one or more IL15 polynucleotides (e.g., mRNAs), i.e., polynucleotides comprising one or more ORFs encoding an IL15 polypeptide.

Interleukin 15 ("IL15") IL15 is a member of the 4a-helix bundle family of cytokines and plays an important role in the development of an effective immune response. Waldmann, T. A., *Cancer Immunol. Res.* 3: 219-227 (2015). IL15 is essential for the proper development of NK cells and long-term maintenance of memory CD8+ T cells. The IL15 gene encodes a 162 amino acid preprotein having a signal peptide of 48 amino acids, with the mature protein being 114 amino acids in length. Bamford, R. N., et al., *Proc. Natl. Acad. Sci. USA* 93: 2897-2902 (1996). See also, e.g., GenBank Accession Numbers NM_000585 for the *Homo sapiens* IL15 transcript variant 3 mRNA sequence and NP_000576 for the corresponding IL15 isoform 1 preproprotein.

IL15 shares certain structural similarity to interleukin-2 (IL2). Like IL2, IL15 signals through the IL2 receptor beta chain (CD 122) and the common gamma chain (CD132). But, unlike IL2, IL15 cannot effectively bind CD122 and CD132 on its own. IL15 must first bind to the IL15 alpha receptor subunit ("IL15Rα").

The IL15Rα gene encodes a 267 amino acid preprotein having a signal peptide of 30 amino acids, with the mature protein being 237 amino acids in length. See, e.g., GenBank Accession Numbers NM_002189 for the *Homo sapiens* IL15Rα transcript variant 1 mRNA and NP_002180 for the *Homo sapiens* IL15Rα isoform 1 precursor amino acid sequence.

Wild-type IL15Rα is predominantly a transmembrane protein that binds to IL15 on the surface of cells such as activated dendritic cells and monocytes. Waldmann, T. A., *Cancer Immunol. Res.* 3: 219-227 (2015). The membrane bound complex of IL15/IL15Ra then presents IL15 in trans to CD122 and CD132 subunits located on the surface of cells such as natural killer (NK) and $CD8^+$ memory T cells. Binding of IL15 to CD122 and CD132 activates signal transduction. Accordingly, IL15Ra is an essential component of IL15 activity. Studies have shown that the biological activity of soluble IL15 can be improved in the presence of a soluble form of IL15Rα. Rubinstein, M. P., et al., *Proc. Natl. Acad. Sci. USA* 103:9166-9171 (2006).

In some embodiments, the combination therapies disclosed herein comprise an IL15 polynucleotide, i.e., a polynucleotide comprising a nucleic acid sequence (e.g., an ORF) encoding an IL15 polypeptide. In some embodiments, the IL15 polynucleotide encodes an IL15Rα polypeptide. In some embodiments, the IL15 polynucleotide, e.g., a ribonucleic acid (RNA) such as a messenger RNA (mRNA) comprises a nucleotide sequence (e.g., an ORF) encoding an fusion protein comprising an IL15 polypeptide (e.g., an IL15-L15Rα fusion protein).

In other embodiments, the combination therapies disclosed herein can comprise two or more IL15 polynucleotides (e.g., RNA, e.g., mRNA), wherein a first IL15 polynucleotide encodes an IL15 polypeptide, and a second IL15 polynucleotide encodes an IL15Rα polypeptide. In certain embodiments, the combination therapies disclosed herein comprise an IL15 polynucleotide, e.g., an RNA, comprising a nucleotide sequence encoding both an IL15 polypeptide and an IL15Rα polypeptide, wherein the IL15 and the IL15α polypeptides are fused directly or by a linker.

In some embodiments, the IL15 polypeptide and/or IL15Rα polypeptide encoded by the IL15 polynucleotide is a variant, a peptide or a polypeptide containing a substitution, and insertion and/or an addition, a deletion and/or a covalent modification with respect to a wild-type IL15 and/or IL15Rα sequence.

In the context of the present disclosure, the term "IL15 polypeptide" refers to polypeptides comprising a mature IL15 polypeptide (i.e., without its signal peptide and propeptide). The "IL15 polypeptide" can include a signal peptide and/or propeptide. Also, the IL15 polypeptide can include other components, e.g., an IL15Rα polypeptide. Thus, a chimeric polypeptide comprising a IL15 moiety and a IL15Rα moiety is considered an IL15 polypeptide in the context of the present disclosure.

The term "IL15Rα polypeptide" as used herein includes at least a Sushi domain of a full-length IL15Rα polypeptide, without a signal peptide. In some embodiments, the "IL15Rα polypeptide" comprises the extracellular domain of the full-length IL15Rα polypeptide. In other embodiments, the "IL15Rα polypeptide" can comprise the transmembrane region and/or cytoplasmic region of the full-length IL15Rα polypeptide. In some embodiments, sequence tags or amino acids, can be added to the sequences encoded by the polynucleotides of the disclosure (e.g., at the N-terminal or C-terminal ends), e.g., for localization. In some embodiments, amino acid residues located at the carboxy, amino terminal, or internal regions of a polypeptide of the disclosure can optionally be deleted providing for fragments.

In some embodiments, the IL15 and/or IL1R5α polypeptide encoded by the IL15 polynucleotide (e.g., a RNA, e.g., an mRNA) comprises a substitutional variant of an IL15 and/or IL15Rα sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

In other embodiments, the IL15 and/or IL15Ra polypeptide encoded the IL15 polynucleotide (e.g., a RNA, e.g., an mRNA) comprises a linker fusing the IL15Rα and IL15 polypeptides. Non-limiting examples of linkers are disclosed elsewhere herein. As recognized by those skilled in the art, IL15 and/or IL15Rα protein fragments, functional protein domains, variants, and homologous proteins (orthologs) are also considered to be within the scope of the IL15 and/or IL15Rα polypeptides disclosed herein.

Nonlimiting examples of polypeptides encoded by the IL15 polynucleotides of the disclosure are shown in TABLE 9.

TABLE 9

| SEQ ID NO | Description | Sequence | Comments |
|---|---|---|---|
| 808 | Full Length IL15R Amino Acid Sequence (Wild Type) | *MAPRRARGCRTLGLPALLLLLLLRPPATRG*ITCPPPMSVEHADIWV<br>KSYSLYSRERYICNSGFKRKAGTSSLTECVLNKATNVAHWTTPSLK<br>CIRDPALVHQRPAPPSTVTTAGVTPQPESLSPSGKEPAASSPSSNN<br>TAATTAAIVPGSQLMPSKSPSTGTTEISSHESSHGTPSQTTAKNWE<br>LTASASHQPPGVYPQGHSDTTVAISTSTVLLCGLSAVSLLACYLKS<br>RQTPPLASVE MEAMEALPVTWGTSSRDEDLENCSHHL | Signal peptide is italicized, The sushi domain of the wild-type 1L15Ra is double underlined. |
| 809 | Full-Length IL151R Nucleotide Sequence | *ATGGCTCCCCGCCGCGCGCGAGGCTGTCGCACCCTCGGACTTCCTG*<br>*CACTCTTGCTTTTGCTCCTCCTTAGACCCCCTGCAACCAGAGGG*AT<br>AACCTGTCCACCTCCAATGAGCGTCGAGCACGCAGACATTTGGGTG<br>AAATCATACAGTCTGTACAGTAGAGAGCGGTACATCTGCAACAGTG<br>GGTTTAAAAGAAAAGCAGGCACTTCATCTCTGACAGAGTGCGTGCT<br>GAACAAAGCAACTAATGTAGCTCATTGGACAACCCCATCACTGAAA<br>TGCATTAGAGATCCAGCTCTGGTGCATCAAAGACCAGCACCACCAA<br>GTACCGTAACAACCGCAGGGGTGACCCCTCAGCCTGAGTCCCTATC | Signal peptide is italicized, The sushi domain of the wild-type EL 15Ra is double underlined. |

TABLE 9-continued

| SEQ ID NO | Description | Sequence | Comments |
|---|---|---|---|
| | | TCCCTCCGGCAAGGAGCCAGCAGCATCTTCACCTAGCTCCAATAAC ACCGCAGCTACCACTGCCGCCATAGTCCCCGGAAGCCAGCTGATGC CTAGTAAATCTCCCTCAACAGGTACCACCGAAATTTCTAGCCATGA GTCCTCGCACGGCACCCCGTCACAGACTACAGCTAAAAACTGGGAG CTAACGGCTTCGGCATCCCACCAACCTCCAGGCGTTTATCCCCAAG GTCACTCCGACACTACTGTGGCGATTAGCACAAGTACCGTCCTTCT GTGTGGACTGAGTGCAGTTTCATTGCTGGCCTGTTATCTGAAATCT CGCCAGACCCCTCCCCTCGCCAGTGTTGAGATGGAAGCCATGGAAG CACTTCCTGTGACTTGGGGAACATCCTCGAGGGACGAGGACCTCGA GAACTGCTCTCACCACCTG | |
| 810 | Full-Length IL15 Amino Acid Sequence (Wild Type) | MRISKPHLRSISIQCYLCLLLNSHFLTEAGIHVFILGCFSAGLPKT EANWVNVISDLKKIEDLIQSMHIDATLYTESDVHPSCKVTAMKCFL LELQVISLESGDASIHDTVENLIILANNSLSSNGNVTESGCKECEE LEEKNIKEFLQSFVHIVQMFINTS | The signal peptide is italized. The propeptide is solid line underlined. Mature 1L15 is dot underlined. |
| 811 | Full-length IL15 Nucleotide Sequence (Wild Type) | *ATGCGCATCAGCAAACCTCATTTACGGAGTATCAGCATCCAGTGCT ATCTCTGCCTGCTTCTGAACAGTCATTTTCTGACTGAGGCG*GGCAT TCATGTCTTTATTTTAGGCTGCTTTTCCGCAGGTCTGCCCAAAACA GAAGCAAATTGGGTGAACGTGATCAGCGACCTGAAGAAGATTGAGG ATCTAATTCAAAGCATGCATATTGATGCCACACTCTACACCGAATC CGACGTGCACCCTTCGTGTAAAGTGACTGCAATGAAGTGTTTCTTA CTGGAACTGCAGGTGATCAGTCTGGAGTCCGGGGATGCATCAATCC ACGACACAGTGGAAAACCTGATTATCCTGGCAAACAATTCCCTGAG CAGTAATGGCAATGTCACGGAGAGCGGATGTAAGGAGTGTGAGGAA TTAGAGGAAAAGAATATCAAGGAATTCCTTCAGTCCTTTGTGCACA TCGTACAGATGTTTATTAATACATCC | |
| 812 | tPA-IL15 Amino acid Sequence | *MDAMKRGLCCVLLLCGAVFVSPSQEIHARFRRGAR*NWVNVISDLKK IEDLIQSMHIDATLYTESDVHPSCKVTAMKCFLLELQVISLESGDA SIHDTVENLIILANNSLSSNGNVTESGCKECEELEEKNIKEFLQSF VIHVQMFINTS | Signal peptide and propeptide from tPA is italicized; the mature IL15 peptide has a dotted underline |
| 813 | Full Fc-IL15R-Linker-IL15 Amino acid Sequence | *METDTLLLWVLLLWVPGSTG*EPKSCDKTHTCPPCPAPELLGGPSVF LFPPKPKDTLMISRTPEVTCVVVAVSHEDPEVKFNWYVDGVEVHNA KTKPREEQYNSTYRVVSVLTVLHQDWLNGKEYKCKVSNKALPAPIE KTISKAKGQPREPQVYTLPPSRDELTKNQVSLTCLVKGFYPSDIAV EWESNGQPENNYKTTPPVLDSDGSFFLYSKLTVDKSRWQQGNVFSC SVMHEALHNHYTQKSLSLSPGKITCPPPMSVEHADIWVKSYSLYSR ERYICNSGFKRKAGTSSLTECVLNKATNVAHWTTPSLKCIRDPALV HQRPAPP**SGGSGGGGSGGGSGGGGSLQ**NWVNVISDLKKIEDLIQSM HIDATLYTESDVHPSCKVTAMKCFLLELQVISLESGDASIHDTVEN LIILANNSLSSNGNVTESGCKECEELEEKNIKEFLQSFVHIVQMFI NTS | The signal peptide is italicized and the mature 1115 is represented by a dotted underline. |

IL15 Polynucleotides and Open Reading Frames (ORFs):

In some aspects of the present disclosure, the combination therapies disclosed herein comprise an IL15 polynucleotide (e.g., a RNA, e.g., an mRNA) that comprises a nucleotide sequence (e.g., an ORF) encoding an IL15 polypeptide, an IL15Rα polypeptide, or a combination thereof.

In some embodiments, the IL15 polynucleotide (e.g., a RNA, e.g., an mRNA) comprises a nucleotide sequence (e.g., an ORF) encoding an IL15 polypeptide. In some embodiments, the IL15 polynucleotide (e.g., a RNA, e.g., an mRNA) comprises a nucleotide sequence (e.g., an ORF) encoding an IL15Rα polypeptide.

In some embodiments, the IL15 polynucleotide (e.g., a RNA, e.g., an mRNA) comprises a nucleotide sequence that encodes a fusion protein comprising an IL15 polypeptide and an IL15Rα polypeptide comprising or consisting of a Sushi domain, which are fused directly or by a linker, wherein (a) the IL15 polypeptide is selected from:

(i) the mature IL15 polypeptide (e.g., having the same or essentially the same length as wild-type IL15) with or without a signal peptide;

(ii) a functional fragment of the IL15 polypeptide, e.g., a truncated (e.g., deletion of carboxy, amino terminal, or internal regions) sequence shorter than a wild-type IL15, but still retaining IL15 activity;

(iii) a variant thereof, e.g., full length, mature, or truncated IL15 proteins in which one or more amino acids have been replaced (e.g., variants that retain all or most of the IL15 activity of the polypeptide with respect to the wild-type IL15 polypeptide); or, (iv) a fusion protein comprising (i) a mature IL15 wild-type, a functional fragment or a variant thereof, with or without a signal peptide and (ii) a heterologous protein (e.g., tPA-IL15);

and/or, (b) the IL15Rα polypeptide is selected from:

(i) the full-length IL15Rα polypeptide (e.g., having the same or essentially the same length as wild-type IL15Rα);

(ii) a functional fragment of the full-length IL15Rα polypeptide, e.g., a truncated (e.g., deletion of carboxy, amino terminal, or internal regions) sequence shorter than an IL15Rα wild-type (e.g, a Sushi domain); but still retaining IL15Rα activity;

(iii) a variant thereof, e.g., full length or truncated IL15Rα polypeptide in which one or more amino acids have been replaced, e.g., variants that retain all or most of the IL15Rα activity of the polypeptide with respect to the wild-type IL15Rα polypeptide (such as natural or artificial variants known in the art); or, (iv) a fusion protein comprising (i) a full length IL15Rα wild-type, a functional fragment or a variant thereof, and (ii) a heterologous protein.

In other embodiments, the IL15 polynucleotide (e.g., a RNA, e.g., an mRNA) encodes two polypeptide chains, the first chain comprising an IL15 polypeptide and the second chain comprising an IL15Rα polypeptide, wherein (a) the IL15 polypeptide is selected from:

(i) the full-length IL15 polypeptide (e.g., having the same or essentially the same length as wild-type TL 5);

(ii) a functional fragment of any of the full-length IL15 polypeptide, e.g., a truncated (e.g., deletion of carboxy, amino terminal, or internal regions) sequence shorter than an IL15 wild-type; but still retaining IL15 activity;

(iii) a variant thereof, e.g., full length or truncated IL15 proteins in which one or more amino acids have been replaced (e.g., variants that retain all or most of the IL15 activity of the polypeptide with respect to the wild-type IL15 polypeptide); or (iv) a fusion protein comprising (i) a full length IL15 wild-type, a functional fragment or a variant thereof, and (ii) a heterologous protein (e.g., tPA-IL15);

and/or, (b) the IL15Rα is selected from:

(i) the full-length IL15Rα polypeptide (e.g., having the same or essentially the same length as wild-type IL15Rα);

(ii) a functional fragment of any of the wild-type IL15Rα polypeptide, e.g., a truncated (e.g., deletion of carboxy, amino terminal, or internal regions) sequence shorter than an IL15Rα wild-type; but still retaining IL15Rα activity (e.g., a Sushi domain);

(iii) a variant thereof, e.g., full length or truncated IL15Rα proteins in which one or more amino acids have been replaced (e.g., variants that retain all or most of the IL15Rα activity of the polypeptide with respect to a reference isoform, such as natural or artificial variants known in the art); or (iv) a fusion protein comprising (i) a full length IL15Rα wild-type, a functional fragment or a variant thereof, and (ii) a heterologous protein.

In certain embodiments, the IL15 polynucleotide (e.g., a RNA, e.g., an mRNA) encodes a mammalian IL15 and/or IL15Rα polypeptide, such as a human IL15 and/or IL15Rα polypeptide, a functional fragment or a variant thereof.

In some embodiments, the IL15 polynucleotide (e.g., an mRNA) comprises an ORF which has the structure:

[IL15R]-[L]-[IL15]

wherein [IL15R] comprises a nucleic acid sequence encoding an extracellular portion of the IL15Ralpha receptor, for example, its Sushi domain, [L] is a nucleic acid sequence encoding a linker, and [L 5] is nucleic acid sequence encoding a mature IL15 polypeptide, e.g., an mature IL15 genetically fuse to a heterologous sequence (e.g., tPA-IL15). polypeptide. In some specific embodiments, the IL15 polynucleotide (e.g., an mRNA) according to the structure disclosed above comprises an ORF encoding an IL15 polypeptide comprising, from N-terminus to C-terminus the following sequences operably linked:

(i) a Sushi Domain of wild-type IL15Ra, as indicated in FIG. 110A;

(ii) a linker, e.g., GGSGGGGSGGGSGGGGSLQ (SEQ ID NO: 1263); and, (iii) a optimized mature IL15, e.g., tPA-IL15, such as SEQ ID NO: 812.

In some embodiments, the IL15 polynucleotide (e.g., a RNA, e.g., an mRNA) increases IL15 and/or IL15Ra protein expression levels and/or detectable IL15 activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to IL15 and/or IL15Ra protein expression levels and/or detectable IL15 activity levels in the cells prior to the administration of the IL15 polynucleotide. IL15 and/or IL15Ra protein expression levels and/or IL15 activity can be measured according to methods know in the art. In some embodiments, the polynucleotide is introduced to the cells in vitro. In some embodiments, the polynucleotide is introduced to the cells in vivo.

In some embodiments, the IL15 polynucleotide (e.g., a RNA, e.g., an mRNA) comprises a nucleotide sequence (e.g., an ORF) that encodes a wild-type human IL15 (e.g., SEQ ID NO: 810 or functional fragment thereof) and/or IL15R (e.g., SEQ ID NO: 808 or a functional fragment thereof).

In some embodiments, the IL15 polynucleotide (e.g., a RNA, e.g., an mRNA) comprises a codon optimized nucleic acid sequence, wherein the open reading frame (ORF) of the codon optimized nucleic sequence is derived from a wild-type IL15Rα and/or IL15 sequence.

In some embodiments, the IL15 polynucleotide (e.g., a RNA, e.g., an mRNA) comprises a nucleotide sequence encoding IL15 and/or IL15Rα having the full length sequence of human IL15 and/or IL15Rα, i.e., including initiator methionine, signal peptide, and propeptide (in the case of IL15).

In mature human IL15 and IL15Rα, the initiator methionine, signal peptide and propeptide (in the case of IL15) can be removed to yield a "mature IL15" and "mature IL15Rα" comprising amino acid residues of SEQ ID NO: 810 and SEQ ID NO: 808, respectively.

SEQ ID NO: 808 corresponds to amino acids 23 to 328 of SEQ ID NO: 857 or amino acids 24 to 329 of SEQ ID NO: 858, and SEQ ID NO: 810 corresponds to amino acids 336 to 532 of SEQ ID NO: 857 or 337 to 533 of SEQ ID NO: 858, respectively.

The teachings of the present disclosure directed to the full sequence of human IL15 and/or IL15Rα are also applicable to the mature form of human IL15 and/or IL15Rα lacking the initiator methionine and/or the signal peptide. Thus, in some embodiments, the IL15 polynucleotide (e.g., a RNA, e.g., an mRNA) comprises a nucleotide sequence encoding IL15 and/or IL15Rα having the mature sequence of human IL15 and/or IL15Rα. In some embodiments, the IL15 polynucleotide (e.g., a RNA, e.g., an mRNA) comprising a nucleotide sequence encoding IL15 and/or IL15Rα is sequence optimized.

In some embodiments, the IL15 polynucleotide (e.g., a RNA, e.g., an mRNA) comprises a nucleotide sequence (e.g., an ORF) encoding a mutant IL15 and/or IL15Rα polypeptide. In some embodiments, the IL15 polynucleotide comprises an ORF encoding a IL15 and/or IL15Rα polypeptide that comprises at least one point mutation in the IL15 and/or IL15Rα sequence and retains IL15 and/or IL15Rα activity.

In some embodiments, the mutant IL15 and/or IL15Rα polypeptide has a IL15 and/or IL15Rα activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL15 and/or IL15Rα activity of the corresponding wild-type IL15 and/or IL15Rα (i.e., the same IL15 and/or IL15Rα but without the mutation(s)).

In some embodiments, the IL15 polynucleotide (e.g., a RNA, e.g., an mRNA) comprising an ORF encoding a mutant IL15 and/or IL15Rα polypeptide is sequence optimized.

In some embodiments, the IL15 polynucleotide (e.g., a RNA, e.g., an mRNA) comprises a nucleotide sequence (e.g., an ORF) that encodes a IL15 and/or IL15Rα polypeptide with mutations that do not alter IL15 and/or IL15Rα activity. Such mutant IL15 and/or IL15Rα polypeptides can be referred to as function-neutral. In some embodiments, the IL15 polynucleotide comprises an ORF that encodes a mutant IL15 and/or IL15Rα polypeptide comprising one or more function-neutral point mutations.

In some embodiments, the mutant IL15 and/or IL15Rα polypeptide has higher IL15 and/or IL15Rα activity than the corresponding wild-type IL15 and/or IL15Rα. In some embodiments, the mutant IL15 and/or IL15Rα polypeptide has a IL15 and/or IL15Rα activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type IL15 and/or IL15Rα (i.e., the same IL15 and/or IL15Rα but without the mutation(s)).

In some embodiments, the IL15 polynucleotide (e.g., a RNA, e.g., an mRNA) comprises a nucleotide sequence (e.g., an ORF) encoding a functional IL15 and/or IL15Rα fragment, e.g., where one or more fragments correspond to a polypeptide subsequence of a wild-type IL15 and/or IL15Rα polypeptide and retain IL15 and/or IL15Rα activity. In some embodiments, the IL15 and/or IL15Rα fragment has a IL15 and/or IL15Rα activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL15 and or IL15Rα activity of the corresponding full length IL15 and/or IL15Rα. In some embodiments, the IL15 polynucleotide (e.g., a RNA, e.g., an mRNA) comprising an ORF encoding a functional IL15 and/or IL15Rα fragment is sequence optimized.

In some embodiments, the IL15 polynucleotide (e.g., a RNA, e.g., an mRNA) comprises a nucleotide sequence (e.g., an ORF) encoding a IL15 and/or IL15Rα fragment that has higher IL15 and/or IL15Rα activity than the corresponding full length IL15 and/or IL15Rα. Thus, in some embodiments the IL15 and/or IL15Rα fragment has a IL15 and/or IL15Rα activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the IL15 and/or IL15Rα activity of the corresponding full length IL15 and/or IL15Rα.

In some embodiments, the IL15 polynucleotide (e.g., a RNA, e.g., an mRNA) comprises a nucleotide sequence (e.g., an ORF) encoding a IL15 and/or IL15Rα fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type IL15 and/or IL15Rα.

In other embodiments, the IL15 polynucleotide (e.g., a RNA, e.g., an mRNA) comprises a nucleotide sequence (e.g., an ORF) encoding an IL15 polypeptide, wherein the ORF has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_007, hIL15RαB_010, or hIL15RαB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_018 or hIL15RαB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_004, hIL15RαB_005, hIL15RαB_013, or hIL15RαB_017;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_001 or hIL15RαB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_012 or hIL15RαB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_022 or hIL15RαB_038;

(viii) at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_024, hiL15RαB_031, hIL15RαB_032, or hIL15RαB_036;

(ix) at least 91%, at least 92%, at least 93%, at least 94%, at least 95%, at least 96%, at least 97%, at least 98%, at least 99%, or 100% sequence identity to nucleotides 159-1076 of hIL15RαB_021, hiL15RαB_023, hiL15RαB_025, hiL15RαB_026, hIL15RαB_027, hiL15RαB_029, hIL15RαB_030, hiL15RαB_034, hiL15RαB_039, or hIL15RαB_040;

(x) at least 92%, at least 93%, at least 94%, at least 95%, at least 96%, at least 97%, at least 98%, at least 99%, or 100% sequence identity to nucleotides 159-1076 of hIL15RαB_016, hIL15RαB_035, or hIL15RαB_037;

(xi) at least 93%, at least 94%, at least 95%, at least 96%, at least 97%, at least 98%, at least 99%, or 100% sequence identity to nucleotides 159-1076 of hIL15RαB_011, hIL15RαB_028, or hIL15RαB_033;

(xii) at least 94%, at least 95%, at least 96%, at least 97%, at least 98%, at least 99%, or 100% sequence identity to nucleotides 159-1076 of hIL15RαB_015;

(xiii) at least 95%, at least 96%, at least 97%, at least 98%, at least 99%, or 100% sequence identity to nucleotides 159-1076 of hiL15RαB_020;

(xiv) 100% sequence identity to nucleotides 159-1076 of hiL15RαB_006;

(xv) at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO01 to IL15opt-tPa-CO5 or IL15opt-tPa-CO7 to IL15opt-tPa-CO50;

(xvi) at least 82%, at least 83%, at least 84%, at least 85%, at least 86%, at least 87%, at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO06;

(xvii) at least 88%, 89%, 90%, at least 91%, at least 92%, at least 93%, at least 94%, at least 95%, at least 96%, at least 97%, at least 98%, at least 99%, or 100% sequence identity to nucleotides 85 to 318 of IL15_RLI-CO01 to IL15_RLI-CO025; or (xviii) at least 88%, 89%, 90%, at least 91%, at least 92%, at least 93%, at least 94%, at least 95%, at least 96%, at least 97%, at least 98%, at least 99%, or 100% sequence identity to nucleotides 757-990 of IL15_Fc_RLI-CO01 to IL15_Fc_RLI-CO25.

In other embodiments, the IL5 polynucleotide (e.g., a RNA, e.g., an mRNA) comprises a nucleotide sequence (e.g., an ORF) encoding an IL15Rα polypeptide, wherein the ORF has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_007, hIL15RαB_010, or hIL15RαB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_018 or hIL15RαB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hiL15RαB_004, hIL15RαB_005, hIL15RαB_013, or hIL15RαB_017;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_001 or hIL15RαB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_012 or hIL15RαB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_022 or hIL15RαB_038;

(viii) at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_024, hiL15RαB_031, hIL15RαB_032, or hIL15RαB_036;

(ix) at least 91%, at least 92%, at least 93%, at least 94%, at least 95%, at least 96%, at least 97%, at least 98%, at least 99%, or 100% sequence identity to nucleotides 159-1076 of hIL15RαB_021, hiL15RαB_023, hiL15RαB_025, hiL15RαB_026, hIL15RαB_027, hiL15RαB_029, hiL15RαB_030, hiL15RαB_034, hiL15RαB_039, or hIL15RαB_040;

(x) at least 92%, at least 93%, at least 94%, at least 95%, at least 96%, at least 97%, at least 98%, at least 99%, or 100% sequence identity to nucleotides 159-1076 of hIL15RαB_016, hIL15RαB_035, or hiL15RαB_037;

(xi) at least 93%, at least 94%, at least 95%, at least 96%, at least 97%, at least 98%, at least 99%, or 100% sequence identity to nucleotides 159-1076 of hIL15RαB_011, hIL15RαB_028, or hIL15RαB_033;

(xii) at least 94%, at least 95%, at least 96%, at least 97%, at least 98%, at least 99%, or 100% sequence identity to nucleotides 159-1076 of hIL15RαB_015;

(xiii) at least 95%, at least 96%, at least 97%, at least 98%, at least 99%, or 100% sequence identity to nucleotides 159-1076 of hiL15RαB_020;

(xiv) 100% sequence identity to nucleotides 159-1076 of hiL15RαB_006;

(xv) at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO01 to IL15opt-tPa-CO5 or IL15opt-tPa-CO7 to IL15opt-tPa-CO50;

(xvi) at least 82%, at least 83%, at least 84%, at least 85%, at least 86%, at least 87%, at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO06;

(xvii) at least 88%, 89%, 90%, at least 91%, at least 92%, at least 93%, at least 94%, at least 95%, at least 96%, at least 97%, at least 98%, at least 99%, or 100% sequence identity to nucleotides 85 to 318 of IL15_RLI-CO01 to IL15_RLI-CO025; or (xviii) at least 88%, 89%, 90%, at least 91%, at least 92%, at least 93%, at least 94%, at least 95%, at least 96%, at least 97%, at least 98%, at least 99%, or 100% sequence identity to nucleotides 757-990 of IL15_Fc_RLI-CO01 to IL15_Fc_RLI-CO25.

In certain embodiments, the IL5 polynucleotide (e.g., a RNA, e.g., an mRNA) of the disclosure comprises a first ORF encoding IL15 and a second ORF encoding IL15Rα, wherein the first ORF comprises a sequence that has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_007, hIL15RαB_010, or hIL15RαB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_018 or hIL15RαB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hiL15RαB_004, hIL15RαB_005, hIL15RαB_013, or hIL15RαB_017;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_001 or hIL15RαB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_012 or hIL15RαB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_022 or hIL15RαB_038;

(viii) at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_024, hiL15RαB_031, hIL15RαB_032, or hIL15RαB_036;

(ix) at least 91%, at least 92%, at least 93%, at least 94%, at least 95%, at least 96%, at least 97%, at least 98%, at least 99%, or 100% sequence identity to nucleotides 159-1076 of hIL15RαB_021, hiL15RαB_023, hiL15RαB_025, hiL15RαB_026, hIL15RαB_027, hiL15RαB_029, hIL15RαB_030, hiL15RαB_034, hIL15RαB_039, or hIL15RαB_040;

(x) at least 92%, at least 93%, at least 94%, at least 95%, at least 96%, at least 97%, at least 98%, at least 99%, or 100% sequence identity to nucleotides 159-1076 of hIL15RαB_016, hIL15RαB_035, or hIL15RαB_037;

(xi) at least 93%, at least 94%, at least 95%, at least 96%, at least 97%, at least 98%, at least 99%, or 100% sequence identity to nucleotides 159-1076 of hIL15RαB_011, hIL15RαB_028, or hIL15RαB_033;

(xii) at least 94%, at least 95%, at least 96%, at least 97%, at least 98%, at least 99%, or 100% sequence identity to nucleotides 159-1076 of hIL15RαB_015;

(xiii) at least 95%, at least 96%, at least 97%, at least 98%, at least 99%, or 100% sequence identity to nucleotides 159-1076 of hiL15RαB_020; or, (xiv) 100% sequence identity to nucleotides 159-1076 of hiL15RαB_006;

(xv) at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-$CO_{01}$ to IL15opt-tPa-CO5 or IL15opt-tPa-CO7 to IL15opt-tPa-CO50;

(xvi) at least 82%, at least 83%, at least 84%, at least 85%, at least 86%, at least 87%, at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO06;

(xvii) at least 88%, 89%, 90%, at least 91%, at least 92%, at least 93%, at least 94%, at least 95%, at least 96%, at least 97%, at least 98%, at least 99%, or 100% sequence identity to nucleotides 85 to 318 of IL15_RLI-CO01 to IL15_RLI-CO025; or, (xviii) at least 88%, 89%, 90%, at least 91%, at least 92%, at least 93%, at least 94%, at least 95%, at least 96%, at least 97%, at least 98%, at least 99%, or 100% sequence identity to nucleotides 757-990 of IL15_Fc_RLI-CO01 to IL15_Fc_RLI-CO25; or wherein the second ORF has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_007, hIL15RαB_010, or hIL15RαB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_018 or hIL15RαB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hiL15RαB_004, hIL15RαB_005, hIL15RαB_013, or hIL15RαB_017;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_001 or hIL15RαB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_012 or hIL15RαB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_022 or hIL15RαB_038;

(viii) at least 90%, at least 91%, at least 92%, at least 93%, at least 94%, at least 95%, at least 96%, at least 97%, at least 98%, at least 99%, or 100% sequence identity to nucleotides 159-1076 of hIL15RαB_024, hiL15RαB_031, hIL15RαB_032, or hIL15RαB_036;

(ix) at least 91%, at least 92%, at least 93%, at least 94%, at least 95%, at least 96%, at least 97%, at least 98%, at least 99%, or 100% sequence identity to nucleotides 159-1076 of hIL15RαB_021, hiL15RαB_023, hiL15RαB_025, hiL15RαB_026, hIL15RαB_027, hiL15RαB_029, hIL15RαB_030, hiL15RαB_034, hiL15RαB_039, or hIL15RαB_040;

(x) at least 92%, at least 93%, at least 94%, at least 95%, at least 96%, at least 97%, at least 98%, at least 99%, or 100% sequence identity to nucleotides 159-1076 of hIL15RαB_016, hIL15RαB_035, or hIL15RαB_037;

(xi) at least 93%, at least 94%, at least 95%, at least 96%, at least 97%, at least 98%, at least 99%, or 100% sequence identity to nucleotides 159-1076 of hIL15RαB_011, hIL15RαB_028, or hIL15RαB_033;

(xii) at least 94%, at least 95%, at least 96%, at least 97%, at least 98%, at least 99%, or 100% sequence identity to nucleotides 159-1076 of hIL15RαB_015;

(xiii) at least 95%, at least 96%, at least 97%, at least 98%, at least 99%, or 100% sequence identity to nucleotides 159-1076 of hiL15RαB_020;

(xiv) 100% sequence identity to nucleotides 159-1076 of hiL15RαB_006;

(xv) at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO01 to IL15opt-tPa-CO5 or IL15opt-tPa-CO7 to IL15opt-tPa-CO50;

(xvi) at least 82%, at least 83%, at least 84%, at least 85%, at least 86%, at least 87%, at least 88%, 89%, 90%, at least 91%, at least 92%, at least 93%, at least 94%, at least 95%, at least 96%, at least 97%, at least 98%, at least 99%, or 100% sequence identity to nucleotides 106 to 447 of IL15opt-tPa-CO06;

(xvii) at least 88%, 89%, 90%, at least 91%, at least 92%, at least 93%, at least 94%, at least 95%, at least 96%, at least 97%, at least 98%, at least 99%, or 100% sequence identity to nucleotides 85 to 318 of IL15_RLI-CO01 to IL15_RLI-CO025; or (xviii) at least 88%, 89%, 90%, at least 91%, at least 92%, at least 93%, at least 94%, at least 95%, at least 96%, at least 97%, at least 98%, at least 99%, or 100% sequence identity to nucleotides 757-990 of IL15_Fc_RLI-CO01 to IL15_Fc_RLI-CO25.

In one embodiment, the first ORF encoding the IL15 polypeptide and the second ORF encoding the IL15Rα polypeptide are fused directly or by a linker. In another embodiment, the first ORF encoding the IL15 polypeptide and the second ORF encoding the IL15Rα polypeptide are not fused to each other.

In some embodiments, the IL15 polynucleotide (e.g., a RNA, e.g., an mRNA) comprises a nucleotide sequence (e.g., an ORF) encoding a IL15-IL15Rα fusion polypeptide (e.g., the wild-type sequence, functional fragment, or variant thereof), wherein the nucleotide sequence has at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any sequence disclosed in TABLE 10 or TABLE 11.

In some embodiments, the IL15 polynucleotide (e.g., a RNA, e.g., an mRNA) comprises a nucleotide sequence (e.g., an ORF) encoding a IL15-IL15Rα fusion polypeptide (e.g., the wild-type sequence, functional fragment, or variant thereof), wherein the nucleotide sequence has 70% to 100%, 75% to 100%, 80% to 100%, 85% to 100%, 70% to 95%, 80% to 95%, 70% to 85%, 75% to 90%, 80% to 95%, 70% to 75%, 75% to 80%, 80% to 85%, 85% to 90%, 90% to 95%, or 95% to 100%, sequence identity to any sequence disclosed in TABLE 10 or TABLE 11.

In some embodiments, the IL15 polynucleotide (e.g., a RNA, e.g., an mRNA) comprises from about 100 to about 100,000 nucleotides (e.g., from 100 to 1,000, from 100 to 1,100, from 100 to 1,200, from 100 to 1,300, from 100 to 1,400, from 100 to 1,500, from 300 to 1,100, from 300 to 1,100, from 300 to 1,200, from 300 to 1,300, from 300 to 1,400, from 300 to 1,500, from 342 to 1,200, from 342 to 1,400, from 342 to 1,600, from 342 to 1,800, from 342 to 2,000, from 342 to 3,000, from 342 to 5,000, from 342 to 7,000, from 342 to 10,000, from 342 to 25,000, from 342 to 50,000, from 342 to 70,000, or from 342 to 100,000).

In some embodiments, the IL15Rα polynucleotide (e.g., a RNA, e.g., an mRNA) comprises from about 500 to about 100,000 nucleotides (e.g., from 500 to 1,000, from 500 to 1,100, from 500 to 1,200, from 500 to 1,300, from 500 to 1,400, from 500 to 1,500, from 600 to 1,100, from 600 to 1,100, from 600 to 1,200, from 600 to 1,300, from 600 to 1,400, from 600 to 1,500, from 711 to 1,200, from 711 to 1,400, from 711 to 1,600, from 711 to 1,800, from 711 to 2,000, from 711 to 3,000, from 711 to 5,000, from 711 to 7,000, from 711 to 10,000, from 711 to 25,000, from 711 to 50,000, from 711 to 70,000, or from 711 to 100,000).

In some embodiments, the IL15 polynucleotide (e.g., a RNA, e.g., an mRNA) comprises a nucleotide sequence (e.g., an ORF) encoding a IL15-IL15Rα fusion polypeptide (e.g., the wild-type sequence, functional fragment, or variant thereof), wherein the length of the nucleotide sequence (e.g., an ORF) is at least 500 nucleotides in length (e.g., at least or greater than about 500, 600, 700, 80, 900, 1,000, 1,050, 1,083, 1,100, 1,200, 1,300, 1,400, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IL15 polynucleotide (e.g., a RNA, e.g., an mRNA) comprises a nucleotide sequence (e.g., an ORF) encoding a IL15 and/or IL15Rα polypeptide (e.g., the wild-type sequence, functional fragment, or variant thereof) further comprises at least one nucleic acid sequence that is noncoding, e.g., a miRNA binding site.

In some embodiments, the IL15 polynucleotide (e.g., a RNA, e.g., an mRNA) comprises a nucleotide sequence (e.g., an ORF) encoding a IL15 and/or IL15Rα polypeptide is single stranded or double stranded.

In some embodiments, the IL15 polynucleotide comprising a nucleotide sequence (e.g., an ORF) encoding a IL15 and/or IL15Rα polypeptide (e.g., the wild-type sequence, functional fragment, or variant thereof) is DNA or RNA. In some embodiments, the IL15 polynucleotide is RNA. In some embodiments, the IL15 polynucleotide is, or functions as, a messenger RNA (mRNA). In some embodiments, the mRNA comprises a nucleotide sequence (e.g., an ORF) that encodes at least one IL15 and/or IL15Rα polypeptide, and is capable of being translated to produce the encoded IL15 and/or IL15Rα polypeptide in vitro, in vivo, in situ or ex vivo.

In some embodiments, the IL15 polynucleotide (e.g., a RNA, e.g., an mRNA) comprises a sequence-optimized nucleotide sequence (e.g., an ORF) encoding a IL15 and/or IL15Rα polypeptide (e.g., the wild-type sequence, functional fragment, or variant thereof), wherein the polynucleotide comprises at least one chemically modified nucleobase, e.g., 5-methoxyuracil. In some embodiments, the IL15 polynucleotide further comprises a miRNA binding site, e.g., a miRNA binding site that binds to miR-122. In some embodiments, the IL15 polynucleotide disclosed herein is formulated with a delivery agent, e.g., a compound having Formula (I), e.g., any of Compounds 1-147.

The IL15 polynucleotides (e.g., a RNA, e.g., an mRNA) disclosed herein can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the IL15 polynucleotide (e.g., a RNA, e.g., an mRNA) comprises a nucleotide sequence (e.g., an ORF) that encodes a signal peptide operably linked a nucleotide sequence that encodes a IL15 and/or IL15Rα polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the IL15 polypeptide, respectively. Addition of these sequences results in trafficking the encoded IL15 polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the IL15 polynucleotide comprises a nucleotide sequence encoding an IL15 and/or IL15Rα polypeptide, wherein the nucleotide sequence further comprises a 5' nucleic acid sequence encoding a native signal peptide. In another embodiment, the IL15 polynucleotide comprises a nucleotide sequence encoding an IL15 and/or IL15Rα polypeptide, wherein the nucleotide sequence lacks the nucleic acid sequence encoding a native signal peptide. In some embodiments, the IL15 polynucleotide comprises a nucleotide sequence encoding a IL15 and/or IL15Rα polypeptide, wherein the nucleotide sequence further comprises a 5' nucleic acid sequence encoding a heterologous signal peptide.

Sequence-Optimized Nucleotide Sequences Encoding IL15 and/or IL15Rα Polypeptides:

In some embodiments, the IL15 polynucleotide (e.g., a RNA, e.g., an mRNA) comprises a sequence-optimized nucleotide sequence encoding a IL15 and/or IL15Rα polypeptide disclosed herein. In some embodiments, the IL15 polynucleotide comprises an open reading frame (ORF) encoding a IL15 and/or IL15Rα polypeptide, wherein the ORF has been sequence optimized.

Exemplary sequence-optimized nucleotide sequences encoding human IL15 and/or IL15Rα are shown in TABLE 10 and TABLE 11. In some embodiments, the sequence optimized IL15 and/or IL15Rα sequences in TABLE 10 and TABLE 11, fragments, and variants thereof are used to practice the methods disclosed herein. In some embodiments, the sequence optimized IL15 and/or IL15Rα sequences in TABLE 10 and TABLE 11, fragments and variants thereof are combined with or alternatives to the wild-type sequences (SEQ ID NOS: 1-4).

TABLE 10

| Optimized sequences encoding human IL15, IL15Ra, or IL15Ra-IL15 fusion |
|---|
| >hIL15RαB_001 (SEQ ID NO: 814)<br>ATGTGTCACCAGCAGCTGGTCATTAGCTGGTTTAGCCTTGTGTTCCTGGCCTCCCCCCTTGTCGCTATTTGGGAGCTCAAGAAGG<br>ACGTGTACGTGGTGGAGCTGGACTGGTACCCAGACGCGCCCGGAGAGATGGTAGTTCTGACCTGTGATACCCCAGAGGAGGACGG<br>CATCACCTGGACTCTGGACCAAAGCAGCGAGGTTTTGGGCTCAGGGAAAACGCTGACCATCCAGGTGAAGGAATTCGGCGACGCC<br>GGACAGTACACCTGCCATAAGGGAGGAGAGGTGCTGAGCCATTCCCTTCTTCTGCTGCACAAGAAAGAGGACGGCATCTGGTCTA<br>CCGACATCCTGAAAGACCAGAAGGAGCCCAAGAACAAAACCTTCCTGAGGTGCGAGGCCAAGAACTACTCCGGCAGGTTCACTTG<br>TTGGTGGCTGACCACCATCAGTACAGACCTGACTTTTAGTGTAAAAAGCTCCAGAGGCTCGTCCGATCCCCAAGGGGTGACCTGC<br>GGCGCAGCCACTCTGAGCGCTGAGCGCGTGCGCGGTGACAATAAAGAGTACGAGTACAGCGTTGAGTGTCAAGAAGACAGCGCTT<br>GCCCTGCCGCCGAGGAGAGCCTGCCTATCGAGGTGATGGTTGACGCAGTGCACAAGCTTAAGTACGAGAATTACACCAGCTCATT<br>CTTCATTAGAGATATAATCAAGCCTGACCCACCCAAGAACCTGCAGCTGAAGCCACTGAAAAACTCACGGCAGGTCGAAGTGAGC<br>TGGGAGTACCCCGACACCTGGAGCACTCCTCATTCCTATTTCTCTCTTACATTCTGCGTCCAGGTGCAGGGCAAGAGCAAGCGGG<br>AAAAGAAGGATCGAGTCTTCACCGACAAAACAAGCGCGACCGTGATTTGCAGGAAGAACGCCAGCATCTCCGTCAGAGCCCAGGA<br>TAGATACTATAGTAGCAGCTGGAGCGAGTGGGCAAGCGTGCCCTGTTCCGGCGGCGGGGGCGGGGGCAGCCGAAACTTGCCTGTC<br>GCTACCCCGGACCCTGGAATGTTTCCGTGTCTGCACCACAGCCAGAACCTGCTGAGAGCCGTGTCGAATATGCTCCAGAAGGCCC<br>GGCAGACCCTTGAGTTCTACCCCTGTACCAGCGAAGAGATCGATCATGAGGACATCACGAAAGACAAGACTTCCACCGTCGAGGC<br>TTGTCTCCCGCTGGAGCTGACCAAGAACGAGAGCTGTCTGAATAGCCGGGAGACATCTTTCATCACGAATGGTAGCTGTCTGGCC<br>AGCAGGAAAACTTCCTTCATGATGGCTCTCTGCCTGAGCTCTATCTATGAAGATCTGAAGATGTATCAGGTGGAGTTTAAGACTA<br>TGAACGCCAAACTCCTGATGGACCCAAAAAGGCAAATCTTTCTGGACCAGAATATGCTGGCCGTGATAGACGAGCTGATGCAGGC<br>ACTGAACTTCAACAGCGAGACAGTGCCACAGAAATCCAGCCTGGAGGAGCCTGACTTTTACAAAACTAAGATCAAGCTGTGTATC<br>CTGCTGCACGCCTTTAGAATCCGTGCCGTGACTATCGACAGGGTGATGTCATACCTCAACGCTTCA |
| >hIL15RαB_002(SEQ ID NO: 815)<br>ATGTGCCACCAGCAGCTGGTGATCAGCTGGTTCAGCCTGGTGTTCCTGGCCAGCCCCCTGGTGGCCATCTGGGAGCTGAAGAAGG<br>ACGTGTACGTGGTGGAGCTGGACTGGTACCCCGACGCCCCCGGCGAGATGGTGGTGCTGACCTGCGACACCCCCGAGGAGGACGG<br>CATCACCTGGACCCTGGACCAGAGCAGCGAGGTGCTGGGCAGCGGCAAGACCCTGACCATCCAGGTGAAGGAGTTCGGCGACGCC<br>GGCCAGTACACCTGCCACAAGGGCGGCGAGGTGCTGAGCCACAGCCTGCTGCTGCTGCACAAGAAGGAGGACGGCATCTGGAGCA |

TABLE 10-continued

Optimized sequences encoding human IL15, IL15Ra, or IL15Ra-IL15 fusion

CCGACATCCTGAAGGACCAGAAGGAGCCCAAGAACAAGACCTTCCTGAGATGCGAGGCCAAGAACTACAGCGGCAGATTCACCTG
CTGGTGGCTGACCACCATCAGCACCGACCTGACCTTCAGCGTGAAGAGCAGCAGAGGCAGCAGCGACCCCCAGGGCGTGACCTGC
GGCGCCGCCACCCTGAGCGCCGAGAGAGTGAGAGGCGACAACAAGGAGTACGAGTACAGCGTGGAGTGCCAGGAGGACAGCGCCT
GCCCCGCCGCCGAGGAGAGCCTGCCCATCGAGGTGATGGTGGACGCCGTGCACAAGCTGAAGTACGAGAACTACACCAGCAGCTT
CTTCATCAGAGACATCATCAAGCCCGACCCCCCCAAGAACCTGCAGCTGAAGCCCCTGAAGAACAGCAGACAGGTGGAGGTGAGC
TGGGAGTACCCCGACACCTGGAGCACCCCCCACAGCTACTTCAGCCTGACCTTCTGCGTGCAGGTGCAGGGCAAGAGCAAGAGAG
AGAAGAAGGACAGAGTGTTCACCGACAAGACCAGCGCCACCGTGATCTGCAGAAAGAACGCCAGCATCAGCGTGAGAGCCCAGGA
CAGATACTACAGCAGCAGCTGGAGCGAGTGGGCCAGCGTGCCCTGCAGCGGCGGCGGCGGCGGCAGCAGAAACCTGCCCGTG
GCCACCCCCGACCCCGGCATGTTCCCCTGCCTGCACCACAGCCAGAACCTGCTGAGAGCCGTGAGCAACATGCTGCAGAAGGCCA
GACAGACCCTGGAGTTCTACCCCTGCACCAGCGAGGAGATCGACCACGAGGACATCACCAAGGACAAGACCAGCACCGTGGAGGC
CTGCCTGCCCCTGGAGCTGACCAAGAACGAGAGCTGCCTGAACAGCAGAGAGACCAGCTTCATCACCAACGGCAGCTGCCTGGCC
AGCAGAAAGACCAGCTTCATGATGGCCCTGTGCCTGAGCAGCATCTACGAGGACCTGAAGATGTACCAGGTGGAGTTCAAGACCA
TGAACGCCAAGCTGCTGATGGACCCCAAGAGACAGATCTTCCTGGACCAGAACATGCTGGCCGTGATCGACGAGCTGATGCAGGC
CCTGAACTTCAACAGCGAGACCGTGCCCCAGAAGAGCAGCCTGGAGGAGCCCGACTTCTACAAGACCAAGATCAAGCTGTGCATC
CTGCTGCACGCCTTCAGAATCAGAGCCGTGACCATCGACAGAGTGATGAGCTACCTGAACGCCAGC

>hIL15RαB_003(SEQ ID NO: 816)
ATGTGTCACCAGCAGTTGGTCATCTCTTGGTTTTCCCTGGTTTTTCTGGCATCTCCCCTCGTGGCCATATGGGAACTGAAGAAAG
ATGTTTATGTCGTAGAATTGGATTGGTATCCGGATGCCCCTGGAGAAATGGTGGTCCTCACCTGTGACACCCCTGAAGAAGATGG
TATCACCTGGACCTTGGACCAGAGCAGTGAGGTCTTAGGCTCTGGCAAAACCCTGACCATCCAAGTCAAAGAGTTTGGAGATGCT
GGCCAGTACACCTGTCACAAAGGAGGCGAGGTTCTAAGCCATTCGCTCCTGCTGCTTCACAAAAAGGAAGATGGAATTTGGTCCA
CTGATATTTTAAAGGACCAGAAAGAACCCAAAAATAAGACCTTTCTAAGATGCGAGGCCAAGAATTATTCTGGACGTTTCACCTG
CTGGTGGCTGACGACAATCAGTACTGATTTGACATTCAGTGTCAAAAGCAGCAGAGGCTCTTCTGACCCCCAAGGGGTGACGTGC
GGAGCTGCTACACTCTCTGCAGAGAGAGTCAGAGGGGACAACAAGGAGTATGAGTACTCAGTGGAGTGCCAGGAGGACAGTGCCT
GCCCAGCTGCTGAGGAGAGTCTGCCCATTGAGGTCATGGTGGATGCCGTTCACAAGCTCAAGTATGAAAACTACACCAGCAGCTT
CTTCATCAGGGACATCATCAAACCTGACCCACCCAAGAACTTGCAGCTGAAGCCATTAAAGAATTCTCGGCAGGTGGAGGTCAGC
TGGGAGTACCCTGACACCTGGAGTACTCCACATTCCTACTTCTCCCTGACATTCTGCGTTCAGGTCCAGGGCAAGAGCAAGAGAG
AAAAGAAAGATAGAGTCTTCACGGACAAGACCTCAGCCACGGTCATCTGCCGCAAAAATGCCAGCATTAGCGTGCGGGCCCAGGA
CCGCTACTATAGCTCATCTTGGAGCGAATGGGCATCTGTGCCCTGCAGTGGCGGAGGGGGCGGAGGGAGCAGAAACCTCCCCGTG
GCCACTCCAGACCCAGGAATGTTCCCATGCCTTCACCACTCCCAAAACCTGCTGAGGGCCGTCAGCAACATGCTCCAGAAGGCCA
GACAAACTTTAGAATTTTACCCTTGCACTTCTGAAGAGATTGATCATGAAGATATCACAAAAGATAAAACCAGCACAGTGGAGGC
CTGTTTACCATTGGAATTAACCAAGAATGAGAGTTGCCTAAATTCCAGAGAGACCTCTTTCATAACTAATGGGAGTTGCCTGGCC
TCCAGAAAGACCTCTTTTATGATGGCCCTGTGCCTTAGTAGTATTTATGAAGACTTGAAGATGTACCAGGTGGAGTTCAAGACCA
TGAATGCAAAGCTTCTGATGGATCCTAAGAGGCAGATCTTTTTAGATCAAAACATGCTGGCAGTTATTGATGAGCTGATGCAGGC
CCTGAATTTCAACAGTGAGACTGTGCCACAAAAATCCTCCCTTGAAGAACCGGACTTCTACAAGACCAAGATCAAGCTCTGCATA
CTTCTTCATGCTTTCAGAATTCGGGCAGTGACTATTGATAGAGTGATGAGCTATCTGAATGCTTCC

>hIL15RαB_004 (SEQ ID NO: 817)
ATGGGCTGCCACCAGCAGCTGGTCATCAGCTGGTTCTCCCTGGTCTTCCTGGCCAGCCCCCTGGTGGCCATCTGGGAGCTGAAGA
AAGATGTCTATGTTGTAGAGCTGGACTGGTACCCAGATGCTCCTGGAGAAATGGTGGTTCTCACCTGTGACACGCCAGAAGAAGA
TGGCATCACCTGGACGCTGGACCAGAGCTCAGAAGTTCTTGGCAGTGGAAAAACGCTGACCATACAAGTAAAAGAATTTGGGGAT
GCTGGCCAGTACACCTGCCACAAAGGAGGAGAAGTTCTCAGCCACAGCCTGCTGCTGCTGCACAAGAAAGAAGATGGCATCTGGA
GCACAGACATTTTAAAAGACCAGAAGGAGCCCAAGAACAAAACCTTCCTTCGATGTGAGGCCAAGAACTACAGTGGCCGCTTCAC
CTGCTGGTGGCTCACCACCATCAGCACAGACCTCACCTTCTCGGTGAAGAGCAGCCGTGGCAGCTCAGACCCCCAAGGAGTCACC
TGTGGGGCGGCCACGCTGTCGGCAGAAAGAGTTCGAGGGGACAACAAGGAATATGAATACTCGGTGGAATGTCAAGAAGACTCGG
CCTGCCCGGCGGCAGAAGAAAGTCTTCCCATAGAAGTCATGGTGGATGCTGTTCACAAATTAAAATATGAAAACTACACCAGCAG
CTTCTTCATCAGAGACATCATCAAGCCAGACCCGCCCAAGAACCTGCAGCTGAAGCCCCTGAAGAACAGCAGACAAGTGGAAGTT
TCCTGGGAGTACCCAGACACGTGGAGCACGCCGCACAGCTACTTCAGCCTCACCTTCTGTGTACAAGTACAAGGCAAGAGCAAGA
GAGAGAAGAAAGATCGTGTCTTCACAGACAAAACCTCGGCGACGGTCATCTGCAGGAAGAATGCCTCCATCTCGGTTCGAGCCCA
GGACCGCTACTACAGCAGCAGCTGGAGTGAGTGGGCCTCGGTGCCCTGCAGTGGTGGCGGCGGCGGCGGCAGCAGAAACCTTCCT
GTGGCCACGCCGGACCCTGGCATGTTCCCGTGCCTGCACCACAGCCAAAATTTACTTCGAGCTGTTTCTAACATGCTGCAGAAAG
CAAGACAAACTTTAGAATTCTACCCCTGCACCTCAGAAGAAATAGACCATGAAGACATCACCAAAGATAAAACCAGCACTGTAGA
GGCCTGCCTGCCCCTGGAGCTCACCAAGAATGAATCCTGCCTCAACAGCAGAGAGACCAGCTTCATCACCAATGGCAGCTGCCTG
GCCAGCAGGAAAACCAGCTTCATGATGGCGCTCTGCCTGAGCAGCATCTATGAAGATTTGAAGATGTACCAAGTAGAATTTAAAA
CCATGAATGCCAAGCTGCTCATGGACCCCAAGAGACAAATATTTTTGGATCAAAACATGCTGGCTGTCATTGATGAGCTCATGCA
AGCATTAAACTTCAACTCAGAGACGGTGCCCCAGAAGAGCAGCCTGGAGGAGCCAGACTTCTACAAAACCAAGATCAAGCTCTGC
ATCTTATTACATGCCTTCCGCATCCGGGCGGTCACCATTGACCGTGTCATGTCCTACTTAAATGCCAGC

>hIL15RαB_005 (SEQ ID NO: 818)
ATGTGCCACCAGCAGCTGGTCATCAGCTGGTTCTCCCTGGTCTTCCTGGCCAGCCCCCTGGTGGCCATCTGGGAGCTGAAGAAAG
ATGTCTATGTTGTAGAGCTGGACTGGTACCCAGATGCTCCTGGAGAAATGGTGGTTCTCACCTGTGACACGCCAGAAGAAGATGG
CATCACCTGGACGCTGGACCAGAGCTCAGAAGTTCTTGGCAGTGGAAAAACGCTGACCATACAAGTAAAAGAATTTGGGGATGCT
GGCCAGTACACCTGCCACAAAGGAGGAGAAGTTCTCAGCCACAGCCTGCTGCTGCTGCACAAGAAAGAAGATGGCATCTGGAGCA
CAGACATTTTAAAAGACCAGAAGGAGCCCAAGAACAAAACCTTCCTTCGATGTGAGGCCAAGAACTACAGTGGCCGCTTCACCTG
CTGGTGGCTCACCACCATCAGCACAGACCTCACCTTCTCGGTGAAGAGCAGCCGTGGCAGCTCAGACCCCCAAGGAGTCACCTGT
GGGGCGGCCACGCTGTCGGCAGAAAGAGTTCGAGGGGACAACAAGGAATATGAATACTCGGTGGAATGTCAAGAAGACTCGGCCT
GCCCGGCGGCAGAAGAAAGTCTTCCCATAGAAGTCATGGTGGATGCTGTTCACAAATTAAAATATGAAAACTACACCAGCAGCTT
CTTCATCAGAGACATCATCAAGCCAGACCCGCCCAAGAACCTGCAGCTGAAGCCCCTGAAGAACAGCAGACAAGTGGAAGTTTCC
TGGGAGTACCCAGACACGTGGAGCACGCCGCACAGCTACTTCAGCCTCACCTTCTGTGTACAAGTACAAGGCAAGAGCAAGAGAG
AGAAGAAAGATCGTGTCTTCACAGACAAAACCTCGGCGACGGTCATCTGCAGGAAGAATGCCTCCATCTCGGTTCGAGCCCAGGA
CCGCTACTACAGCAGCAGCTGGAGTGAGTGGGCCTCGGTGCCCTGCAGTGGTGGCGGCGGCGGCGGCAGCAGAAACCTTCCTGTG
GCCACGCCGGACCCTGGCATGTTCCCGTGCCTGCACCACAGCCAAAATTTACTTCGAGCTGTTTCTAACATGCTGCAGAAAGCAA
GACAAACTTTAGAATTCTACCCCTGCACCTCAGAAGAAATAGACCATGAAGACATCACCAAAGATAAAACCAGCACTGTAGAGGC
CTGCCTGCCCCTGGAGCTCACCAAGAATGAATCCTGCCTCAACAGCAGAGAGACCAGCTTCATCACCAATGGCAGCTGCCTGGCC
AGCAGGAAAACCAGCTTCATGATGGCGCTCTGCCTGAGCAGCATCTATGAAGATTTGAAGATGTACCAAGTAGAATTTAAAACCA
TGAATGCCAAGCTGCTCATGGACCCCAAGAGACAAATATTTTTGGATCAAAACATGCTGGCTGTCATTGATGAGCTCATGCAAGC
ATTAAACTTCAACTCAGAGACGGTGCCCCAGAAGAGCAGCCTGGAGGAGCCAGACTTCTACAAAACCAAGATCAAGCTCTGCATC
TTATTACATGCCTTCCGCATCCGGGCGGTCACCATTGACCGTGTCATGTCCTACTTAAATGCCAGC

TABLE 10-continued

Optimized sequences encoding human IL15, IL15Ra, or IL15Ra-IL15 fusion

>hIL15RαB_006 (SEQ ID NO: 819)
ATGTGCCACCAGCAGCTGGTGATCAGCTGGTTCAGCCTGGTGTTCCTGGCCAGCCCCCTGGTGGCCATCTGGGAGCTGAAGAAGG
ACGTGTACGTGGTGGAGCTGGACTGGTACCCCGACGCCCCCGGCGAGATGGTGGTGCTGACCTGTGACACCCCCGAGGAGGACGG
CATCACCTGGACCCTGGACCAGAGCAGCGAGGTGCTGGGCAGCGGCAAGACCCTGACCATCCAGGTGAAGGAGTTCGGGGACGCC
GGCCAGTACACCTGCCACAAGGGCGGCGAGGTGCTGAGCCACAGCCTGCTGCTGCTGCACAAGAAGGAGGACGGCATCTGGAGCA
CAGATATCCTGAAGGACCAGAAGGAGCCCAAGAACAAGACCTTCCTGAGATGCGAGGCCAAGAACTACAGCGGCAGATTCACCTG
CTGGTGGCTGACCACCATCAGCACAGACTTGACCTTCAGCGTGAAGAGCAGCAGAGGCAGCAGCGACCCCCAGGGCGTGACCTGC
GGCGCCGCCACCCTGAGCGCCGAGAGAGTGAGAGGGGACAACAAGGAGTACGAGTACAGCGTGGAGTGCCAGGAGGACAGCGCCT
GCCCCGCCGCCGAGGAGAGCCTGCCCATCGAGGTGATGGTGGACGCCGTGCACAAGCTGAAGTACGAGAACTACACCAGCAGCTT
CTTCATCAGAGACATCATCAAGCCCGACCCGCCGAAGAACCTGCAGCTGAAGCCCCTGAAGAACAGCAGACAGGTGGAGGTGAGC
TGGGAGTACCCCGACACCTGGAGCACCCCCCACAGCTACTTCAGCCTGACCTTCTGCGTGCAGGTGCAGGGCAAGAGCAAGAGAG
AGAAGAAGGACAGAGTGTTCACAGATAAGACCAGCGCCACCGTGATCTGCAGAAAGAACGCCAGCATCAGCGTGAGAGCCCAGGA
CAGATACTACAGCAGCAGCTGGAGCGAGTGGGCCAGCGTGCCCTGCAGCGGCGGCGGCGGCGGCAGCAGAAACCTGCCCGTG
GCCACCCCCGACCCCGGCATGTTCCCCTGCCTGCACCACAGCCAGAACCTGCTGAGAGCCGTGAGCAACATGCTGCAGAAGGCCA
GACAGACCCTGGAGTTCTACCCCTGCACCAGCGAGGAGATCGACCACGAGGACATCACCAAGGACAAGACCAGCACCGTGGAGGC
CTGCCTGCCCCTGGAGCTGACCAAGAATGAAAGCTGCCTGAACAGCAGAGAGACCAGCTTCATCACCAACGGCAGCTGCCTGGCC
AGCAGAAAGACCAGCTTCATGATGGCCCTGTGCCTGAGCAGCATCTACGAGGACCTGAAGATGTACCAGGTGGAGTTCAAGACCA
TGAACGCCAAGCTGCTGATGGACCCCAAGAGACAGATCTTCCTGGACCAGAACATGCTGGCCGTGATCGACGAGCTGATGCAGGC
CCTGAACTTCAACAGCGAGACCGTGCCCCAGAAGAGCAGCCTGGAGGAGCCCGACTTCTACAAGACCAAGATCAAGCTGTGCATC
CTGCTGCACGCCTTCAGAATCAGAGCCGTGACCATCGACAGAGTGATGAGCTACCTGAACGCCAGC

>hIL15RαB_007 (SEQ ID NO: 820)
ATGTGCCACCAGCAGCTTGTCATCTCCTGGTTCTCTCTTGTCTTCCTTGCTTCTCCTCTTGTGGCCATCTGGGAGCTGAAGAAGG
ATGTTTATGTTGTGGAGTTGGACTGGTACCCTGATGCTCCTGGAGAAATGGTGGTTCTCACCTGTGACACTCCTGAGGAGGATGG
CATCACCTGGACTTTGGACCAGTCTTCTGAGGTTCTTGGCAGTGGAAAAACTCTTACTATTCAGGTGAAGGAGTTTGGAGATGCT
GGCCAGTACACCTGCCACAAGGGTGGTGAAGTTCTCAGCCACAGTTTACTTCTTCTTCACAAGAAGGAGGATGGCATCTGGTCTA
CTGACATTTTAAAAGACCAGAAGGAGCCCAAGAACAAGACTTTCCTTCGTTGTGAAGCCAAGAACTACAGTGGTCGTTTCACCTG
CTGGTGGCTTACTACTATTTCTACTGACCTTACTTTCTCTGTGAAGTCTTCTCGTGGCTCTTCTGACCCTCAGGGTGTCACCTGT
GGGGCTGCTACTCTTTCTGCTGAGCGTGTGCGTGGGGACAACAAGGAGTATGAATACTCGGTGGAGTGCCAGGAGGACTCTGCCT
GCCCTGCTGCTGAGGAGTCTCTTCCTATTGAGGTGATGGTGGATGCTGTGCACAAGTTAAAATATGAAAACTACACTTCTTCTTT
CTTCATTCGTGACATTATAAAACCTGACCCTCCCAAGAACCTTCAGTTAAAACCTTTAAAAAACTCTCGTCAGGTGGAGGTGTCC
TGGGAGTACCCTGACACGTGGTCTACTCCTCACTCCTACTTCTCTCTTACTTTCTGTGTCCAGGTGCAGGGCAAGTCCAAGCGTG
AGAAGAAGGACCGTGTCTTCACTGACAAGACTTCTGCTACTGTCATCTGCAGGAAGAATGCATCCATCTCTGTGCGTGCTCAGGA
CCGTTACTACAGCTCTTCCTGGTCTGAGTGGGCTTCTGTGCCCTGCTCTGGCGGCGGCGGCGGCAGCAGAAATCTTCCTGTG
GCTACTCCTGACCCTGGCATGTTCCCCTGCCTTCACCACTCGCAGAACCTTCTTCGTGCTGTGAGCAACATGCTTCAGAAGGCTC
GTCAGACTTTAGAATTCTACCCCTGCACTTCTGAGGAGATTGACCATGAAGACATCACCAAGGACAAGACTTCTACTGTGGAGGC
CTGCCTTCCTTTAGAGCTGACCAAGAATGAATCCTGCTTAAATTCTCGTGAGACTTCTTTCATCACCAATGGCAGCTGCCTTGCC
TCGCGCAAGACTTCTTTCATGATGGCTCTTTGCCTTTCTTCCATCTATGAAGACTTAAAAATGTACCAGGTGGAGTTCAAGACCA
TGAATGCAAAGCTTCTCATGGACCCCAAGCGTCAGATATTTTTGGACCAGAACATGCTTGCTGTCATTGATGAGCTCATGCAGGC
TTTAAACTTCAACTCTGAGACTGTGCCTCAGAAGTCTTCTTTAGAAGAGCCTGACTTCTACAAGACCAAGATAAAACTTTGCATT
CTTCTTCATGCTTTCCGCATCCGTGCTGTGACTATTGACCGTGTGATGTCCTACTTAAATGCTTCT

>hIL15RαB_008 (SEQ ID NO: 821)
ATGTGTCATCAACAACTCGTGATTAGCTGGTTCAGTCTCGTGTTCCTGGCCTCTCCGCTGGTGGCCATCTGGGAGCTTAAGAAGG
ACGTGTACGTGGTGGAGCTCGATTGGTACCCCGATGCTCCTGGCGAGATGGTGGTGCTAACCTGCGATACCCCCGAGGAGGACGG
GATCACTTGGACCCTGGATCAGAGTAGCGAAGTCCTGGGCTCTGGCAAGACACTCACAATCCAGGTGAAGGAATTCGGAGACGCT
GGTCAGTACACTTGCCACAAGGGGGGTGAAGTGCTGTCTCACAGCCTGCTGTTACTGCACAAGAAGGAGGATGGGATCTGGTCAA
CCGACATCCTGAAGGATCAGAAGGAGCCTAAGAACAAGACCTTTCTGAGGTGTGAAGCTAAGAACTATTCCGGAAGATTCACTTG
CTGGTGGTTGACCACAATCAGCACTGACCTGACCTTTTCCGTGAAGTCCAGCAGAGGAAGCAGCGATCCTCAGGGCGTAACGTGC
GGCGCGGCTACCCTGTCAGCTGAGCGGGTTAGAGGCGACAACAAAGAGTATGAGTACTCCGTGGAGTGTCAGGAGGACAGCGCCT
GCCCCGCAGCCGAGGAGAGTCTGCCCATCGAGGTGATGGTGGACGCTGTCCATAAGTTAAAATACGAAAATTACACAAGTTCCTT
TTTCATCCGCGATATTATCAAACCCGATCCCCCCAAGAACCTGCAGCTGAAGCCCCTGAAGAATAGCCGACAGGTGGAAGTCTCT
TGGGAGTATCCTGACACCTGGTCCACGCCTCACAGCTACTTTAGTCTGACTTTCTGTGTCCAGGTCCAGGGCAAGAGCAAGAGAG
AGAAAAAGGATAGAGTGTTTACTGACAAGACATCTGCTACAGTCATCTGCAGAAAGAACGCCAGTATCTCAGTGAGGGCGCAGGA
CAGATACTACAGTAGTAGCTGGAGCGAATGGGCTAGCGTGCCCTGTTCAGGGGGCGGCGGAGGGGGCTCCAGGAATCTGCCCGTG
GCCACCCCCGACCCTGGGATGTTCCCTTGCCTCCATCACTCACAGAACCTGCTCAGAGCAGTGAGCAACATGCTCCAAAAGGCCC
GCCAGACCCTGGAGTTTTACCCTTGTACTTCAGAAGAGATCGATCACGAAGACATAACAAAGGATAAAACCAGCACCGTGGAGGC
CTGTCTGCCTCTAGAACTCACAAAGAATGAAAGCTGTCTGAATTCCAGGGAAACCTCCTTCATTACTAACGGAAGCTGTCTCGCA
TCTCGCAAAACATCATTCATGATGGCCCTCTGCCTGTCTTCTATCTATGAAGATCTCAAGATGTATCAGGTGGAGTTCAAAACAA
TGAACGCCAAGCTGCTGATGGACCCCAAGAGACAGATCTTCCTGGACCAGAACATGCTGGCAGTGATCGATGAGCTGATGCAAGC
CTTGAACTTCAACTCAGAGACAGTGCCGCAAAAGTCCTCGTTGGAGGAACCAGATTTTTACAAAACCAAAATCAAGCTGTGTATC
CTTCTTCACGCCTTTCGGATCAGAGCCGTGACTATCGACCGGGTGATGTCATACCTGAATGCTTCC

>hIL15RαB_009 (SEQ ID NO: 822)
ATGTGCCACCAGCAGCTGGTCATCAGCTGGTTTAGCCTGGTCTTCCTGGCCAGCCCCCTGGTGGCCATCTGGGAGCTGAAGAAAG
ATGTCTATGTTGTAGAGCTGGACTGGTACCCAGATGCTCCTGGAGAAATGGTGGTTCTCACCTGCGACACGCCAGAAGAAGATGG
CATCACCTGGACGCTGGACCAGAGCAGCGAAGTACTGGGCAGTGGAAAAACGCTGACCATACAAGTAAAAGAATTTGGCGATGCT
GGCCAGTACACCTGCCACAAAGGAGGAGAAGTACTGAGCCACAGCCTGCTGCTGCTGCACAAGAAAGAAGATGGCATCTGGAGCA
CCGACATTTTAAAAGACCAGAAGGAGCCCAAGAACAAAACCTTCCTTCGATGTGAGGCGAAGAACTACAGTGGCCGCTTCACCTG
CTGGTGGCTCACCACCATCAGCACCGACCTCACCTTCTCGGTGAAGAGCAGCCGTGGTAGCTCAGACCCCCAAGGAGTCACCTGT
GGGGCGGCCACGCTGTCGGCAGAAAGAGTTCGAGGCGACAACAAGGAATATGAATACTCGGTGGAATGTCAAGAAGACTCGGCCT
GCCCGGCGGCAGAAGAAAGTCTGCCCATAGAAGTCATGGTGGATGCTGTTCACAAATTAAAATATGAAAACTACACCAGCAGCTT
CTTCATCAGAGACATCATCAAGCCAGACCCCCCCAAGAACCTGCAGCTGAAGCCCCTGAAGAACAGCAGACAAGTGGAAGTTTCC
TGGGAGTACCCAGACACGTGGAGCACGCCGCACAGCTACTTCAGCCTCACCTTCTGTGTACAAGTACAAGGCAAGAGCAAGAGAG
AGAAGAAAGATCGTGTCTTCACCGACAAAACCTCGGCGACGGTCATCTGCAGGAAGAATGCAAGCATCTCGGTTCGAGCCCAGGA
CCGCTACTACAGCAGCAGCTGGAGTGAGTGGGCCTCGGTGCCCTGCAGTGGTGGCGGCGGCGGCGGCAGCAGAAACCTTCCTGTG
GCCACGCCGGACCCTGGCATGTTTCCGTGCCTGCACCACAGCCAAAATTTATTACGAGCTGTTAGCAACATGCTGCAGAAAGCAA
GACAAACTTTAGAATTCTACCCCTGCACCTCAGAAGAAATAGACCATGAAGACATCACCAAAGATAAAACCAGCACTGTAGAGGC

TABLE 10-continued

| Optimized sequences encoding human IL15, IL15Ra, or IL15Ra-IL15 fusion |
|---|

CTGCCTGCCCCTGGAGCTCACCAAGAACGAGAGCTGCCTCAATAGCAGAGAGACCAGCTTCATCACCAATGGCAGCTGCCTGGCC
AGCAGGAAAACCAGCTTCATGATGGCGCTCTGCCTGAGCAGCATCTATGAAGATCTGAAGATGTACCAAGTAGAATTTAAAACCA
TGAATGCCAAGCTGCTCATGGACCCCAAGAGACAAATATTCCTCGACCAAAACATGCTGGCTGTCATTGATGAGCTCATGCAAGC
ATTAAACTTCAACTCAGAGACGGTGCCCCAGAAGAGCAGCCTGGAGGAGCCAGACTTCTACAAAACCAAGATCAAGCTCTGCATC
TTATTACATGCCTTCCGCATCCGGGCGGTCACCATTGACCGTGTCATGTCCTACTTAAATGCCAGC

>hIL15RαB_010 (SEQ ID NO: 823)
ATGTGCCACCAGCAGCTTGTCATCTCCTGGTTTTCTCTTGTCTTCCTCGCTTCTCCTCTTGTGGCCATCTGGGAGCTGAAGAAAG
ATGTCTATGTTGTAGAGCTGGACTGGTACCCGGACGCTCCTGGAGAAATGGTGGTTCTCACCTGCGACACTCCTGAAGAAGATGG
CATCACCTGGACGCTGGACCAAAGCAGCGAAGTTTTAGGCTCTGGAAAAAACGCTGACCATACAAGTAAAAGAATTTGGCGACGCT
GGCCAGTACACGTGCCACAAAGGAGGAGAAGTTTTAAGCCACAGTTTACTTCTTCTTCACAAGAAAGAAGATGGCATCTGGAGTA
CGGACATTTTAAAAGACCAGAAGGAGCCTAAGAACAAAACCTTCCTCCGCTGTGAAGCTAAGAACTACAGTGGTCGTTTCACCTG
CTGGTGGCTCACCACCATCTCCACTGACCTCACCTTCTCTGTAAAATCAAGCCGTGGTTCTTCTGACCCCCAAGGAGTCACCTGT
GGGGCTGCCACGCTCAGCGCTGAAAGAGTTCGAGGCGACAACAAGGAATATGAATATTCTGTGGAATGTCAAGAAGATTCTGCCT
GCCCGGCGGCAGAAGAAAGTCTTCCCATAGAAGTCATGGTGGACGCTGTTCACAAATTAAAATATGAAAACTACACCAGCAGCTT
CTTCATTCGTGACATCATCAAACCAGACCCTCCTAAGAACCTTCAGTTAAAACCGCTGAAGAACAGCAGACAAGTGGAAGTTTCC
TGGGAGTACCCGGACACGTGGAGTACGCCGCACTCCTACTTCAGTTTAACCTTCTGTGTACAAGTACAAGGAAAATCAAAAAGAG
AGAAGAAAGATCGTGTCTTCACTGACAAAACATCTGCCACGGTCATCTGCCGTAAGAACGCTTCCATCTCGGTTCGAGCCCAGGA
CCGCTACTACAGCAGCAGCTGGAGTGAGTGGGCATCTGTTCCCTGCAGTGGTGGCGGCGGCGGCGGCAGCCCGCAACCTTCCTGTG
GCCACGCCGGACCCTGGCATGTTCCCGTGCCTTCACCACTCGCAAAATCTTCTTCGTGCTGTTTCTAACATGCTGCAGAAGGCGA
GACAAACTTTAGAATTCTACCCGTGCACTTCTGAAGAAATAGACCATGAAGACATCACCAAGGACAAAACCAGCACGGTGGAGGC
CTGCCTTCCTTTAGAACTTACTAAGAACGAAAGTTGCCTTAACAGCCGTGAGACCAGCTTCATCACCAATGGCAGCTGCCTTGCT
AGCAGGAAGACCAGCTTCATGATGGCGCTGTGCCTTTCTTCCATCTATGAAGATCTTAAGATGTACCAAGTAGAATTTAAAACCA
TGAATGCCAAATTATTAATGGACCCCAAGAGACAAATATTCCTCGACCAAAACATGCTGGCTGTCATTGATGAGCTCATGCAAGC
ATTAAACTTCAACTCAGAAACTGTTCCCCAGAAGTCATCTTTAGAAGAACCGGACTTCTACAAAACAAAAATAAAACTCTGCATT
CTTCTTCATGCCTTCCGCATCCGTGCTGTCACCATTGACCGTGTCATGTCCTACTTAAATGCTTCT

>hIL15RαB_011 (SEQ ID NO: 824)
ATGTGCCACCAGCAGCTGGTGATCAGCTGGTTCAGCCTGGTGTTCCTGGCCAGCCCCCTGGTGGCCATCTGGGAGCTGAAGAAGG
ACGTGTACGTGGTGGAGCTGGACTGGTACCCGGACGCGCCGGGGGAGATGGTGGTGCTGACGTGCGACACGCCGGAGGAGGACGG
GATCACGTGGACGCTGGACCAGAGCAGCGAGGTGCTGGGGAGCGGGAAGACGCTGACGATCCAGGTGAAGGAGTTCGGGGACGCG
GGGCAGTACACGTGCCACAAGGGGGGGGAGGTGCTGAGCCACAGCCTGCTGCTGCTGCACAAGAAGGAGGACGGGATCTGGAGCA
CGGACATCCTGAAGGACCAGAAGGAGCCGAAGAACAAGACGTTCCTGAGGTGCGAGGCGAAGAACTACAGCGGGAGGTTCACGTG
CTGGTGGCTGACGACGATCAGCACGGACCTGACGTTCAGCGTGAAGAGCAGCAGGGGGAGCAGCGACCCGCAGGGGGTGACGTGC
GGGGCGGCGACGCTGAGCGCGGAGAGGGTGAGGGGGGACAACAAGGAGTACGAGTACAGCGTGGAGTGCCAGGAGGACAGCGCGT
GCCCGGCGGCGGAGGAGAGCCTGCCGATCGAGGTGATGGTGGACGCGGTGCACAAGCTGAAGTACGAGAACTACACGAGCAGCTT
CTTCATCAGGGACATCATCAAGCCGGACCCGCCGAAGAACCTGCAGCTGAAGCCGCTGAAGAACAGCAGGCAGGTGGAGGTGAGC
TGGGAGTACCCGGACACGTGGAGCACGCCGCACAGCTACTTCAGCCTGACGTTCTGCGTGCAGGTGCAGGGGAAGAGCAAGAGGG
AGAAGAAGGACAGGGTGTTCACGGACAAGACGAGCGCGACGGTGATCTGCAGGAAGAACGCGAGCATCAGCGTGAGGGCGCAGGA
CAGGTACTACAGCAGCAGCTGGAGCGAGTGGGCGAGCGTGCCGTGCAGCGGGGGGGGGGGGGGGGGGAGCAGGAACCTGCCGGTG
GCGACGCCGGACCCGGGGATGTTCCCGTGCCTGCACCACAGCCAGAACCTGCTGAGGGCGGTGAGCAACATGCTGCAGAAGGCGA
GGCAGACGCTGGAGTTCTACCCGTGCACGAGCGAGGAGATCGACCACGAGGACATCACGAAGGACAAGACGAGCACGGTGGAGGC
GTGCCTGCCGCTGGAGCTGACGAAGAACGAGAGCTGCCTGAACAGCAGGGAGACGAGCTTCATCACGAACGGGAGCTGCCTGGCG
AGCAGGAAGACGAGCTTCATGATGGCGCTGTGCCTGAGCAGCATCTACGAGGACCTGAAGATGTACCAGGTGGAGTTCAAGACGA
TGAACGCGAAGCTGCTGATGGACCCGAAGAGGCAGATCTTCCTGGACCAGAACATGCTGGCGGTGATCGACGAGCTGATGCAGGC
GCTGAACTTCAACAGCGAGACGGTGCCGCAGAAGAGCAGCCTGGAGGAGCCGGACTTCTACAAGACGAAGATCAAGCTGTGCATC
CTGCTGCACGCGTTCAGGATCAGGGCGGTGACGATCGACAGGGTGATGAGCTACCTGAACGCGAGC

>hIL15RαB_012 (SEQ ID NO: 825)
ATGTGCCATCAGCAGCTGGTGATCAGCTGGTTCAGCCTCGTGTTTCTGGCCAGCCCCCTGGTGGCCATTTGGGAACTCAAGAAGG
ACGTGTATGTAGTGGAACTCGACTGGTACCCTGACGCCCCAGGCGAAATGGTGGTCTTAACCTGCGACACCCCTGAGGAGGACGG
AATCACCTGGACCTTGGACCAGAGCTCCGAGGTCCTCGGCAGTGGCAAGACCCTGACCATACAGGTGAAAGAATTTGGAGACGCA
GGGCAATACACATGTCACAAGGGCGGGGAGGTTCTTTCTCACTCCCTTCTGCTTCTACATAAAAAGGAAGACGGAATTTGGTCTA
CCGACATCCTCAAGGACCAAAAGGAGCCTAAGAATAAAACCTTCTTACGCTGTGAAGCTAAAAACTACAGCGGCAGATTCACTTG
CTGGTGGCTCACCACCATTTCTACCGACCTGACCTTCTCGGTGAAGTCTTCAAGGGGCTCTAGTGATCCACAGGGAGTGACATGC
GGGGCCGCCACACTGAGCGCTGAACGGGTGAGGGGCGATAACAAGGAGTATGAATACTCTGTCGAGTGTCAGGAGGATTCAGCTT
GTCCCGCAGCTGAAGAGTCACTCCCCATAGAGGTTATGGTCGATGCTGTGCATAAACTGAAGTACGAAAACTACACCAGCAGCTT
CTTCATTCGGGACATTATAAAACCTGACCCCCCCAAGAACCTGCAACTTAAACCCCTGAAAAACTCTCGGCAGGTCGAAGTTAGC
TGGGAGTACCCTGATACTTGGTCCACCCCCCACTCGTACTTCTCACTGACTTTCTGTGTGCAGGTGCAGGGCAAGAGCAAGAGAG
AGAAAAAAGATCGTGTATTCACAGACAAGACCTCTGCCACCGTGATCTGCAGAAAAAACGCTTCCATCAGTGTCAGAGCCCAAGA
CCGGTACTATAGTAGTAGCTGGAGCGAGTGGGCAAGTGTCCCCTGCTCTGGCGGCGGAGGGGGCGGCTCTCGAAACCTCCCCGTC
GCTACCCCTGATCCAGGAATGTTCCCTTGCCTGCATCACTCACAGAATCTGCTGAGAGCGGTCAGCAACATGCTGCAGAAAGCTA
GGCAAACACTGGAGTTTTATCCTTGTACCTCAGAGGAGATCGACCACGAGGATATTACCAAGGACAAGACCAGCACGGTGGAGGC
CTGCTTGCCCCTGGAACTGACAAAGAATGAATCCTGCCTTAATAGCCGTGAGACCTCTTTTATAACAAACGGATCCTGCCTGGCC
AGCAGGAAGACCTCCTTCATGATGGCCCTCTGCCTGTCCTCAATCTACGAAGACCTGAAGATGTACCAGGTGGAATTTAAAACTA
TGAACGCCAAGCTGTTGATGGACCCCAAGCGGCAGATCTTTCTGGATCAAAATATGCTGGCTGTGATCGACGAACTGATGCAGGC
CCTCAACTTTAACAGCGAGACCGTGCCACAAAAGAGCAGTCTTGAGGAGCCCGACTTCTACAAGACCAAGATCAAGCTGTGCATC
CTCCTTCATGCCTTCAGGATAAGAGCTGTCACCATCGACAGAGTCATGAGTTACCTGAATGCATCC

>hIL15RαB_013 (SEQ ID NO: 826)
ATGTGCCACCAGCAGCTGGTCATCTCCTGGTTCAGTCTTGTCTTCCTGGCCTCGCCGCTGGTGGCCATCTGGGAGCTGAAGAAAG
ATGTTTATGTTGTAGAGCTGGACTGGTACCCAGATGCTCCTGGAGAAATGGTGGTCCTCACCTGTGACACGCCAGAAGAAGATGG
CATCACCTGGACGCTGGACCAGAGCAGTGAAGTTCTTGGAAGTGGAAAAAACGCTGACCATACAAGTAAAAGAATTTGGAGATGCT
GGCCAGTACACCTGCCACAAAGGAGGAGAAGTTCTCAGCCACAGTTTATTATTACTTCACAAGAAAGAAGATGGCATCTGGTCCA
CGGACATTTTAAAAGACCAGAAGGAGCCCAAAAATAAAACATTTCTTCGATGTGAGGCCAAGAACTACAGTGGTCGTTTCACCTG
CTGGTGGCTGACCACCATCTCCACAGACCTCACCTTCAGTGTAAAAAGCAGCCGTGGTTCTTCTGACCCCCAAGGAGTCACCTGT
GGGGCTGCCACGCTCTCTGCAGAAAGAGTTCGAGGGGACAACAAAGAATATGAGTACTCGGTGGAATGTCAAGAAGACTCGGCCT
GCCCAGCTGCTGAGGAGAGTCTTCCCATAGAAGTCATGGTGGATGCTGTTCACAAATTAAAATATGAAAACTACACCAGCAGCTT

TABLE 10-continued

Optimized sequences encoding human IL15, IL15Ra, or IL15Ra-IL15 fusion

CTTCATCAGAGACATCATCAAACCTGACCCGCCCAAGAACTTACAGCTGAAGCCGCTGAAAAACAGCAGACAAGTAGAAGTTTCC
TGGGAGTACCCGGACACCTGGTCCACGCCGCACTCCTACTTCTCCCTCACCTTCTGTGTACAAGTACAAGGCAAGAGCAAGAGAG
AGAAGAAAGATCGTGTCTTCACGGACAAAACATCAGCCACGGTCATCTGCAGGAAAAATGCCAGCATCTCGGTGCGGGCCCAGGA
CCGCTACTACAGCAGCAGCTGGAGTGAGTGGGCATCTGTGCCCTGCAGTGGTGGTGGGGGTGGTGGCAGCAGAAACCTTCCTGTG
GCCACTCCAGACCCTGGCATGTTCCCGTGCCTTCACCACTCCCAAAATTTACTTCGAGCTGTTTCTAACATGCTGCAGAAAGCAA
GACAAACTTTAGAATTCTACCCGTGCACTTCTGAAGAAATTGACCATGAAGACATCACAAAAGATAAAACCAGCACAGTGGAGGC
CTGTCTTCCTTTAGAGCTGACCAAAAATGAATCCTGCCTCAACAGCAGAGAGACCAGCTTCATCACCAATGGCAGCTGCCTGGCC
TCCAGGAAAACCAGCTTCATGATGGCGCTCTGCCTCAGCTCCATCTATGAAGATTTGAAGATGTACCAAGTAGAATTTAAAACCA
TGAATGCCAAATTATTAATGGACCCCAAGAGGCAGATATTTTTAGATCAAAACATGCTGGCAGTTATTGATGAGCTCATGCAAGC
ATTAAACTTCAACAGTGAGACTGTACCTCAAAAAAGCAGCCTTGAAGAGCCGGACTTCTACAAAACCAAGATCAAACTCTGCATT
TTACTTCATGCCTTCCGCATCCGGGCGGTCACCATTGACCGTGTCATGTCCTACTTAAATGCCTCG

>hIL15RαB_014 (SEQ ID NO: 827)
ATGTGCCACCAGCAGCTTGTGATTTCTTGGTTCTCTCTTGTGTTCCTTGCTTCTCCTCTTGTGGCTATTTGGGAGTTAAAAAAGG
ACGTGTACGTGGTGGAGCTTGACTGGTACCCTGATGCTCCTGGCGAGATGGTGGTGCTTACTTGTGACACTCCTGAGGAGGACGG
CATTACTTGGACTCTTGACCAGTCTTCTGAGGTGCTTGGCTCTGGCAAGACTCTTACTATTCAGGTGAAGGAGTTCGGGGATGCT
GGCCAGTACACTTGCCACAAGGGCGGCGAGGTGCTTTCTCACTCTCTTCTTCTTCTTCACAAGAAGGAGGACGGCATTTGGTCTA
CTGACATTTTAAAAGACCAGAAGGAGCCCAAGAACAAGACTTTCCTTCGTTGCGAGGCCAAGAACTACTCTGGCCGTTTCACTTG
CTGGTGGCTTACTACTATTTCTACTGACCTTACTTTCTCTGTGAAGTCTTCTCGTGGCTCTTCTGACCCTCAGGGCGTGACTTGT
GGGGCTGCTACTCTTTCTGCTGAGCGTGTGCGTGGGGACAACAAGGAGTACGAGTACTCTGTGGAGTGCCAGGAGGACTCTGCTT
GCCCTGCTGCTGAGGAGTCTCTTCCTATTGAGGTGATGGTGGATGCTGTGCACAAGTTAAAATACGAGAACTACACTTCTTCTTT
CTTCATTCGTGACATTATTAAGCCTGACCCTCCCAAGAACCTTCAGTTAAAACCTTTAAAAAACTCTCGTCAGGTGGAGGTGTCT
TGGGAGTACCCTGACACTTGGTCTACTCCTCACTCTTACTTCTCTCTTACTTTCTGCGTGCAGGTGCAGGGCAAGTCTAAGCGTG
AGAAGAAGGACCGTGTGTTCACTGACAAGACTTCTGCTACTGTGATTTGCAGGAAGAATGCATCTATTTCTGTGCGTGCTCAGGA
CCGTTACTACTCTTCTTCTTGGTCTGAGTGGGCTTCTGTGCCTTGCTCTGGCGGCGGCGGCGGCTCTAGAAATCTTCCTGTG
GCTACTCCTGACCCTGGCATGTTCCCTTGCCTTCACCACTCTCAGAACCTTCTTCGTGCTGTGAGCAACATGCTTCAGAAGGCTC
GTCAGACTCTTGAGTTCTACCCTTGCACTTCTGAGGAGATTGACCACGAGGACATCACCAAGGACAAGACTTCTACTGTGGAGGC
TTGCCTTCCTCTTGAGCTTACCAAGAATGAATCTTGCTTAAATTCTCGTGAGACTTCTTTCATCACCAACGGCTCTTGCCTTGCC
TCGCGCAAGACTTCTTTCATGATGGCTCTTTGCCTTTCTTCTATTTACGAGGACTTAAAAATGTACCAGGTGGAGTTCAAGACTA
TGAATGCAAAGCTTCTTATGGACCCCAAGCGTCAGATTTTCCTTGACCAGAACATGCTTGCTGTGATTGACGAGCTTATGCAGGC
TTTAAATTTCAACTCTGAGACTGTGCCTCAGAAGTCTTCTCTTGAGGAGCCTGACTTCTACAAGACCAAGATTAAGCTTTGCATT
CTTCTTCATGCTTTCCGTATTCGTGCTGTGACTATTGACCGTGTGATGTCTTACTTAAATGCTTCT

>hIL15RαB_015 (SEQ ID NO: 828)
ATGTGTCACCAGCAGCTGGTGATCAGCTGGTTTAGCCTGGTGTTTCTGGCCAGCCCCCTGGTGGCCATATGGGAACTGAAGAAAG
ATGTGTATGTGGTAGAACTGGATTGGTATCCGGATGCCCCCGGCGAAATGGTGGTGCTGACCTGTGACACCCCCGAAGAAGATGG
TATCACCTGGACCCTGGACCAGAGCAGCGAGGTGCTGGGCAGCGGCAAAACCCTGACCATCCAAGTGAAAGAGTTTGGCGATGCC
GGCCAGTACACCTGTCACAAAGGCGGCGAGGTGCTAAGCCATTCGCTGCTGCTGCTGCACAAAAAGGAAGATGGCATCTGGAGCA
CCGATATCCTGAAGGACCAGAAAGAACCCAAAAATAAGACCTTTCTAAGATGCGAGGCCAAGAATTATAGCGGCCGTTTCACCTG
CTGGTGGCTGACGACCATCAGCACCGATCTGACCTTCAGCGTGAAAAGCAGCAGAGGCAGCAGCGACCCCCAAGGCGTGACGTGC
GGCGCCGCCACCCTGAGCGCCGAGAGAGTGAGAGGCGACAACAAGGAGTATGAGTACAGCGTGGAGTGCCAGGAGGACAGCGCCT
GCCCCGCCGCCGAGGAGAGCCTGCCCATCGAGGTGATGGTGGATGCCGTGCACAAGCTGAAGTATGAAAACTACACCAGCAGCTT
CTTCATCAGAGACATCATCAAACCCGACCCCCCCAAGAACCTGCAGCTGAAGCCCCTGAAGAATAGCAGACAGGTGGAGGTGAGC
TGGGAGTACCCCGACACCTGGAGCACCCCCCATAGCTACTTCAGCCTGACCTTCTGCGTGCAGGTGCAGGGCAAGAGCAAGAGAG
AAAAGAAAGATAGAGTGTTCACGGACAAGACCAGCGCCACGGTGATCTGCAGAAAAAATGCCAGCATCAGCGTGAGAGCCCAGGA
CAGATACTATAGCAGCAGCTGGAGCGAATGGGCCAGCGTGCCCTGCAGCGGCGGCGGCGGCGGCGGCAGCAGAAACCTGCCCGTG
GCCACCCCCGACCCCGGCATGTTCCCCTGCCTGCACCACAGCCAAAACCTGCTGAGAGCCGTGAGCAACATGCTGCAGAAGGCCA
GACAAACCCTGGAATTTTACCCCTGCACCAGCGAAGAGATCGATCATGAAGATATCACCAAAGATAAAACCAGCACCGTGGAGGC
CTGTCTGCCCCTGGAACTGACCAAGAATGAGAGCTGCCTAAATAGCAGAGAGACCAGCTTCATAACCAATGGCAGCTGCCTGGCC
AGCAGAAAGACCAGCTTTATGATGGCCCTGTGCCTGAGCAGCATCTATGAAGACCTGAAGATGTACCAGGTGGAGTTCAAGACCA
TGAATGCCAAGCTGCTGATGGATCCCAAGAGACAGATCTTTCTGGATCAAAACATGCTGGCCGTGATCGATGAGCTGATGCAGGC
CCTGAATTTCAACAGCGAGACCGTGCCCCAAAAAAGCAGCCTGGAAGAACCGGATTTTTATAAAACCAAAATCAAGCTGTGCATA
CTGCTGCATGCCTTCAGAATCAGAGCCGTGACCATCGATAGAGTGATGAGCTATCTGAATGCCAGC

>hIL15RαB_016 (SEQ ID NO: 829)
ATGTGCCACCAGCAGCTGGTCATCAGCTGGTTCAGCCTGGTCTTCCTGGCCAGCCCCCTGGTGGCCATCTGGGAGCTGAAGAAGG
ATGTTTATGTTGTGGAGCTGGACTGGTACCCAGATGCCCCTGGGGAGATGGTGGTGCTGACCTGTGACACCCCAGAAGAGGATGG
CATCACCTGGACCCTGGACCAGAGCTCAGAAGTGCTGGGCAGTGGAAAAACCCTGACCATCCAGGTGAAGGAGTTTGGAGATGCT
GGCCAGTACACCTGCCACAAGGGTGGTGAAGTGCTGAGCCACAGCCTGCTGCTGCTGCACAAGAAGGAGGATGGCATCTGGAGCA
CAGACATCCTGAAGGACCAGAAGGAGCCCAAGAACAAGACCTTCCTTCGCTGTGAAGCCAAGAACTACAGTGGCCGCTTCACCTG
CTGGTGGCTGACCACCATCAGCACAGACCTCACCTTCTCGGTGAAGAGCAGCAGAGGCAGCTCAGACCCCCAGGGTGTCACCTGT
GGGGCGGCCACGCTGTCGGCGGAGAGAGTTCGAGGGGACAACAAGGAGTATGAATACTCGGTGGAGTGCCAGGAGGACTCGGCGT
GCCCGGCGGCAGAAGAGAGCCTGCCCATAGAAGTGATGGTGGATGCTGTGCACAAGCTGAAGTATGAAAACTACACCAGCAGCTT
CTTCATCAGAGACATCATCAAGCCAGACCCGCCCAAGAACCTGCAGCTGAAGCCCCTGAAGAACAGCAGACAAGTGGAGGTTTCC
TGGGAGTACCCAGACACGTGGAGCACCCCCCACAGCTACTTCAGCCTGACCTTCTGTGTCCAGGTGCAGGGCAAGAGCAAGAGAG
AGAAGAAGGACAGAGTCTTCACAGACAAGACCTCGGCCACGGTCATCTGCAGAAAGAATGCCTCCATCTCGGTTCGAGCCCAGGA
CAGATACTACAGCAGCAGCTGGTCAGAATGGGCCTCGGTGCCCTGCAGTGGTGGCGGCGGCGGCGGCAGCAGAAACCTGCCTGTT
GCCACCCCAGACCCTGGGATGTTCCCCTGCCTGCACCACAGCCAGAACTTATTACGAGCTGTTTCTAACATGCTGCAGAAGGCCA
GACAAACCCTGGAGTTCTACCCCTGCACCTCAGAAGAGATTGACCATGAAGACATCACCAAGGACAAGACCAGCACTGTAGAGGC
CTGCCTGCCCCTGGAGCTGACCAAGAATGAAAGCTGCCTGAACAGCAGAGAGACCAGCTTCATCACCAATGGAAGCTGCCTGGCC
AGCAGAAAGACCAGCTTCATGATGGCCCTGTGCCTGAGCAGCATCTATGAAGACCTGAAGATGTACCAGGTGGAGTTCAAGACCA
TGAATGCAAAGCTGCTGATGGACCCCAAGAGACAAATATTTTTGGACCAGAACATGCTGGCTGTCATTGATGAGCTGATGCAGGC
CCTGAACTTCAACTCAGAAACTGTACCCCAGAAGAGCAGCCTGGAGGAGCCAGACTTCTACAAGACCAAGATCAAGCTGTGCATC
CTGCTTCATGCTTTCAGAATCAGAGCTGTCACCATTGACCGCGTGATGAGCTACTTAAATGCCTCG

>hIL15RαB_017 (SEQ ID NO: 830)
ATGTGCCACCAGCAGCTGGTAATCAGCTGGTTTTCCCTCGTCTTTCTGGCATCACCCCTGGTGGCTATCTGGGAGCTGAAGAAGG
ACGTGTACGTGGTGGAGCTGGATTGGTACCCTGACGCCCCGGGGGAAATGGTGGTGTTAACATGCGACACGCCTGAGGAGGACGG

TABLE 10-continued

Optimized sequences encoding human IL15, IL15Ra, or IL15Ra-IL15 fusion

CATCACCTGGACACTGGACCAGAGCAGCGAGGTGCTTGGGTCTGGTAAAACTCTGACTATTCAGGTGAAAGAGTTCGGGGATGCC
GGCCAATATACTTGCCACAAGGGTGGCGAGGTGCTTTCTCATTCTCTGCTCCTGCTGCACAAGAAAGAAGATGGCATTTGGTCTA
CTGATATTCTGAAAGACCAGAAGGAGCCCAAGAACAAGACCTTTCTGAGATGCGAGGCTAAAAACTACAGCGGAAGATTTACCTG
CTGGTGGCTGACCACAATCTCAACCGACCTGACATTTTCAGTGAAGTCCAGCAGAGGGAGCTCCGACCCTCAGGGCGTGACCTGC
GGAGCCGCCACTCTGTCCGCAGAAAGAGTGAGAGGTGATAATAAGGAGTACGAGTATTCAGTCGAGTGCCAAGAGGACTCTGCCT
GCCCAGCCGCCGAGGAGAGCCTGCCAATCGAGGTGATGGTAGATGCGGTACACAAGCTGAAGTATGAGAACTACACATCCTCCTT
CTTCATAAGAGACATTATCAAGCCTGACCCACCTAAAAATCTGCAACTCAAGCCTTTGAAAAATTCAAGACAGGTGGAGGTGAGC
TGGGAGTACCCTGATACTTGGAGCACCCCCCATAGCTACTTTTCGCTGACATTCTGCGTCCAGGTGCAGGGCAAGTCAAAGAGAG
AGAAGAAGGATCGCGTGTTCACTGATAAGACAAGCGCCACAGTGATCTGCAGAAAAAACGCTAGCATTAGCGTCAGAGCACAGGA
CCGGTATTACTCCAGCTCCTGGAGCGAATGGGCATCTGTGCCCTGCAGCGGTGGGGGCGGAGGCGGATCTAGAAACCTCCCCGTT
GCCACACCTGATCCTGGAATGTTCCCCTGTCTGCACCACAGCCAGAACCTGCTGAGAGCAGTGTCTAACATGCTCCAGAAGGCCA
GGCAGACCCTGGAGTTTTACCCCTGCACCAGCGAGGAAATCGATCACGAGGACATCACCAAAGATAAAACCTCCACCGTGGAGGC
CTGCCTGCCCCTGGAACTGACCAAAAACGAGAGCTGCCTGAATAGCAGGGAGACCTCCTTCATCACCAACGGCTCATGCCTTGCC
AGCCGGAAAACTAGCTTCATGATGGCCCTGTGCCTGTCTTCGATCTATGAGGACCTGAAAATGTACCAGGTCGAATTTAAGACGA
TGAACGCAAAGCTGCTGATGGACCCCAAGCGGCAGATCTTTCTGGACCAGAACATGCTGGCAGTCATAGATGAGTTGATGCAGGC
ATTAAACTTCAACAGCGAGACCGTGCCTCAGAAGTCCAGCCTCGAGGAGCCAGATTTTTATAAGACCAAGATCAAACTATGCATC
CTGCTGCATGCTTTCAGGATTAGAGCCGTCACCATCGATCGAGTCATGTCTTACCTGAATGCTAGC

>hIL15RαB_018 (SEQ ID NO: 831)
ATGTGTCACCAACAGTTAGTAATCTCCTGGTTTTCTCTGGTGTTTCTGGCCAGCCCCCTCGTGGCCATCTGGGAGCTTAAAAAGG
ATGTGTACGTGGTGGAGCTGGACTGGTATCCCGATGCACCAGGCGAAATGGTCGTGCTGACCTGCGATACCCCTGAAGAAGATGG
CATCACCTGGACTCTGGACCAGTCTTCCGAGGTGCTTGGATCTGGCAAGACTCTGACAATACAAGTTAAGGAGTTCGGGGACGCA
GGACAGTACACCTGCCACAAAGGCGGCGAGGTCCTGAGTCACTCCCTGTTACTGCTCCACAAGAAAGAGGACGGCATTTGGTCCA
CCGACATTCTGAAGGACCAGAAGGAGCCTAAGAATAAAACTTTCCTGAGATGCGAGGCAAAAAACTATAGCGGCCGCTTTACTTG
CTGGTGGCTTACAACAATCTCTACCGATTTAACTTTCTCCGTGAAGTCTAGCAGAGGATCCTCTGACCCGCAAGGAGTGACTTGC
GGAGCCGCCACCTTGAGCGCCGAAAGAGTCCGTGGCGATAACAAAGAATACGAGTACTCCGTGGAGTGCCAGGAAGATTCCGCCT
GCCCAGCTGCCGAGGAGTCCCTGCCCATTGAAGTGATGGTGGATGCCGTCCACAAGCTGAAGTACGAAAACTATACCAGCAGCTT
CTTCATCCGGGATATCATTAAGCCCGACCCTCCTAAAAACCTGCAACTTAAGCCCCTAAAGAATAGTCGGCAGGTTGAGGTCAGC
TGGGAATATCCTGACACATGGAGCACCCCCCACTCTTATTTCTCCCTGACCTTCTGCGTGCAGGTGCAGGGCAAGAGTAAACGGG
AGAAAAAGGACAGGGTCTTTACCGATAAAACCAGCGCTACGGTTATCTGTCGGAAGAACGCTTCCATCTCCGTCCGCGCTCAGGA
TCGTTACTACTCGTCCTCATGGAGCGAGTGGGCCAGCGTGCCCTGCAGCGGCGGCGGTGGAGGCGGATCCAGAAATCTGCCTGTT
GCCACACCAGACCCTGGCATGTTCCCCTGTCTGCATCATAGCCAGAACCTGCTCAGAGCCGTGAGCAACATGCTCCAGAAGGCCA
GGCAGACATTGGAGTTCTACCCGTGTACATCTGAGGAAATCGATCACGAAGATATAACCAAGGACAAAACCTCTACAGTAGAGGC
TTGTTTGCCCCTGGAGTTGACCAAAAACGAGAGTTGCCTGAACAGTCGCGAGACAAGCTTCATTACTAACGGCAGCTGTCTCGCC
TCCAGAAAGACATCCTTCATGATGGCCCTGTGTCTTTCCAGCATATACGAAGACCTGAAAATGTACCAGGTCGAGTTCAAAACAA
TGAACGCCAAGCTGCTTATGGACCCCAAGAGACAGATCTTCCTCGACCAAAACATGCTCGCTGTGATCGATGAGCTGATGCAGGC
TCTCAACTTCAATTCCGAAACAGTGCCACAGAAGTCCAGTCTGGAAGAACCCGACTTCTACAAGACCAAGATTAAGCTGTGTATT
TTGCTGCATGCGTTTAGAATCAGAGCCGTGACCATTGATCGGGTGATGAGCTACCTGAACGCCTCG

>hIL15RαB_019 (SEQ ID NO: 832)
ATGTGCCACCAGCAGCTTGTCATCTCCTGGTTTTCTCTTGTCTTCCTGGCCTCGCCGCTGGTGGCCATCTGGGAGCTGAAGAAAG
ATGTCTATGTTGTAGAGCTGGACTGGTACCCAGATGCTCCTGGAGAAATGGTGGTTCTCACCTGTGACACTCCTGAAGAAGATGG
CATCACCTGGACGCTGGACCAAAGCTCAGAAGTTCTTGGCAGTGGAAAAACGCTGACCATACAAGTAAAAGAATTTGGGGATGCT
GGCCAGTACACGTGCCACAAAGGAGGAGAAGTTCTCAGCCACAGTTTACTTCTTCTTCACAAGAAAGAAGATGGCATCTGGTCCA
CGGACATTTTAAAAGACCAGAAGGAGCCCAAGAACAAAACCTTCCTCCGCTGTGAGGCCAAGAACTACAGTGGTCGTTTCACCTG
CTGGTGGCTCACCACCATCTCCACTGACCTCACCTTCTCTGTAAAAAGCAGCCGTGGTTCTTCTGACCCCCAAGGAGTCACCTGT
GGGGCTGCCACGCTCTCGGCAGAAAGAGTTCGAGGGGACAACAAGGAATATGAATATTCTGTGGAATGTCAAGAAGATTCTGCCT
GCCCGGCGGCAGAAGAAAGTCTTCCCATAGAAGTCATGGTGGATGCTGTTCACAAATTAAAATATGAAAACTACACCAGCAGCTT
CTTCATTCGTGACATCATCAAACCAGACCCGCCCAAGAACCTTCAGTTAAAACCTTTAAAAAACAGCAGACAAGTAGAAGTTTCC
TGGGAGTACCCGGACACGTGGTCCACGCCGCACTCCTACTTCAGTTTAACCTTCTGTGTACAAGTACAAGGAAAATCAAAAAGAG
AGAAGAAAGATCGTGTCTTCACTGACAAAACATCTGCCACGGTCATCTGCAGGAAGAATGCCTCCATCTCGGTTCGAGCCCAGGA
CCGCTACTACAGCAGCAGCTGGAGTGAGTGGGCATCTGTTCCCTGCAGTGGTGGCGGCGGCGGCGGCAGCCGCAACCTTCCTGTG
GCCACGCCGGACCCTGGCATGTTCCCGTGCCTTCACCACTCCCAAAATCTTCTTCGTGCTGTTTCTAACATGCTGCAGAAGGCGC
GCCAAACTTTAGAATTCTACCCGTGCACTTCTGAAGAAATAGACCATGAAGACATCACCAAAGATAAAACCAGCACGGTGGAGGC
CTGCCTTCCTTTAGAGCTGACCAAGAATGAATCCTGCCTCAACAGCAGAGAGACCAGCTTCATCACCAATGGCAGCTGCCTGGCC
TCGCGCAAGACCAGCTTCATGATGGCGCTGTGCCTTTCTTCCATCTATGAAGATTTAAAGATGTACCAAGTAGAATTTAAAACCA
TGAATGCCAAATTATTAATGGACCCCAAAAGACAAATATTTTTGGATCAAAACATGCTGGCTGTCATTGATGAGCTCATGCAAGC
ATTAAACTTCAACTCAGAAACTGTTCCCCAGAAGTCATCTTTAGAAGAGCCGGACTTCTACAAAACAAAAATAAAACTCTGCATT
CTTCTTCATGCCTTCCGCATCCGTGCTGTCACCATTGACCGTGTCATGTCCTACTTAAATGCTTCT

>hIL15RαB_020 (SEQ ID NO: 833)
ATGTGCCACCAGCAGCTGGTGATCAGCTGGTTCAGCCTGGTGTTCCTGGCTAGCCCTCTGGTGGCCATCTGGGAGCTGAAGAAGG
ACGTGTACGTGGTGGAGTTAGACTGGTACCCCGACGCTCCCGGCGAGATGGTGGTGCTGACCTGCGACACCCCCGAGGAGGACGG
GATCACCTGGACCCTGGATCAGTCAAGCGAGGTGCTGGGAAGCGGCAAGACCCTGACCATCCAGGTGAAGGAGTTCGGCGACGCC
GGCCAATACACTTGCCACAAGGGAGGCGAGGTGCTGTCCCACTCCCTCCTGCTGCTGCACAAAAAGGAAGACGGCATCTGGAGCA
CCGACATCCTGAAAGACCAGAAGGAGCCTAAGAACAAGACATTCCTCAGATGCGAGGCCAAGAATTACTCCGGGAGATTCACCTG
TTGGTGGCTGACCACCATCAGCACAGACCTGACCTTCAGCGTGAAGAGCAGCAGAGGCAGCAGCGACCCCCAGGGCGTGACCTGT
GGCGCCGCCACCCTGAGCGCCGAAAGAGTGCGCGGCGACAACAAGGAGTACGAGTACTCCGTGGAATGCCAGGAGGACAGCGCCT
GCCCCGCCGCCGAGGAGAGCCTGCCCATCGAGGTGATGGTGGACGCCGTCCACAAGCTGAAGTACGAGAACTACACCTCTAGCTT
CTTCATCCGGGACATCATCAAGCCCGATCCCCCCAAGAACCTGCAGCTGAAACCCCTGAAGAACAGCAGACAGGTGGAGGTGAGC
TGGGAGTATCCCGACACCTGGTCCACCCCCCACAGCTATTTTAGCCTGACCTTCTGCGTGCAAGTGCAGGGCAAGAGCAAGAGAG
AGAAGAAGGACCGCGTGTTCACCGACAAAACCAGCGCCACCGTGATCTGCAGAAAGAACGCCAGCATCAGCGTGAGGGCCCAGGA
TAGATACTACAGTTCCAGCTGGAGCGAGTGGGCCAGCGTGCCCTGCAGCGGCGGCGGCGGGGGAGGCTCTAGAAACCTGCCCGTG
GCTACCCCCGATCCCGGAATGTTCCCCTGCCTGCACCACAGCCAGAACCTGCTGAGGGCGGTGTCCAACATGCTTCAGAAGGCCC
GGCAGACCCTGGAGTTCTACCCCTGTACCTCTGAGGAGATCGATCATGAGGACATCACAAAGGACAAAACCAGCACCGTGGAGGC
CTGCCTGCCCCTGGAGCTGACCAAGAACGAGAGCTGCCTGAACTCCCGCGAGACCAGCTTCATCACGAACGGCAGCTGCCTGGCC
AGCAGGAAGACCTCCTTCATGATGGCCCTGTGCCTGAGCAGCATCTACGAGGACCTGAAAATGTACCAGGTGGAGTTTAAGACCA
TGAACGCCAAGCTGCTGATGGACCCCAAGCGGCAAATCTTCCTGGACCAGAACATGCTGGCAGTGATCGACGAGCTCATGCAGGC

TABLE 10-continued

Optimized sequences encoding human IL15, IL15Ra, or IL15Ra-IL15 fusion

CCTGAACTTCAATAGCGAGACAGTCCCCCAGAAGAGCAGCCTGGAGGAGCCCGACTTTTACAAGACCAAGATCAAGCTGTGCATC
CTGCTGCACGCCTTTAGAATCCGTGCCGTGACCATTGACAGAGTGATGAGCTACCTGAATGCCAGC

>hIL15RαB_021(SEQ ID NO: 834)
ATGTGCCACCAGCAGCTGGTGATCAGCTGGTTCAGCCTGGTGTTCCTGGCCAGCCCTCTGGTTGCCATCTGGGAGCTGAAGAAAG
ACGTGTACGTCGTGGAACTGGACTGGTATCCGGACGCCCCGGGCGAGATGGTGGTGCTGACCTGTGACACCCCCGAGGAGGACGG
CATCACCTGGACGCTGGACCAATCCTCCGAGGTGCTGGGAAGCGGCAAGACCCTGACCATCCAGGTGAAGGAATTCGGGGACGCC
GGGCAGTACACCTGCCACAAGGGGGGCGAAGTGCTGTCCCACTCGCTGCTGCTCCTGCATAAGAAGGAGGATGGAATCTGGTCCA
CCGACATCCTCAAAGATCAGAAGGAGCCCAAGAACAAGACGTTCCTGCGCTGTGAAGCCAAGAATTATTCGGGGCGATTCACGTG
CTGGTGGCTGACAACCATCAGCACCGACCTGACGTTTAGCGTGAAGAGCAGCAGGGGGTCCAGCGACCCCCAGGGCGTGACGTGC
GGCGCCGCCACCCTCTCCGCCGAGAGGGTGCGGGGGGACAATAAGGAGTACGAGTACAGCGTGGAATGCCAGGAGGACAGCGCCT
GCCCCGCCGCGGAGGAAAGCCTCCCGATAGAGGTGATGGTGGACGCCGTGCACAAGCTCAAGTATGAGAATTACACCAGCAGCTT
TTTCATCCGGGACATTATCAAGCCCGACCCCCCGAAGAACCTCCAGCTGAAGCCCCTGAAGAACAGCCGGCAGGTGGAAGTCTCC
TGGGAGTATCCCGACACCTGGAGCACCCCGCACAGCTACTTCTCCCTGACCTTCTGTGTGCAGGTGCAGGGCAAGTCCAAGAGGG
AAAAGAAGGACAGGGTTTTCACCGACAAGACCAGCGCGACCGTGATCTGCCGGAAGAACGCCAGCATAAGCGTCCGCGCCCAAGA
TAGGTACTACAGCAGCTCCTGGAGCGAGTGGGCTAGCGTGCCCTGCAGCGGGGGCGGGGGTGGGGGCTCCAGGAACCTGCCAGTG
GCGACCCCCGACCCCGGCATGTTCCCCTGCCTCCATCACAGCCAGAACCTGCTGAGGGCCGTCAGCAATATGCTGCAGAAGGCCA
GGCAGACCCTGGAATTCTACCCCTGCACGTCGGAGGAGATCGATCACGAGGATATCACAAAAGACAAGACTTCCACCGTGGAGGC
CTGCCTGCCCCTGGAGCTCACCAAGAATGAGTCCTGTCTGAACTCCCGGGAAACCAGCTTCATCACCAACGGGTCCTGCCTGGCC
AGCAGGAAGACCAGCTTTATGATGGCCCTGTGCCTGTCGAGCATCTACGAGGACCTGAAGATGTACCAGGTCGAGTTCAAGACAA
TGAACGCCAAGCTGCTGATGGACCCCAAGAGGCAAATCTTCCTGGACCAGAATATGCTTGCCGTCATCGACGAGCTCATGCAGGC
CCTGAACTTCAACTCCGAGACCGTGCCCCAGAAGAGCAGCCTGGAGGAGCCCGACTTCTACAAGACCAAGATCAAGCTGTGCATC
CTGCTGCACGCGTTCAGGATCCGGGCAGTCACCATCGACCGTGTGATGTCCTACCTGAACGCCAGC

>hIL15RαB_022(SEQ ID NO: 835)
ATGTGCCATCAGCAGCTGGTGATCAGCTGGTTCAGCCTGGTGTTCCTCGCCTCTCCCCTGGTGGCCATCTGGGAGCTCAAAAAGG
ACGTGTACGTGGTGGAGCTCGACTGGTACCCAGACGCCCCCGGGGAGATGGTGGTGCTGACCTGCGACACCCCCGAAGAAGACGG
CATCACGTGGACCCTCGACCAGTCCAGCGAGGTGCTGGGGAGCGGGAAGACTCTGACCATCCAGGTCAAGGAGTTCGGGGACGCC
GGGCAGTACACGTGCCACAAGGGCGGCGAAGTCTTAAGCCACAGCCTGCTCCTGCTGCACAAGAAGGAGGACGGGATCTGGTCCA
CAGACATACTGAAGGACCAGAAGGAGCCGAAGAATAAAACCTTTCTGAGGTGCGAGGCCAAGAACTATTCCGGCAGGTTCACGTG
CTGGTGGCTTACAACAATCAGCACAGACCTGACGTTCAGCGTGAAGTCCAGCCGCGGCAGCAGCGACCCCCAGGGGGTGACCTGC
GGCGCCGCCACCCTGAGCGCCGAGCGGGTGCGCGGGGACAACAAGGAGTACGAGTACTCCGTGGAGTGCCAGGAAGACAGCGCCT
GTCCCGCCGCCGAAGAGAGCCTGCCTATCGAGGTCATGGTAGATGCAGTGCATAAGCTGAAGTACGAGAACTATACGAGCAGCTT
TTTCATACGCGACATCATCAAGCCCGACCCCCCCAAGAACCTGCAGCTTAAGCCCCTGAAGAATAGCCGGCAGGTGGAGGTCTCC
TGGGAGTACCCCGACACCTGGTCAACGCCCCACAGCTACTTCTCCCTGACCTTTTGTGTCCAAGTCCAGGGAAAGAGCAAGAGGG
AGAAGAAAGATCGGGTGTTCACCGACAAGACCTCCGCCACGGTGATCTGCAGGAAGAACGCCAGCATCTCCGTGAGGGCGCAAGA
CAGGTACTACTCCAGCAGCTGGTCCGAATGGGCCAGCGTGCCCTGCTCCGGCGGCGGGGGCGGCGGCAGCCGAAACCTACCCGTG
GCCACGCCGGATCCCGGCATGTTTCCCTGCCTGCACCACAGCCAGAACCTCCTGAGGGCCGTGTCCAACATGCTGCAGAAGGCCA
GGCAGACTCTGGAGTTCTACCCCTGCACGAGCGAGGAGATCGATCACGAGGACATCACCAAGGATAAGACCAGCACTGTGGAGGC
CTGCCTTCCCCTGGAGCTGACCAAGAACGAGAGCTGTCTGAACTCCAGGGAGACCTCATTCATCACCAACGGCTCCTGCCTGGCC
AGCAGGAAAACCAGCTTCATGATGGCCTTGTGTCTCAGCTCCATCTACGAGGACCTGAAGATGTATCAGGTCGAGTTCAAGACAA
TGAACGCCAAGCTGCTGATGGACCCCAAAAGGCAGATCTTCCTGGACCAGAACATGCTGGCCGTCATCGACGAGCTGATGCAGGC
CCTGAACTTCAACAGCGAGACGGTGCCCCAGAAAAGCTCCCTGGAGGAGCCCGACTTCTACAAGACCAAGATCAAGCTGTGCATC
CTGCTGCACGCCTTCAGGATCAGGGCAGTGACCATCGACCGGGTGATGTCATACCTTAACGCCAGC

>hIL15RαB_023(SEQ ID NO: 836)
ATGTGCCATCAGCAGCTGGTGATCTCCTGGTTCAGCCTGGTGTTTCTGGCCTCGCCCCTGGTCGCCATCTGGGAGCTGAAGAAAG
ACGTGTACGTCGTCGAACTGGACTGGTACCCCGACGCCCCCGGGGAGATGGTGGTGCTGACCTGCGACACGCCGGAGGAGGACGG
CATCACCTGGACCCTGGATCAAAGCAGCGAGGTGCTGGGCAGCGGCAAGACCCTGACCATCCAAGTGAAGGAATTCGGCGATGCC
GGCCAGTACACCTGTCACAAAGGGGGCGAGGTGCTCAGCCACAGCCTGCTGCTGCTGCACAAGAAGGAGGATGGCATCTGGAGCA
CCGATATCCTGAAGGACCAGAAAGAGCCCAAGAACAAGACGTTCCTGAGGTGCGAGGCCAAGAACTACAGCGGTAGGTTCACGTG
TTGGTGGCTGACCACCATCAGCACCGACCTGACGTTCAGCGTGAAGAGCTCCAGGGGCAGCTCCGACCCACAGGGGGTGACGTGC
GGGGCCGCAACCCTCAGCGCCGAAAGGGTGCGGGGGGACAACAAGGAGTACGAATACTCCGTGGAGTGCCAGGAAGATTCGGCCT
GCCCCGCCGCGGAGGAGAGCCTCCCCATCGAGGTAATGGTGGACGCCGTGCATAAGCTGAAGTACGAGAACTACACCAGCTCGTT
CTTCATCCGAGACATCATCAAACCCGACCCGCCCAAAAATCTGCAGCTCAAGCCCCTGAAGAACTCCAGGCAGGTGGAGGTGAGC
TGGGAGTACCCCGACACCTGGTCCACCCCGCACAGCTACTTCTCCCTGACATTCTGCGTGCAGGTGCAGGGCAAGAGCAAGCGGG
AGAAGAAGGACAGGGTGTTCACCGACAAGACGAGCGCCACCGTGATCTGCCGAAAGAACGCCAGCATCTCGGTGCGCGCCCAGGA
TAGGTACTATTCCAGCTCCTGGAGCGAGTGGGCCTCGGTACCCTGCAGCGGCGGCGGGGGCGGCGGCAGTAGGAATCTGCCCGTG
GCTACCCCGGACCCGGGCATGTTCCCCTGCCTCCACCACAGCCAGAACCTGCTGAGGGCCGTGAGCAACATGCTGCAGAAGGCCA
GACAGACGCTGGAGTTCTACCCCTGCACGAGCGAGGAGATCGACCACGAGGACATCACCAAGGATAAAACTTCCACCGTCGAGGC
CTGCCTGCCCTTGGAGCTGACCAAGAATGAATCCTGTCTGAACAGCAGGGAGACCTCGTTTATCACCAATGGCAGCTGCCTCGCC
TCCAGGAAGACCAGCTTCATGATGGCCCTCTGTCTGAGCTCCATCTATGAGGACCTGAAGATGTACCAGGTGGAGTTCAAGACCA
TGAACGCGAAGCTGCTGATGGACCCCAAGAGGCAGATCTTCCTGGATCAGAATATGCTGGCGGTGATCGACGAGCTCATGCAGGC
CCTCAATTTCAATAGCGAGACAGTGCCCCAGAAGTCCTCCCTGGAGGAGCCCGACTTCTACAAGACCAAGATCAAGCTGTGTATC
CTGCTGCACGCCTTCCGGATCCGGGCCGTCACCATCGACCGGGTCATGAGCTACCTCAATGCCAGC

>hIL15RαB_024(SEQ ID NO: 837)
ATGTGCCACCAGCAGCTGGTGATCTCCTGGTTCTCCCTGGTGTTCCTGGCCTCGCCCCTGGTGGCCATCTGGGAGCTGAAGAAGG
ACGTGTACGTCGTGGAGCTCGACTGGTACCCCGACGCCCCTGGCGAGATGGTGGTGCTGACCTGCGACACCCCAGAGGAGGATGG
CATCACCTGGACCCTGGATCAGTCCTCCGAGGTGCTGGGCTCCGGCAAGACGCTGACCATCCAAGTGAAGGAGTTCGGTGACGCC
GGACAGTATACCTGCCATAAGGGCGGCGAGGTCCTGTCCCACAGCCTCCTCCTCCTGCATAAGAAGGAGGACGGCATCTGGAGCA
CCGACATCCTGAAGGACCAGAAGGAGCCCAAGAACAAGACCTTTCTGAGGTGCGAGGCCAAGAACTACAGCGGCCGATTCACCTG
CTGGTGGCTCACCACCATATCCACCGACCTGACTTTCTCCGTCAAGTCCTCCCGGGGGTCCAGCGACCCCCAGGGAGTGACCTGC
GGCGCCGCCACCCTCAGCGCCGAGCGGGTGCGGGGGGACAACAAGGAGTACGAATACTCCGTCGAGTGCCAGGAGGACTCCGCCT
GCCCGGCCGCCGAGGAGAGCCTGCCCATCGAGGTGATGGTCGACGCGGTGCACAAGCTGAAGTACGAGAACTACACCAGCAGTTT
CTTCATCAGGGATATCATCAAGCCAGATCCCCCGAAGAATCTGCAACTGAAGCCGCTGAAAAACTCACGACAGGTGGAGGTGAGC
TGGGAGTACCCCGACACGTGGAGCACCCCACATTCCTACTTCAGCCTGACCTTCTGCGTGCAGGTCCAGGGCAAGAGCAAGCGGG
AGAAGAAGGACAGGGTGTTCACGGATAAGACCAGTGCCACCGTGATCTGCAGGAAGAACGCCTCTATTAGCGTGAGGGCCCAGGA

TABLE 10-continued

Optimized sequences encoding human IL15, IL15Ra, or IL15Ra-IL15 fusion

TCGGTATTACTCCTCGAGCTGGAGCGAATGGGCCTCCGTGCCCTGCAGTGGGGGGGTGGAGGCGGGAGCAGGAACCTGCCCGTA
GCAACCCCCGACCCCGGGATGTTCCCCTGTCTGCACCACTCGCAGAACCTGCTGCGCGCGGTGAGCAACATGCTCCAAAAAGCCC
GTCAGACCTTAGAGTTCTACCCCTGCACCAGCGAAGAAATCGACCACGAAGACATCACCAAGGACAAAACCAGCACCGTGGAGGC
GTGCCTGCCGCTGGAGCTGACCAAGAACGAGAGCTGCCTCAACTCCAGGGAGACCAGCTTTATCACCAACGGCTCGTGCCTAGCC
AGCCGGAAAACCAGCTTCATGATGGCCCTGTGCCTGAGCTCCATTTACGAGGACCTGAAGATGTATCAGGTGGAGTTCAAGACCA
TGAATGCCAAACTCCTGATGGACCCCAAGAGGCAGATCTTCCTGGACCAGAACATGCTCGCGGTGATCGATGAGCTGATGCAGGC
CCTGAACTTTAATAGCGAGACCGTGCCCCAGAAAAGCAGCCTGGAGGAGCCGGACTTCTACAAGACCAAAATCAAGCTGTGCATC
CTGCTCCACGCCTTCCGCATCCGGGCCGTGACCATCGACAGGGTGATGAGCTACCTGAACGCCAGC

>hIL15RαB_025(SEQ ID NO: 838)
ATGTGCCATCAGCAGCTGGTGATTTCCTGGTTCTCCCTGGTGTTCCTGGCCAGCCCCCTCGTGGCGATCTGGGAGCTAAAGAAGG
ACGTGTACGTGGTGGAGCTGGACTGGTACCCGGACGCACCCGGCGAGATGGTCGTTCTGACCTGCGATACGCCAGAGGAGGACGG
CATCACCTGGACCCTCGATCAGAGCAGCGAGGTCCTGGGGAGCGGAAAGACCCTGACCATCCAGGTCAAGGAGTTCGGCGACGCC
GGCCAGTACACCTGCCACAAAGGTGGCGAGGTCCTGAGCCACTCGCTGCTGCTCCTGCATAAGAAGGAGGACGGAATCTGGAGCA
CAGACATCCTGAAAGACCAGAAGGAGCCCAAGAACAAGACCTTCCTGAGGTGCGAGGCCAAGAACTACAGCGGGCGCTTCACGTG
CTGGTGGCTGACCACCATCAGCACGGACCTCACCTTCTCCGTGAAGAGCAGCCGGGGATCCAGCGATCCCCAAGGCGTCACCTGC
GGCGCGGCCACCCTGAGCGCGGAGAGGGTCAGGGGCGATAATAAGGAGTATGAGTACAGCGTGGAGTGCCAGGAGGACAGCGCCT
GCCCGGCCGCCGAGGAGTCCCTGCCAATCGAAGTGATGGTCGACGCCGTGCACAAGCTGAAGTACGAGAACTACACCAGCAGCTT
CTTCATCCGGGATATCATCAAGCCCGATCCCCCGAAGAACCTGCAGCTGAAGCCCCTCAAGAACAGCCGGCAGGTGGAGGTGAGT
TGGGAGTACCCCGACACCTGGTCAACGCCCCACAGCTACTTCTCCCTGACCTTCTGTGTGCAGGTGCAGGGAAAGAGCAAGAGGG
AGAAGAAAGACCGGGTCTTCACCGACAAGACCAGCGCCACGGTGATCTGCAGGAAGAACGCAAGCATCTCCGTGAGGGCCCAGGA
CAGGTACTACAGCTCCAGCTGGTCCGAATGGGCCAGCGTGCCCTGTAGCGGCGGCGGGGGCGGTGGCAGCCGCAACCTCCCAGTG
GCCACCCCCGACCCCGGCATGTTCCCCTGCCTGCACCACAGCCAGAATCTGCTGAGGGCCGTGAGTAACATGCTGCAGAAGGCAA
GGCAAACCCTCGAATTCTATCCCTGCACCTCCGAGGAGATCGACCACGAGGATATCACCAAGGACAAGACCAGCACCGTCGAGGC
CTGTCTCCCCCTGGAGCTGACCAAGAATGAGAGCTGCCTGAACAGCCGGGAGACCAGCTTCATCACCAACGGGAGCTGCCTGGCC
TCCAGGAAGACCTCGTTCATGATGGCGCTGTGCCTCTCAAGCATATACGAGGATCTGAAGATGTACCAGGTGGAGTTTAAGACGA
TGAACGCCAAGCTGCTGATGGACCCGAAGAGGCAGATCTTCCTGGACCAGAACATGCTGGCCGTGATAGACGAGCTCATGCAGGC
CCTGAACTTCAACTCCGAGACCGTGCCGCAGAAGTCATCCCTCGAGGAGCCCGACTTCTATAAGACCAAGATCAAGCTGTGCATC
CTGCTCCACGCCTTCCGGATAAGGGCCGTGACGATCGACAGGGTGATGAGCTACCTTAACGCCAGC

>hIL15RαB_026(SEQ ID NO: 839)
ATGTGCCACCAGCAGCTCGTGATCAGCTGGTTCTCCCTGGTGTTTCTCGCCAGCCCCCTGGTGGCCATCTGGGAGCTGAAGAAGG
ACGTGTACGTGGTGGAGCTGGACTGGTACCCTGACGCCCCGGGGGAGATGGTCGTGCTGACCTGCGACACCCCCGAAGAGGACGG
TATCACCTGGACCCTGGACCAGTCCAGCGAGGTGCTGGGCAGCGGCAAGACCCTGACTATTCAAGTCAAGGAGTTCGGAGACGCC
GGCCAGTACACCTGCCACAAGGGTGGAGAGGTGTTATCACACAGCCTGCTGCTGCTGCACAAGAAGGAAGACGGGATCTGGAGCA
CCGACATCCTGAAGGACCAGAAGGAGCCCAAAAACAAGACCTTCCTGCGGTGCGAGGCCAAGAACTATTCGGGCCGCTTTACGTG
CTGGTGGCTGACCACCATCAGCACTGATCTCACCTTCAGCGTGAAGTCCTCCCGGGGGTCGTCCGACCCCCAGGGGGTGACCTGC
GGGGCCGCCACCCTGTCCGCCGAGAGAGTGAGGGGCGATAATAAGGAGTACGAGTACAGCGTTGAGTGCCAGGAAGATAGCGCCT
GTCCCGCCGCCGAGGAGAGCCTGCCCATCGAGGTGATGGTGGACGCCGTCCACAAGCTGAAGTATGAGAACTACACCTCAAGCTT
CTTCATCAGGGACATCATCAAACCCGATCCGCCCAAGAATCTGCAGCTGAAGCCCCTGAAAAATAGCAGGCAGGTGGAGGTGAGC
TGGGAGTACCCCGACACCTGGTCCACCCCCCATAGCTATTTCTCCCTGACGTTCTGCGTGCAGGTGCAAGGGAAGAGCAAGCGGG
AGAAGAAGGACCGGGTGTTCACCGACAAGACCTCCGCCACCGTGATCTGTAGGAAGAACGCGTCGATCTCGGTCAGGGCCCAGGA
CAGGTATTACAGCAGCAGCTGGAGCGAGTGGGCGAGCGTGCCCTGCTCGGGCGGCGGCGGCGGCGGGAGCAGAAATCTGCCCGTG
GCCACCCCAGACCCCGGAATGTTCCCCTGCCTGCACCATTCGCAGAACCTCCTGAGGGCCGTGAGCAACATGCTGCAGAAGGCCC
GCCAGACGCTGGAGTTCTACCCCTGCACGAGCGAGGAGATCGACCACGAAGACATCACCAAGGACAAAACCAGCACCGTGGAGGC
CTGCCTGCCCCTGGAGCTGACCAAAAACGAATCCTGCCTCAACAGCCGGGAGACCAGCTTCATCACCAACGGCAGCTGCCTGGCC
AGCCGAAAGACCTCCTTCATGATGGCCCTCTGCCTGAGCAGCATCTATGAGGATCTGAAGATGTATCAGGTGGAGTTCAAGACCA
TGAATGCCAAGCTGCTGATGGACCCCAAGAGGCAGATATTCCTGGACCAGAATATGCTGGCCGTGATCGACGAGCTGATGCAGGC
CCTGAACTTCAACAGCGAGACCGTCCCCCAGAAGTCCAGCCTGGAGGAGCCGGACTTTTACAAAACGAAGATCAAGCTGTGCATA
CTGCTGCACGCCTTCAGGATCCGGGCCGTGACAATCGACAGGGTGATGTCCTACCTGAACGCCAGC

>hIL15RαB_027(SEQ ID NO: 840)
ATGTGTCACCAGCAGCTGGTGATCAGCTGGTTCTCCCTGGTGTTCCTGGCCAGCCCCCTGGTGGCCATCTGGGAGCTCAAGAAGG
ACGTCTACGTCGTGGAGCTGGATTGGTACCCCGACGCTCCCGGGGAGATGGTGGTGCTGACCTGCGACACCCCCGAGGAGGACGG
CATCACCTGGACGCTGGACCAGAGCTCAGAGGTGCTGGGAAGCGGAAAGACACTGACCATCCAGGTGAAGGAGTTCGGGGATGCC
GGGCAGTATACCTGCCACAAGGGCGGCGAAGTGCTGAGCCATTCCCTGCTGCTGCTGCACAAGAAGGAGGACGGCATATGGTCCA
CCGACATCCTGAAGGATCAGAAGGAGCCGAAGAATAAAACCTTCCTGAGGTGCGAGGCCAAGAATTACAGCGGCCGATTCACCTG
CTGGTGGCTGACCACCATCAGCACCGACCTGACCTTCAGTGTGAAGTCCTCACGGGGCAGCTCAGATCCCCAGGGCGTGACCTGC
GGGGCCGCGACACTCAGCGCCGAGCGGGTGAGGGGTGATAACAAGGAGTACGAGTATTCTGTGGAGTGCCAGGAAGACTCCGCCT
GTCCCGCCGCCGAGGAGTCCCTGCCCATCGAGGTGATGGTGGACGCCGTGCATAAACTGAAGTACGAGAACTACACCTCCAGCTT
CTTCATCCGGGATATAATCAAGCCCGACCCTCCGAAAAACCTGCAGCTGAAGCCCCTTAAAAACAGCCGGCAGGTGGAGGTGAGC
TGGGAGTACCCCGACACCTGGAGCACCCCCCATAGCTATTTCAGCCTGACCTTCTGCGTGCAGGTGCAGGGGAAGTCCAAGCGCG
AGAAAAAGGACCGGGTGTTCACCGACAAGACGAGCGCCACCGTGATCTGCCGGAAGAACGCCAGTATAAGCGTAAGGGCCCAGGA
TAGGTACTACAGCTCCAGCTGGTCGGAGTGGGCCTCCGTGCCCTGTTCCGGCGGCGGGGGGGGTGGCAGCAGGAACCTCCCCGTG
GCCACGCCGGACCCCGGCATGTTCCCGTGCCTGCACCACTCCCAAAACCTCCTGCGGGCCGTCAGCAACATGCTGCAAAAGGCGC
GGCAGACCCTGGAGTTTTACCCCTGTACCTCCGAAGAGATCGACCACGAGGATATCACCAAGGATAAGACCTCCACCGTGGAGGC
CTGTCTCCCCCTGGAGCTGACCAAGAACGAGAGCTGTCTTAACAGCAGAGAGACCTCGTTCATAACGAACGGCTCCTGCCTCGCT
TCCAGGAAGACGTCGTTCATGATGGCGCTGTGCCTGTCCAGCATCTACGAGGACCTGAAGATGTATCAGGTCGAGTTCAAAACCA
TGAACGCCAAGCTGCTGATGGACCCCAAGAGGCAGATCTTCCTGGACCAGAACATGCTCGCCGTGATCGACGAGCTGATGCAGGC
CCTGAACTTCAACAGCGAAACCGTGCCCCAGAAGTCAAGCCTGGAGGAGCCGGACTTCTATAAGACCAAGATCAAGCTGTGTATC
CTGCTACACGCTTTTCGTATCCGGGCCGTGACCATCGACAGGGTTATGTCGTACTTGAACGCCAGC

>hIL15RαB_028(SEQ ID NO: 841)
ATGTGCCACCAACAGCTCGTGATCAGCTGGTTCAGCCTGGTGTTCCTGGCCAGCCCGCTGGTGGCCATCTGGGAGCTGAAGAAGG
ACGTGTACGTGGTGGAGCTGGACTGGTACCCCGACGCCCCCGGCGAGATGGTGGTCCTGACCTGCGACACGCCGGAAGAGGACGG
CATCACCTGGACCCTGGATCAGTCCAGCGAGGTGCTGGGCTCCGGCAAGACCCTGACCATTCAGGTGAAGGAGTTCGGCGACGCC
GGTCAGTACACCTGCCACAAGGGCGGCGAGGTGCTGAGCCACAGCCTACTGCTCCTGCACAAAAAGGAGGATGGAATCTGGTCCA
CCGACATCCTCAAGGACCAGAAGGAGCCGAAGAACAAGACGTTCCTCCGGTGCGAGGCCAAGAACTACAGCGGCAGGTTTACCTG

TABLE 10-continued

Optimized sequences encoding human IL15, IL15Ra, or IL15Ra-IL15 fusion

CTGGTGGCTGACCACCATCAGCACCGACCTGACATTTTCCGTGAAGAGCAGCCGCGGCAGCAGCGATCCCCAGGGCGTGACCTGC
GGGGCGGCCACCCTGTCCGCCGAGCGTGTGAGGGGCGACAACAAGGAGTACGAGTACAGCGTGGAATGCCAGGAGGACAGCGCCT
GTCCCGCCGCCGAGGAGAGCCTGCCAATCGAGGTCATGGTGGACGCCGTGCACAAGCTGAAGTACGAGAACTACACGAGCAGCTT
CTTCATCAGGGACATCATCAAACCGGACCCGCCCAAGAACCTGCAGCTGAAACCCTTGAAAAACAGCAGGCAGGTGGAAGTGTCT
TGGGAGTACCCCGACACCTGGTCCACCCCCCACAGCTACTTTAGCCTGACCTTCTGTGTGCAGGTCCAGGGCAAGTCCAAGAGGG
AGAAGAAGGACAGGGTGTTCACCGACAAAACCAGCGCCACCGTGATCTGCAGGAAGAACGCCTCCATCAGCGTGCGGGCCCAGGA
CAGGTATTACAGCTCGTCGTGGAGCGAGTGGGCCAGCGTGCCCTGCTCCGGGGGAGGCGGCGGCGGAAGCCGGAATCTGCCCGTG
GCCACCCCCGATCCCGGCATGTTCCCGTGTCTGCACCACAGCCAGAACCTGCTGCGGGCCGTGAGCAACATGCTGCAGAAGGCCC
GCCAAACCCTGGAGTTCTACCCCTGTACAAGCGAGGAGATCGACCATGAGGACATTACCAAGGACAAGACCAGCACCGTGGAGGC
CTGCCTGCCCCTCGAGCTCACAAAGAACGAATCCTGCCTGAATAGCCGCGAGACCAGCTTTATCACGAACGGGTCCTGCCTCGCC
AGCCGGAAGACAAGCTTCATGATGGCCCTGTGCCTGAGCAGCATCTACGAGGACCTGAAAATGTACCAAGTGGAGTTCAAAACGA
TGAACGCCAAGCTGCTGATGGACCCCAAGCGCCAGATCTTCCTGGACCAGAACATGCTGGCCGTCATCGACGAGCTCATGCAGGC
CCTGAACTTCAACAGCGAGACCGTGCCCCAGAAGAGCAGCCTGGAGGAGCCCGACTTCTACAAGACGAAGATCAAGCTCTGCATC
CTGCTGCACGCTTTCCGCATCCGCGCGGTGACCATCGACCGGGTGATGAGCTACCTCAACGCCAGT

>hIL15RαB_029(SEQ ID NO: 842)
ATGTGCCACCAACAGCTGGTGATCAGCTGGTTCAGCCTGGTGTTTCTGGCCTCCCCTCTGGTGGCCATCTGGGAGCTGAAGAAGG
ACGTGTACGTGGTGGAGCTGGACTGGTACCCTGACGCCCCCGGCGAAATGGTGGTGCTGACGTGCGACACCCCCGAGGAGGATGG
CATCACCTGGACCCTGGACCAAAGCAGCGAGGTCCTCGGAAGCGGCAAGACCCTCACTATCCAAGTGAAGGAGTTCGGGGATGCG
GGCCAGTACACCTGCCACAAGGGCGGCGAGGTGCTGTCTCATAGCCTGCTGCTCCTGCATAAGAAGGAAGACGGCATCTGGAGCA
CCGACATACTGAAGGATCAGAAGGAGCCCAAGAACAAGACCTTCCTGAGGTGCGAGGCCAAGAACTACTCCGGGCGCTTCACCTG
TTGGTGGCTGACCACCATCTCCACCGACCTGACCTTCAGCGTGAAGAGCAGCAGGGGGGAGCAGCGACCCCCAGGGGGTGACCTGC
GGAGCCGCGACCTTGTCGGCCGAGCGGGTGAGGGGCGACAATAAGGAGTACGAGTACTCGGTCGAATGCCAGGAGGACTCCGCCT
GCCCCGCCGCCGAGGAGTCCCTCCCCATCGAAGTGATGGTGGACGCCGTCCACAAGCTGAAGTACGAGAACTACACCAGCAGCTT
CTTCATACGGGATATCATCAAGCCCGACCCCCCGAAGAACCTGCAGCTGAAACCCTTGAAGAACTCCAGGCAGGTGGAGGTGAGC
TGGGAGTACCCCGACACCTGGTCCACCCCGCACTCATACTTCAGCCTGACCTTCTGTGTACAGGTCCAGGGCAAGAGCAAGAGGG
AAAAGAAGGATAGGGTGTTCACCGACAAGACCTCCGCCACGGTGATCTGTCGGAAAAACGCCAGCATCTCCGTGCGGGCCCAGGA
CAGGTACTATTCCAGCAGCTGGAGCGAGTGGGCCTCCGTCCCCTGCTCCGGCGGCGGTGGCGGGGGCAGCAGGAACCTCCCCGTG
GCCACCCCCGATCCCGGGATGTTCCCATGCCTGCACCACAGCCAAAACCTGCTGAGGGCCGTCTCCAATATGCTGCAGAAGGCGA
GGCAGACCCTGGAGTTCTACCCCTGTACCTCCGAGGAGATCGACCACGAGGATATCACCAAGGACAAGACCTCCACGGTCGAGGC
GTGCCTGCCCCTGGAGCTCACGAAGAACGAGAGCTGCCTTAACTCCAGGGAAACCTCGTTTATCACGAACGGCAGCTGCCTGGCG
TCACGGAAGACCTCCTTTATGATGGCCCTATGTCTGTCCTCGATCTACGAGGACCTGAAGATGTACCAGGTGGAGTTCAAGACCA
TGAACGCCAAGCTGCTGATGGATCCCAAGAGGCAGATTTTCCTGGACCAGAACATGCTGGCCGTGATTGACGAGCTGATGCAGGC
GCTGAACTTCAACAGCGAGACAGTGCCGCAGAAGAGCTCCCTGGAGGAGCCGGACTTTTACAAGACCAAGATAAAGCTGTGCATC
CTGCTCCACGCCTTCAGAATACGGGCCGTCACCATCGATAGGGTGATGTCTTACCTGAACGCCTCC

>hIL15RαB_030(SEQ ID NO: 843)
ATGTGCCACCAGCAGCTGGTGATTAGCTGGTTTAGCCTGGTGTTCCTGGCAAGCCCCCTGGTGGCCATCTGGGAACTGAAAAAGG
ACGTGTACGTGGTCGAGCTGGATTGGTACCCCGACGCCCCCGGCGAAATGGTGGTGCTGACGTGTGATACCCCCGAGGAGGACGG
GATCACCTGGACCCTGGATCAGAGCAGCGAGGTGCTGGGGAGCGGGAAGACCCTGACGATCCAGGTCAAGGAGTTCGGCGACGCT
GGGCAGTACACCTGTCACAAGGGCGGGGAGGTGCTGTCCCACTCCCTGCTGCTCCTGCATAAGAAAGAGGACGGCATCTGGTCCA
CCGACATCCTCAAGGACCAGAAGGAGCCCAAGAACAAGACCTTCCTGCGGTGTGAGGCGAAGAACTACAGCGGCCGTTTCACCTG
CTGGTGGCTGACGACAATCAGCACCGACTTGACGTTCTCCGTGAAGTCCTCCAGAGGCAGCTCCGACCCCCAAGGGGTGACGTGC
GGCGCGGCCACCCTGAGCGCCGAGCGGGTGCGGGGGGACAACAAGGAGTACGAGTACTCCGTGGAGTGCCAGGAGGACAGCGCCT
GTCCCGCAGCCGAGGAGTCCCTGCCCATCGAAGTCATGGTGGACGCCGTCCACAAGCTGAAGTACGAGAACTACACCAGCAGCTT
CTTCATCCGCGATATCATCAAGCCCGATCCCCCCAAAAACCTGCAACTGAAGCCGCTGAAGAATAGCAGGCAGGTGGAGGTGTCC
TGGGAGTACCCGGACACCTGGAGCACGCCCCACAGCTATTTCAGCCTGACCTTTTGCGTGCAGGTCCAGGGGAAGAGCAAGCGGG
AGAAGAAGGACCGCGTGTTTACGGACAAAACCAGCGCCACCGTGATCTGCAGGAAGAACGCCAGCATCAGCGTGAGGGCCCAGGA
CAGGTACTACAGCAGCTCCTGGAGCGAGTGGGCCTCCGTGCCCTGTTCCGGAGGCGGCGGGGGCGGTTCCCGGAACCTCCCGGTG
GCCACCCCCGACCCGGGCATGTTCCCGTGCCTGCACCACTCACAGAATCTGCTGAGGGCCGTGAGCAATATGCTGCAGAAGGCAA
GGCAGACCCTGGAGTTTTATCCCTGCACCAGCGAGGAGATCGACCACGAAGACATCACCAAGGACAAGACCAGCACAGTGGAGGC
CTGCCTGCCCCTGGAACTGACCAAGAACGAGTCCTGTCTGAACTCCCGGGAAACCAGCTTCATAACCAACGGCTCCTGTCTCGCC
AGCAGGAAGACCAGCTTCATGATGGCCCTGTGCCTCAGCTCCATCTACGAGGACCTCAAGATGTACCAGGTTGAGTTCAAGACCA
TGAACGCCAAGCTCCTGATGGACCCCAAGAGGCAGATCTTCCTGGACCAGAATATGCTGGCCGTGATCGATGAGTTAATGCAGGC
GCTGAACTTCAACAGCGAGACGGTGCCCCAAAAGTCCTCGCTGGAGGAGCCCGACTTCTACAAGACCAAGATCAAGCTGTGCATC
CTCCTGCACGCCTTCCGAATCCGGGCCGTAACCATCGACAGGGTGATGAGCTATCTCAACGCCTCC

>hIL15RαB_031(SEQ ID NO: 844)
ATGTGCCACCAGCAGCTCGTGATCAGCTGGTTCTCGCTTGTGTTCCTGGCCTCCCCCCTCGTCGCCATCTGGGAGCTGAAGAAAG
ACGTGTACGTGGTGGAGCTGGACTGGTATCCCGACGCCCCGGGGGAGATGGTGGTGCTGACCTGCGACACCCCGGAAGAGGACGG
CATCACCTGGACGCTCGACCAGTCGTCCGAAGTGCTGGGGTCGGGCAAGACCCTCACCATCCAGGTGAAGGAGTTCGGAGACGCC
GGCCAGTACACCTGTCATAAGGGGGGGGAGGTGCTGAGCCACAGCCTCCTGCTCCTGCACAAAAAGGAGGACGGCATCTGGAGCA
CCGATATCCTCAAGGACCAGAAGGAGCCCAAGAACAAGACGTTCCTGAGGTGTGAGGCCAAGAACTACAGCGGGCGGTTCACGTG
TTGGTGGCTCACCACCATCTCCACCGACCTCACCTTCTCCGTGAAGTCAAGCAGGGGCAGCTCCGACCCCCAAGGCGTCACCTGC
GGCGCCGCCACCCTGAGCGCCGAGAGGGTCAGGGGGGATAACAAGGAATACGAGTACAGTGTGGAGTGCCAAGAGGATAGCGCCT
GTCCCGCCGCCGAAGAGAGCCTGCCCATCGAAGTGATGGTGGACGCCGTGCACAAGCTGAAGTACGAGAACTACACCTCCAGCTT
CTTCATCAGGGATATCATCAAGCCCGATCCCCCCAAGAACCTGCAGCTGAAGCCCCTGAAGAACAGCAGGCAGGTGGAGGTGAGC
TGGGAGTATCCCGACACGTGGAGCACCCCGCACAGCTACTTCTCGCTGACCTTCTGCGTGCAGGTGCAAGGGAAGTCCAAGAGGG
AGAAGAAGGATAGGGTGTTCACCGACAAAACGAGCGCCACCGTGATCTGCCGGAAGAATGCCAGCATCTCTGTGAGGGCCCAGGA
CAGGTACTATTCCAGCTCCTGGTCGGAGTGGGCCAGCGTGCCCTGTAGCGGCGGGGGCGGGGGCGGCAGCAGGAACCTCCCGGTT
GCCACCCCCGACCCCGGCATGTTTCCGTGCCTGCACCACTCGCAAAACCTGCTGCGCGCGGTCTCCAACATGCTGCAAAAAGCGC
GCCAGACGCTGGAGTTCTACCCCTGCACCAGCGAGGAGATCGATCATGAAGATATCACCAAAGACAAGACCTCGACCGTGGAGGC
CTGCCTGCCCCTGGAGCTCACCAAGAACGAAAGCTGCCTGAACAGCAGGGAGACAAGCTTCATCACCAACGGCAGCTGCCTGGCC
TCCCGGAAGACCAGCTTCATGATGGCCCTGTGCCTGTCCAGCATCTACGAGGATCTGAAGATGTACCAAGTGGAGTTTAAGACCA
TGAACGCCAAGCTGTTAATGGACCCCAAAAGGCAGATCTTCCTGGATCAGAACATGCTGGCCGTCATCGACGAGCTGATGCAAGC
CCTGAACTTCAACAGCGAGACGGTGCCCCAGAAGAGCAGCCTCGAGGAGCCCGACTTCTATAAGACCAAGATAAAGCTGTGCATT
CTGCTGCACGCCTTCAGAATCAGGGCCGTGACCATCGATAGGGTGATGAGCTACCTGAACGCCAGC

TABLE 10-continued

Optimized sequences encoding human IL15, IL15Ra, or IL15Ra-IL15 fusion

>hIL15RαB_032(SEQ ID NO: 845)
ATGTGTCACCAGCAGCTGGTGATTTCCTGGTTCAGTCTGGTGTTTCTTGCCAGCCCCCTGGTGGCCATCTGGGAGCTGAAGAAAG
ACGTATACGTCGTGGAGCTGGACTGGTATCCCGACGCTCCCGGCGAGATGGTGGTCCTCACCTGCGACACCCCAGAGGAGGACGG
CATCACCTGGACCCTGGACCAGAGCTCCGAGGTCCTGGGCAGCGGTAAGACCCTCACCATCCAGGTGAAGGAGTTTGGTGATGCC
GGGCAGTATACCTGCCACAAGGGCGGCGAGGTGCTGTCCCACAGCCTCCTGTTACTGCATAAGAAGGAGGATGGCATCTGGAGCA
CCGACATCCTCAAGGACCAGAAAGAGCCCAAGAACAAGACCTTTCTGCGGTGCGAGGCGAAAAATTACTCCGGCCGGTTCACCTG
CTGGTGGCTGACCACCATCAGCACGGACCTGACGTTCTCCGTGAAGTCGAGCAGGGGGAGCTCCGATCCCCAGGGCGTGACCTGC
GGCGCGGCCACCCTGAGCGCCGAGCGCGTCCGCGGGGACAATAAGGAATACGAATATAGCGTGGAGTGCCAGGAGGACAGCGCCT
GCCCCGCGGCCGAGGAGAGCCTCCCGATCGAGGTGATGGTGGATGCCGTCCACAAGCTCAAATACGAAAACTACACCAGCAGCTT
CTTCATTAGGGACATCATCAAGCCCGACCCCCCCAAAAACCTGCAGCTGAAGCCCCTGAAGAACAGCCGCCAGGTCGAGGTGTCA
TGGGAGTACCCAGACACCTGGAGCACCCCCCACTCCTACTTCAGCCTGACCTTCTGCGTCCAGGTGCAGGGAAAGTCCAAACGGG
AGAAGAAGGATAGGGTCTTTACCGATAAGACGTCGGCCACCGTCATCTGCAGGAAGAACGCCAGCATAAGCGTGCGGGCGCAGGA
TCGGTACTACAGCTCGAGCTGGTCCGAATGGGCCTCCGTGCCCTGTAGCGGAGGGGGTGGCGGGGGCAGCAGGAACCTGCCCGTG
GCCACCCCGGACCCGGGCATGTTTCCCTGCCTGCATCACAGTCAGAACCTGCTGAGGGCCGTGAGCAACATGCTCCAGAAGGCCC
GCCAGACCCTGGAGTTTTACCCCTGCACCAGCGAAGAGATCGATCACGAAGACATCACCAAAGACAAGACCTCCACCGTGGAGGC
CTGTCTGCCCCTGGAGCTGACCAAGAACGAGAGCTGTCTGAACAGCAGGGAGACCTCCTTCATCACCAACGGCTCCTGCCTGGCA
TCCCGGAAGACCAGCTTCATGATGGCCCTGTGTCTGAGCTCTATCTACGAGGACCTGAAGATGTACCAGGTCGAGTTCAAGACCA
TGAACGCCAAGCTGCTGATGGACCCCAAGCGACAGATATTCCTGGACCAGAACATGCTCGCCGTGATCGATGAACTGATGCAAGC
CCTGAACTTCAATAGCGAGACCGTGCCCCAGAAAAGCAGCCTGGAGGAGCCCGACTTCTACAAGACCAAGATCAAACTGTGCATA
CTGCTGCACGCGTTCAGGATCCGGGCCGTCACCATCGACCGGGTGATGTCCTATCTGAATGCCAGC

>hIL15RαB_033(SEQ ID NO: 846)
ATGTGCCACCAGCAGCTCGTGATTAGCTGGTTTTCGCTGGTGTTCCTGGCCAGCCCTCTCGTGGCCATCTGGGAGCTGAAAAAAG
ACGTGTACGTGGTGGAGCTGGACTGGTACCCGGACGCCCCCGGCGAGATGGTGGTGCTGACGTGCGACACCCCGGAAGAGGACGG
CATCACCTGGACCCTGGACCAGTCATCCGAGGTCCTGGGCAGCGGCAAGACGCTCACCATCCAGGTGAAGGAGTTCGGCGACGCC
GGCCAGTACACATGCCATAAGGGCGGGGAGGTGCTGAGCCACAGCCTGCTCCTCCTGCACAAGAAGGAGGATGGCATCTGGTCTA
CAGACATCCTGAAGGACCAGAAAGAGCCCAAGAACAAGACCTTCCTCCGGTGCGAGGCCAAGAACTACTCCGGGCGGTTTACTTG
TTGGTGGCTGACCACCATCAGCACCGACCTCACCTTCAGCGTGAAGAGCTCCCGAGGGAGCTCCGACCCCCAGGGGGTCACCTGC
GGCGCCGCCACCCTGAGCGCCGAGCGGGTGAGGGGCGACAACAAGGAGTATGAATACAGCGTGGAATGCCAAGAGGACAGCGCCT
GTCCCGCGGCCGAGGAAAGCCTGCCCATCGAGGTGATGGTGGACGCCGTCCACAAACTCAAGTACGAGAACTACACCAGCAGTTT
CTTCATTCGCGACATCATCAAGCCGGACCCCCCCAAAAACCTGCAGCTCAAACCCCTGAAGAACAGCAGGCAGGTGGAGGTCAGC
TGGGAGTACCCGGACACCTGGAGCACCCCCCATAGCTACTTCAGCCTGACCTTCTGCGTGCAGGTGCAGGGCAAGAGCAAACGCG
AGAAGAAGGACCGGGTGTTTACCGACAAGACCAGCGCCACGGTGATCTGCCGAAAGAATGCAAGCATCTCCGTGAGGGCGCAGGA
CCGCTACTACTCTAGCAGCTGGAGCGAGTGGGCCAGCGTGCCCTGCAGCGGTGGCGGCGGAGGCGGCAGCCGTAACCTCCCCGTG
GCCACCCCCGACCCCGGCATGTTCCCGTGTCTGCACCACTCCCAGAACCTGCTGAGGGCCGTCAGCAATATGCTGCAGAAGGCCC
GGCAGACGCTGGAGTTCTACCCCTGCACCTCCGAGGAGATCGACCATGAGGACATTACCAAGGACAAGACGAGCACTGTGGAGGC
CTGCCTGCCCCTGGAGCTCACCAAAAACGAGAGCTGCCTGAATAGCAGGGAGACGTCCTTCATCACCAACGGCAGCTGTCTGGCC
AGCAGGAAGACCAGCTTCATGATGGCCCTGTGCCTCTCCTCCATATATGAGGATCTGAAGATGTACCAGGTGGAGTTCAAGACCA
TGAACGCCAAGCTGCTGATGGATCCCAAGAGGCAGATCTTCCTGGACCAGAATATGCTGGCCGTGATTGACGAGCTGATGCAGGC
CCTGAACTTTAATAGCGAGACCGTCCCCCAGAAGAGCAGCCTGGAGGAGCCCGACTTCTATAAGACCAAGATCAAGCTGTGCATA
CTGCTGCACGCGTTTAGGATAAGGGCCGTCACCATCGACAGGGTGATGAGCTACCTGAATGCCAGC

>hIL15RαB_034(SEQ ID NO: 847)
ATGTGCCACCAACAGCTGGTGATCTCCTGGTTCAGCCTGGTGTTCCTCGCCAGCCCCCTGGTGGCCATCTGGGAGCTGAAGAAAG
ACGTGTACGTGGTGGAGCTGGACTGGTATCCCGACGCCCCCGGCGAGATGGTCGTGCTGACCTGCGACACCCCGGAGGAGGACGG
CATCACCTGGACCCTGGATCAGTCCTCCGAGGTGCTGGGCAGCGGGAAGACCCTGACCATCCAGGTGAAAGAGTTCGGAGATGCC
GGCCAGTATACCTGTCACAAGGGGGGTGAGGTGCTGAGCCATAGCCTCTTGCTTCTGCACAAGAAGGAGGACGGCATCTGGTCCA
CCGACATCCTCAAGGACCAAAAGGAGCCGAAGAATAAAACGTTCCTGAGGTGCGAAGCCAAGAACTATTCCGGACGGTTCACCTG
CTGGTGGCTGACCACCATCAGCACCGACCTCACCTTCTCCGTAAAGTCAAGCAGGGGCAGCTCCGACCCCCAGGGCGTGACCTGC
GGAGCCGCCACCCTGAGCGCAGAGAGGGTGAGGGGCGACAACAAGGAGTACGAATACTCCGTCGAGTGCCAGGAGGACAGCGCCT
GCCCCGCCGCCGAGGAAAGTCTGCCCATCGAGGTGATGGTGGACGCCGTGCACAAGCTCAAATACGAGAACTACACCAGCAGCTT
CTTCATCCGGGATATCATCAAGCCCGACCCTCCAAAGAATCTGCAGCTGAAACCCCTTAAGAACAGCAGGCAGGTGGAGGTCAGC
TGGGAGTACCCCGACACCTGGAGCACGCCCCACTCCTACTTTAGCCTGACCTTTTGCGTGCAGGTGCAGGGGAAAAGCAAGCGGG
AGAAGAAGGACAGGGTGTTCACCGATAAGACCTCCGCTACCGTGATCTGCAGGAAGAACGCCTCAATCAGCGTGAGGGCCCAGGA
TCGGTACTACTCCAGCTCCTGGAGCGAGTGGGCCAGCGTGCCCTGCTCTGGCGGTGGCGGCGGGGGCAGCCGGAACCTGCCGGTG
GCCACTCCCGACCCGGGCATGTTCCCGTGCCTCCACCATTCCCAGAACCTGCTGCGGGCCGTGTCCAATATGCTCCAGAAGGCAA
GGCAGACCCTGGAGTTCTACCCCTGCACCAGCGAGGAGATCGATCACGAGGACATCACCAAAGACAAAACCAGCACGGTCGAGGC
CTGCCTGCCCCTGGAACTCACCAAGAACGAAAGCTGTCTCAACAGCCGCGAGACCAGCTTCATAACCAACGGTTCCTGTCTGGCC
TCCCGCAAGACCAGCTTTATGATGGCCCTCTGTCTGAGCTCCATCTATGAAGACCTGAAAATGTACCAGGTGGAGTTCAAAACCA
TGAACGCCAAGCTTCTGATGGACCCCAAGAGGCAGATCTTCCTGGATCAGAACATGCTGGCCGTGATCGACGAGCTGATGCAGGC
CCTGAACTTTAACTCCGAGACCGTGCCCCAGAAAAGCAGCCTGGAAGAGCCCGATTTCTACAAAACGAAGATCAAGCTGTGCATC
CTGCTGCACGCCTTCCGGATCCGTGCGGTGACCATCGATAGGGTGATGAGCTACCTGAACGCCAGC

>hIL15RαB_035(SEQ ID NO: 848)
ATGTGCCACCAACAGCTGGTAATCAGCTGGTTCAGCCTGGTTTTCCTCGCGTCGCCCCTGGTGGCCATCTGGGAGTTAAAGAAGG
ACGTGTACGTGGTGGAGCTGGATTGGTACCCCGACGCCCCGGGCGAGATGGTCGTGCTCACCTGCGATACCCCCGAGGAGGACGG
GATCACCTGGACCCTGGACCAATCCAGCGAGGTGCTGGGCAGCGGCAAGACCCTGACCATACAGGTGAAGGAATTTGGGGACGCC
GGGCAGTACACCTGCCACAAGGGCGGGGAAGTGCTGTCCCACTCCCTCCTGCTGCTGCATAAGAAGGAGGACGGCATCTGGAGCA
CCGACATCCTGAAGGACCAAAAGGAGCCCAAGAACAAGACCTTCCTGAGGTGCGAGGCCAAAAACTATTCCGGCCGCTTTACCTG
TTGGTGGCTGACCACCATCTCCACCGATCTGACCTTCAGCGTGAAGTCGTCTAGGGGCTCCTCCGACCCCCAGGGCGTAACCTGC
GGCGCCGCGACCCTGAGCGCCGAGAGGGTGCGGGGCGATAACAAAGAGTACGAGTACTCGGTGGAGTGCCAGGAGGACAGCGCCT
GTCCGGCGGCCGAGGAGAGCCTGCCCATCGAGGTGATGGTGGACGCCGTCCACAAGCTGAAGTACGAGAACTACACCAGTTCGTT
CTTCATCAGGGACATCATCAAGCCGGACCCCCCCAAGAACCTCCAGCTGAAGCCCCTGAAGAACAGCAGGCAGGTGGAAGTGTCC
TGGGAGTATCCCGACACCTGGAGCACCCCCCACAGCTACTTCAGCCTGACCTTTTGCGTGCAGGTGCAGGGCAAAAGCAAGAGGG
AAAAGAAGGACCGGGTGTTCACCGATAAGACGAGCGCCACCGTTATCTGCAGGAAGAACGCCTCCATAAGCGTGAGGGCGCAGGA
CCGTTACTACAGCAGCAGCTGGAGTGAGTGGGCAAGCGTGCCCTGTAGCGGCGGGGGCGGGGGCGGGTCCCGCAACCTCCCCGTC
GCCACCCCCGACCCAGGCATGTTTCCGTGCCTGCACCACAGCCAGAACCTGCTGCGGGCCGTTAGCAACATGCTGCAGAAGGCCA
GGCAGACCCTCGAGTTCTATCCCTGCACATCTGAGGAGATCGACCACGAAGACATCACTAAGGATAAGACCTCCACCGTGGAGGC

TABLE 10-continued

Optimized sequences encoding human IL15, IL15Ra, or IL15Ra-IL15 fusion

CTGTCTGCCCCTCGAGCTGACCAAGAATGAATCCTGCCTGAACAGCCGAGAGACCAGCTTTATCACCAACGGCTCCTGCCTGGCC
AGCAGGAAGACCTCCTTCATGATGGCCCTGTGCCTCTCCAGCATCTACGAGGATCTGAAGATGTACCAGGTAGAGTTCAAGACGA
TGAACGCCAAGCTCCTGATGGACCCCAAGAGGCAGATATTCCTGGACCAGAACATGCTGGCGGTGATCGACGAGCTGATGCAGGC
CCTGAATTTCAACAGCGAGACGGTGCCACAGAAGTCCAGCCTGGAGGAGCCAGACTTCTACAAGACCAAGATCAAACTGTGCATC
CTCCTGCACGCGTTCAGGATCCGCGCCGTCACCATAGACAGGGTGATGAGTTATCTGAACGCCAGC

>hIL15RαB_036(SEQ ID NO: 849)
ATGTGCCATCAGCAGCTGGTAATCAGCTGGTTTAGCCTGGTGTTCCTGGCCAGCCCACTGGTGGCCATCTGGGAGCTGAAGAAGG
ACGTGTACGTGGTGGAACTGGACTGGTACCCCGACGCCCCTGGCGAGATGGTGGTACTGACCTGTGACACCCCGGAGGAAGACGG
TATCACCTGGACCCTGGATCAGAGCTCCGAGGTGCTGGGCTCCGGCAAGACACTGACCATCCAAGTTAAGGAATTTGGGGACGCC
GGCCAGTACACCTGCCACAAGGGGGGCGAGGTGCTGTCCCACTCCCTGCTGCTTCTGCATAAGAAGGAGGATGGCATCTGGTCCA
CCGACATACTGAAGGACCAGAAGGAGCCCAAGAATAAGACCTTCCTGAGATGCGAGGCCAAGAACTACTCGGGAAGGTTCACCTG
CTGGTGGCTGACCACCATCAGCACCGACCTGACCTTCTCCGTGAAGAGCTCCCGGGGCAGCTCCGACCCCCAGGGCGTAACCTGT
GGGGCCGCTACCCTGTCCGCCGAGAGGGTCCGGGGCGACAACAAGGAATACGAGTACAGCGTGGAGTGCCAGGAGGACTCCGCCT
GCCCCGCCGCCGAGGAGTCGCTGCCCATAGAGGTGATGGTGGACGCCGTGCACAAGCTCAAGTACGAGAATTACACCAGCAGCTT
CTTTATCAGGGACATAATTAAGCCGGACCCCCCAAAGAATCTGCAGCTGAAGCCCCTGAAGAATAGCCGGCAGGTGGAAGTGTCC
TGGGAGTACCCCGACACCTGGAGCACCCCCCACTCCTATTTCTCACTGACATTCTGCGTGCAGGTGCAAGGGAAAAGCAAGAGGG
AGAAGAAGGATAGGGTGTTCACCGACAAGACAAGCGCCACCGTGATCTGCCGAAAAAATGCCAGCATCAGCGTGAGGGCCCAGGA
TCGGTATTACAGCAGCTCCTGGAGCGAGTGGGCCAGCGTGCCCTGTTCCGGCGGGGGAGGGGGCGGCTCCCGGAACCTGCCGGTG
GCCACCCCCGACCCTGGCATGTTCCCCTGCCTGCATCACAGCCAGAACCTGCTCCGGGCCGTGTCGAACATGCTGCAGAAGGCCC
GGCAGACCCTCGAGTTTTACCCCTGCACCAGCGAAGAGATCGACCACGAAGACATAACCAAGGACAAGACCAGCACGGTGGAGGC
CTGCCTGCCCCTGGAGCTTACCAAAAACGAGTCCTGCCTGAACAGCCGGGAAACCAGCTTCATAACGAACGGGAGCTGCCTGGCC
TCCAGGAAGACCAGCTTCATGATGGCGCTGTGTCTGTCCAGCATATACGAGGATCTGAAGATGTATCAGGTGGAATTCAAAACTA
TGAATGCCAAGCTCCTGATGGACCCCAAGAGGCAGATCTTCCTGGACCAGAACATGCTAGCCGTGATCGACGAGCTGATGCAGGC
CCTCAACTTCAACTCGGAGACGGTGCCCCAGAAGTCCAGCCTCGAGGAGCCCGACTTCTACAAGACCAAGATCAAGCTGTGCATA
CTGCTGCATGCCTTCAGGATAAGGGCGGTGACTATCGACAGGGTCATGTCCTACCTGAACGCCAGC

>hIL15RαB_037(SEQ ID NO: 850)
ATGTGCCACCAACAACTGGTGATCAGCTGGTTCTCCCTGGTGTTCCTGGCCAGCCCCCTGGTGGCCATCTGGGAGCTCAAAAAAG
ACGTGTACGTGGTGGAGCTCGATTGGTACCCAGACGCGCCGGGGGAAATGGTGGTGCTGACCTGCGACACCCCAGAGGAGGATGG
CATCACGTGGACGCTGGATCAGTCCAGCGAGGTGCTGGGGAGCGGCAAGACGCTCACCATCCAGGTGAAGGAATTTGGCGACGCG
GGCCAGTATACCTGTCACAAGGGCGGCGAGGTGCTGAGCCACTCCCTGCTGCTGCTGCACAAGAAGGAGGATGGGATCTGGTCAA
CCGATATCCTGAAAGACCAGAAGGAGCCCAAGAACAAGACCTTCCTGCGCTGCGAGGCCAAGAACTATAGCGGCAGGTTCACCTG
CTGGTGGCTGACCACCATCAGCACCGACCTGACCTTCAGCGTGAAATCCTCCAGGGGCAGCAGCGACCCCCAGGGCGTGACCTGC
GGTGCCGCCACGCTCTCCGCCGAGCGAGTGAGGGGTGACAACAAGGAGTACGAGTACAGCGTGGAATGTCAGGAGGACAGCGCCT
GTCCCGCCGCCGAGGAGTCGCTGCCCATCGAGGTGATGGTCGACGCGGTGCACAAGCTCAAATACGAGAATTACACCAGCAGCTT
CTTCATCAGGGACATCATCAAGCCCGACCCCCCCAAGAACCTGCAGCTGAAGCCCTTGAAGAACAGCAGGCAGGTGGAGGTGAGC
TGGGAGTACCCGGACACCTGGAGCACCCCCCACTCCTACTTCAGCCTGACGTTCTGTGTGCAGGTGCAGGGGAAGTCCAAGAGGG
AGAAGAAGGACCGGGTGTTCACCGACAAGACCAGCGCCACCGTGATATGCCGCAAGAACGCGTCCATCAGCGTTCGCGCCCAGGA
CCGCTACTACAGCAGCTCCTGGTCCGAATGGGCCAGCGTGCCCTGCAGCGGTGGAGGGGGCGGGGGCTCCAGGAATCTGCCGGTG
GCCACCCCCGACCCCGGGATGTTCCCGTGTCTGCATCACTCCCAGAACCTGCTGCGGGCCGTGAGCAATATGCTGCAGAAGGCCA
GGCAGACGCTCGAGTTCTACCCCTGCACCTCCGAAGAGATCGACCATGAGGACATCACCAAGGACAAGACCAGCACCGTGGAGGC
CTGCCTCCCCCTGGAGCTGACCAAAAACGAGAGCTGCCTGAACTCCAGGGAGACCAGCTTTATAACCAACGGCAGCTGCCTCGCC
TCCAGGAAGACCTCGTTTATGATGGCCCTCTGCCTGTCCAGCATCTACGAGGACCTGAAGATGTACCAGGTGGAGTTCAAGACCA
TGAACGCGAAGTTGCTCATGGACCCCAAGAGGCAGATCTTCCTGGACCAGAACATGCTCGCGGTGATCGACGAGCTGATGCAAGC
CCTGAACTTCAACAGCGAGACCGTGCCCCAGAAGAGCAGCCTGGAAGAGCCCGACTTCTACAAGACCAAGATCAAGCTGTGCATC
CTGCTGCACGCCTTCCGGATCCGGGCCGTGACCATCGACAGGGTGATGAGCTACCTCAACGCCTCC

>hIL15RαB_038(SEQ ID NO: 851)
ATGTGCCACCAGCAGCTCGTGATCAGCTGGTTCTCCCTCGTCTTCCTGGCCTCCCCGCTGGTGGCCATCTGGGAGCTGAAGAAGG
ACGTGTACGTGGTGGAGCTGGACTGGTATCCCGACGCCCCCGGCGAGATGGTGGTGCTGACGTGCGACACACCAGAAGAGGACGG
GATCACATGGACCCTGGATCAGTCGTCCGAGGTGCTGGGGAGCGGCAAGACCCTCACCATCCAAGTGAAGGAGTTCGGGGACGCC
GGCCAGTACACCTGCCACAAGGGCGGGGAGGTGCTCTCCCATAGCCTGCTCCTCCTGCACAAAAAGGAGGATGGCATCTGGAGCA
CCGACATCCTGAAGGACCAGAAGGAGCCCAAGAACAAGACATTTCTCAGGTGTGAGGCCAAGAACTATTCGGGCAGGTTTACCTG
TTGGTGGCTCACCACCATCTCTACCGACCTGACGTTCTCCGTCAAGTCAAGCAGGGGGAGCTCGGACCCCCAGGGGGTGACATGT
GGGGCCGCCACCCTGAGCGCGGAGCGTGTCCGCGGCGACAACAAGGAGTACGAGTATTCCGTGGAGTGCCAGGAGGACAGCGCCT
GCCCCGCCGCCGAGGAGTCCCTGCCCATAGAGGTGATGGTGGACGCCGTCCACAAGTTGAAGTACGAAAATTATACCTCCTCGTT
CTTCATTAGGGACATCATCAAGCCTGACCCCCCGAAGAACCTACAACTCAAGCCCCTCAAGAACTCCCGCCAGGTGGAGGTGTCC
TGGGAGTACCCCGACACCTGGTCCACCCCGCACAGCTACTTCAGCCTGACCTTCTGCGTGCAGGTCCAGGGGAAGAGCAAGCGTG
AAAAGAAAGACAGGGTGTTCACCGACAAGACGAGCGCCACCGTGATCTGCAGGAAAAACGCCTCCATCTCCGTGCGCGCCCAGGA
CAGGTACTACAGTAGCTCCTGGAGCGAATGGGCCAGCGTGCCGTGCAGCGGCGGGGGAGGAGGCGGCAGTCGCAACCTGCCCGTG
GCCACCCCCGACCCCGGCATGTTCCCATGCCTGCACCACAGCCAGAACCTGCTGAGGGCAGTCAGCAATATGCTGCAGAAGGCCA
GGCAGACCCTGGAGTTTTATCCCTGCACCAGCGAGGAGATCGACCACGAGGACATCACCAAGGACAAGACCTCCACCGTCGAGGC
CTGCCTGCCACTGGAGCTGACCAAAAACGAGAGCTGCCTGAACTCCAGGGAGACCTCCTTCATCACCAACGGGAGCTGCCTGGCC
AGCCGGAAGACCAGCTTCATGATGGCGCTGTGCCTCAGCAGCATCTACGAGGATCTCAAGATGTACCAGGTGGAGTTCAAGACCA
TGAACGCGAAGCTGCTGATGGACCCCAAGCGGCAGATCTTCCTGGACCAGAACATGCTGGCCGTGATTGACGAGCTCATGCAGGC
CCTGAACTTCAATAGCGAGACCGTCCCCCAAAAGAGCAGCCTGGAGGAACCCGACTTCTACAAAACGAAGATCAAGCTCTGCATC
CTGCTGCACGCCTTCCGGATCCGGGCCGTGACCATCGATCGTGTGATGAGCTACCTGAACGCCTCG

>hIL15RαB_039(SEQ ID NO: 852)
ATGTGCCACCAGCAGCTCGTCATCTCCTGGTTTAGCCTGGTGTTTCTGGCCTCCCCCCTGGTCGCCATCTGGGAGCTGAAGAAAG
ACGTGTACGTGGTGGAGCTGGACTGGTACCCGGACGCTCCCGGGGAGATGGTGGTGCTGACCTGCGACACCCCCGAGGAGGACGG
CATCACCTGGACCCTGGACCAGAGCTCCGAGGTGCTGGGGAGCGGCAAGACCCTGACCATTCAGGTGAAAGAGTTCGGCGACGCC
GGCCAATATACCTGCCACAAGGGGGGGGAGGTCCTGTCGCATTCCCTGCTGCTGCTTCACAAAAAGGAGGATGGCATCTGGAGCA
CCGACATCCTGAAGGACCAGAAAGAACCCAAGAACAAGACGTTCCTGCGCTGCGAGGCCAAGAACTACAGCGGCCGGTTCACCTG
TTGGTGGCTGACCACCATCTCCACCGACCTGACTTTCTCGGTGAAGAGCAGCCGCGGGAGCAGCGACCCCCAGGGAGTGACCTGC
GGCGCCGCCACCCTGAGCGCCGAAAGGGTGAGGGGCGACAATAAAGAGTACGAGTATTCCGTGGAGTGCCAGGAGGACAGCGCCT
GTCCCGCCGCCGAGGAGTCCCTGCCTATCGAGGTGATGGTCGACGCGGTGCACAAGCTCAAGTACGAAAACTACACCAGCAGCTT

TABLE 10-continued

| Optimized sequences encoding human IL15, IL15Ra, or IL15Ra-IL15 fusion |
|---|
| TTTCATCAGGGATATCATCAAACCAGACCCCCCCAAGAACCTGCAGCTGAAGCCCCTGAAAAACAGCAGGCAGGTGGAAGTGAGC<br>TGGGAATACCCCGATACCTGGTCCACCCCCCACAGCTACTTCAGCCTGACCTTCTGCGTGCAGGTGCAGGGGAAGTCCAAGCGGG<br>AGAAGAAAGATCGGGTGTTCACGGACAAGACCAGCGCCACCGTGATTTGCAGGAAAAACGCCAGCATCTCCGTGAGGGCTCAGGA<br>CAGGTACTACAGCTCCAGCTGGAGCGAGTGGGCCTCCGTGCCTTGCAGCGGGGGAGGAGGCGGCGGCAGCAGGAATCTGCCCGTC<br>GCAACCCCCGACCCCGGCATGTTCCCCTGCCTGCACCACAGCCAGAATCTGCTGCGAGCCGTGAGCAACATGCTCCAGAAGGCCC<br>GGCAGACGCTGGAGTTCTACCCCTGCACCTCCGAGGAGATCGACCACGAGGACATCACCAAGGATAAGACGAGCACCGTCGAGGC<br>CTGTCTCCCCCTGGAGCTCACCAAGAACGAGTCCTGCCTGAATAGCAGGGAGACGTCCTTCATAACCAACGGCAGCTGTCTGGCG<br>TCCAGGAAGACCAGCTTCATGATGGCCCTCTGCCTGAGCTCCATCTACGAGGACCTCAAGATGTACCAGGTCGAGTTCAAGACCA<br>TGAACGCAAAACTGCTCATGGATCCAAAGAGGCAGATCTTTCTGGACCAGAACATGCTGGCCGTGATCGATGAACTCATGCAGGC<br>CCTGAATTTCAATTCCGAGACCGTGCCCCAGAAGAGCTCCCTGGAGGAACCCGACTTCTACAAAACAAAGATCAAGCTGTGTATC<br>CTCCTGCACGCCTTCCGGATCAGGGCCGTCACCATTGACCGGGTGATGTCCTACCTGAACGCCAGC |
| >hIL15RαB_040(SEQ ID NO: 853)<br>ATGTGCCATCAGCAGCTGGTGATCAGCTGGTTCAGCCTCGTGTTCCTCGCCAGCCCCCTCGTGGCCATCTGGGAGCTGAAAAAGG<br>ACGTGTACGTGGTGGAGCTGGACTGGTATCCCGACGCCCCGGGCGAGATGGTGGTGCTGACCTGCGACACCCCCGAGGAGGACGG<br>CATTACCTGGACACTGGACCAGAGCAGCGAGGTCCTGGGCAGCGGGAAGACCCTGACAATTCAGGTGAAGGAGTTCGGCGACGCC<br>GGACAGTACACGTGCCACAAGGGGGGGGAGGTGCTGTCCCACAGCCTCCTCCTGCTGCACAAGAAGGAGGATGGCATCTGGAGCA<br>CCGACATCCTGAAGGATCAGAAGGAGCCCAAGAACAAGACCTTTCTGAGATGCGAGGCCAAGAATTACAGCGGCCGTTTCACCTG<br>CTGGTGGCTCACCACCATCAGCACCGACCTGACCTTCAGCGTGAAATCCTCCAGGGGCTCCTCCGACCCGCAGGGAGTGACCTGC<br>GGCGCCGCCACACTGAGCGCCGAGCGGGTCAGAGGGGACAACAAGGAGTACGAGTACAGCGTTGAGTGCCAGGAGGACAGCGCCT<br>GTCCCGCGGCCGAGGAATCCCTGCCCATCGAGGTGATGGTGGACGCAGTGCACAAGCTGAAGTACGAGAACTATACCTCGAGCTT<br>CTTCATCCGGGATATCATTAAGCCCGATCCCCCGAAGAACCTGCAGCTCAAACCCCTGAAGAACAGCAGGCAGGTGGAGGTCTCC<br>TGGGAGTACCCCGACACATGGTCCACCCCCCATTCCTATTTCTCCCTGACCTTTTGCGTGCAGGTGCAGGGCAAGAGCAAGAGGG<br>AGAAAAAGGACAGGGTGTTCACCGACAAGACCTCCGCCACCGTGATCTGCCGTAAGAACGCTAGCATCAGCGTCAGGGCCCAGGA<br>CAGGTACTATAGCAGCTCCTGGTCCGAGTGGGCCAGCGTCCCGTGCAGCGGCGGGGGCGGTGGAGGCTCCCGGAACCTCCCCGTG<br>GCCACCCCGGACCCCGGGATGTTTCCCTGCCTGCATCACAGCCAGAACCTGCTGAGGGCCGTGTCCAACATGCTGCAGAAGGCCA<br>GGCAGACACTCGAGTTTTACCCCTGCACCAGCGAGGAGATCGACCACGAAGACATCACCAAGGACAAGACCTCCACCGTGGAGGC<br>ATGCCTGCCCCTGGAGCTGACCAAAAACGAAAGCTGTCTGAACTCCAGGGAGACCTCCTTTATCACGAACGGCTCATGCCTGGCC<br>TCCAGAAAGACCAGCTTCATGATGGCCCTGTGCCTGAGCTCCATCTACGAGGACTTGAAAATGTACCAGGTCGAGTTCAAGACCA<br>TGAACGCCAAGCTGCTCATGGACCCCAAAAGGCAGATCTTTCTGGACCAGAATATGCTGGCCGTGATCGACGAGCTCATGCAAGC<br>CCTGAATTTCAACAGCGAGACCGTGCCCCAGAAGTCCTCCCTGGAGGAGCCCGACTTCTACAAGACCAAGATCAAGCTGTGCATA<br>CTCCTGCACGCGTTTAGGATCAGGGCGGTGACCATCGATAGGGTGATGAGCTACCTGAATGCCTCC |

TABLE 11

Additional sequence optimized nucleic acid encoding IL15 polypeptides

| SEQ ID NO | Name | Sequence |
|---|---|---|
| 854 | IL15opt-tPa6-CO01 | ATGGACGCCATGAAGCGCGGGCTCTGCTGCGTCCTCCTCCTCTGCGGGGCCGTTTTCGTTAG<br>CCCCAGCCAGGAGATCCACGCCCGGTTCAGGAGGGGGGCCAGGAATTGGGTCAACGTCATAT<br>CCGACCTGAAGAAGATCGAGGACCTCATACAGTCCATGCACATCGACGCCACCCTATACACC<br>GAGAGCGACGTACACCCCAGCTGCAAGGTCACCGCGATGAAGTGCTTCCTCCTCGAGCTCCA<br>GGTAATCAGCCTTGAGAGCGGCGACGCCAGTATCCACGACACCGTCGAGAATCTGATAATAC<br>TGGCGAATAACTCGCTGAGCAGCAATGGGAACGTGACCGAGAGCGGGTGTAAGGAGTGCGAG<br>GAGCTGGAGGAGAAGAACATCAAGGAGTTCCTGCAGAGCTTCGTGCACATCGTGCAGATGTT<br>CATCAACACCAGC |
| 855 | IL15opt-tPa6-CO02 | ATGGACGCCATGAAGAGGGGCCTCTGCTGCGTCCTCCTCCTCTGCGGCGCGGTCTTCGTCTC<br>CCCCTCCCAGGAGATCCACGCCAGGTTCAGGAGGGGCGCCAGGAACTGGGTCAACGTCATCT<br>CCGATTTGAAAAAGATCGAGGACTTGATCCAAAGCATGCACATAGACGCCACGCTCTACACC<br>GAGTCCGACGTTCACCCCAGCTGCAAGGTCACGGCCATGAAGTGCTTTCTCCTCGAACTCCA<br>GGTCATCAGCTTGGAGTCCGGGGACGCCAGCATACACGACACCGTCGAGAACCTCATCATCC<br>TGGCCAACAATTCCCTGTCTTCGAACGGGAATGTGACCGAGTCCGGTTGCAAGGAGTGCGAG<br>GAGCTGGAGGAGAAGAACATCAAGGAGTTCCTGCAGTCATTCGTGCACATCGTCCAGATGTT<br>CATCAATACGAGC |
| 856 | IL15opt-tPa6-CO03 | ATGGACGCCATGAAGAGGGGGCTCTGCTGCGTCCTGCTCTTGTGCGGGGCCGTCTTCGTCAG<br>CCCGAGCCAGGAGATCCACGCCAGGTTCCGGCGGGGCGCCAGGAACTGGGTCAACGTCATCT<br>CCGACCTAAAGAAGATCGAGGACCTAATCCAGTCCATGCATATCGACGCCACCCTCTACACC<br>GAGAGCGACGTTCACCCCTCCTGCAAGGTCACCGCCATGAAGTGCTTCCTCCTCGAGCTCCA<br>GGTCATCTCTCTTGAGAGCGGGGACGCCTCCATCCACGACACCGTCGAGAACCTGATCATCC<br>TGGCCAACAACAGCCTGAGCAGCAACGGCAATGTGACGGAAAGCGGGTGCAAGGAATGCGAG<br>GAGCTGGAGGAGAAGAATATCAAGGAGTTCCTTCAGTCCTTCGTGCACATCGTGCAGATGTT<br>CATCAACACTTCC |
| 857 | IL15opt-tPa6-CO04 | ATGGACGCCATGAAGCGCGGCCTCTGCTGCGTCCTCCTCCTCTGTGGCGCCGTCTTCGTCAG<br>CCCCTCCCAGGAGATCCACGCCCGCTTCAGGCGGGGAGCCCGGAACTGGGTCAACGTCATCA<br>GCGATCTAAAGAAGATCGAGGATCTCATCCAGAGCATGCACATCGACGCCACCCTCTACACC<br>GAGAGCGACGTCCACCCCTCCTGCAAGGTAACCGCCATGAAGTGCTTCCTTTTGGAGCTCCA<br>GGTAATTAGCCTCGAGTCAGGCGACGCCAGCATCCACGACACGGTCGAGAACCTGATCATCC<br>TGGCCAACAATAGCCTGAGCTCCAACGGGAACGTGACCGAGTCCGGATGCAAGGAATGCGAG |

TABLE 11-continued

Additional sequence optimized nucleic acid encoding IL15 polypeptides

| SEQ ID NO | Name | Sequence |
|---|---|---|
| | | GAGCTGGAGGAGAAGAACATCAAGGAGTTCCTGCAGAGCTTCGTGCACATCGTGCAGATGTT CATCAACACCAGC |
| 858 | IL15opt-tPa6-CO05 | ATGGACGCCATGAAGAGGGGGTTGTGCTGCGTCCTCCTCCTCTGCGGAGCCGTCTTCGTGTC CCCCAGCCAGGAGATCCACGCCCGGTTCCGCAGAGGAGCCCGCAACTGGGTAAACGTTATAA GCGATCTTAAAAAGATCGAGGACCTCATCCAGAGCATGCACATCGACGCGACCCTTTACACC GAGTCCGACGTGCATCCGAGCTGCAAGGTCACCGCGATGAAGTGCTTCCTACTCGAGCTCCA GGTCATCTCCCTCGAGAGCGGCGACGCCAGCATCCACGACACCGTCGAGAACCTGATCATAC TGGCCAATAACAGCCTGTCCTCCAACGGGAACGTGACCGAGAGCGGCTGTAAGGAGTGCGAG GAACTGGAGGAGAAGAACATCAAGGAATTCCTCCAGAGCTTCGTGCACATCGTCCAGATGTT CATCAACACCTCC |
| 859 | IL15opt-tPa6-CO06 | ATGGACGCCATGAAGAGGGGGCTTTGTTGTGTCCTCCTCCTCTGCGGCGCCGTCTTCGTCAG CCCCTCGCAGGAGATCCACGCCCGGTTCAGGCGGGGCGCCAGGAACTGGGTTAACGTCATCT CGGACCTCAAGAAAATCGAGGACCTAATCCAGAGCATGCATATCGACGCCACCCTCTACACC GAGAGCGACGTCCACCCCTCCTGCAAGGTCACCGCCATGAAGTGCTTCCTCCTAGAGCTCCA GGTCATCAGCCTCGAGTCCGGGGACGCCTCAATCCACGACACCGTCGAGAACCTGATTATCT TGGCCAACAACAGCCTGTCCAGCAATGGCAACGTGACCGAGAGCGGGTGCAAGGAGTGCGAG GAGCTGGAAGAGAAGAACATCAAGGAATTCCTGCAGTCCTTCGTGCACATAGTGCAAATGTT CATCAACACCAGC |
| 860 | IL15opt-tPa6-CO07 | ATGGACGCGATGAAGAGGGGCCTCTGCTGCGTCCTTCTCCTCTGCGGCGCCGTCTTCGTTAG CCCCTCCCAGGAGATCCACGCCAGGTTCAGGAGGGGCGCCCGGAACTGGGTCAACGTCATAA GCGATCTCAAAAAGATCGAGGACCTCATCCAGAGCATGCACATCGACGCCACGCTCTACACC GAGTCCGACGTGCACCCCTCCTGCAAGGTCACCGCCATGAAGTGCTTCCTCCTCGAGCTCCA GGTCATCTCCTTGGAGTCCGGCGACGCCTCGATCCACGATACCGTCGAAAACCTGATCATCC TGGCCAACAACAGCCTGAGCAGCAATGGCAACGTGACCGAATCCGGCTGCAAGGAGTGCGAG GAGCTGGAGGAAAAGAACATCAAGGAGTTCCTGCAGTCATTTGTGCACATCGTGCAGATGTT TATCAACACCTCC |
| 861 | IL15opt-tPa6-CO08 | ATGGACGCCATGAAGCGCGGCCTCTGCTGCGTCCTACTCCTTTGCGGGGCCGTCTTCGTTTC GCCCAGCCAGGAGATCCACGCCCGATTTCGGAGGGGCGCCAGGAACTGGGTCAACGTTATAT CCGACCTCAAGAAGATCGAGGACTTGATCCAGTCGATGCACATCGACGCCACTCTCTATACA GAAAGCGACGTTCACCCGTCCTGTAAGGTCACCGCCATGAAGTGCTTCCTCCTCGAGCTCCA GGTCATAAGCCTGGAGTCGGGCGACGCCTCCATCCACGATACGGTCGAGAACCTGATCATCC TGGCCAACAACAGCCTGTCGTCCAACGGAAACGTCACCGAGTCGGGCTGTAAGGAGTGCGAG GAGCTGGAGGAGAAGAACATCAAGGAGTTCCTGCAGAGCTTCGTGCACATCGTCCAGATGTT TATCAACACCAGC |
| 862 | IL15opt-tPa6-CO09 | ATGGACGCCATGAAACGCGGGCTCTGCTGCGTTCTACTCCTCTGCGGCGCCGTCTTCGTAAG CCCGAGCCAGGAGATTCACGCCCGGTTCAGGCGCGGCGCCAGGAACTGGGTTAACGTAATCT CGGATCTCAAGAAGATCGAGGACTTGATCCAGAGCATGCACATCGACGCCACCCTCTATACC GAGAGCGACGTTCACCCCTCCTGCAAGGTCACCGCGATGAAGTGCTTCCTCCTCGAGCTCCA GGTAATCAGCTTGGAGTCCGGGGACGCGTCCATACACGATACCGTCGAGAACCTGATCATCT TGGCAAACAACAGCCTGAGCTCCAACGGCAATGTGACGGAAAGCGGGTGCAAGGAGTGCGAG GAGCTGGAGGAGAAGAATATCAAAGAGTTCCTGCAAAGCTTCGTGCACATCGTGCAGATGTT CATCAACACCAGC |
| 863 | IL15opt-tPa6-CO10 | ATGGACGCCATGAAGCGCGGCCTCTGCTGCGTCCTCTTACTCTGCGGCGCCGTATTCGTTAG CCCCAGCCAGGAGATCCACGCCAGGTTCAGGCGGGGCGCCAGGAACTGGGTCAACGTTATCA GCGATCTCAAAAAGATCGAGGACCTCATCCAGTCCATGCACATCGACGCGACCCTCTACACC GAGTCAGACGTACACCCCTCCTGCAAGGTCACCGCCATGAAGTGCTTCCTCCTCGAGCTCCA GGTCATCAGCCTAGAGAGCGGAGACGCCAGCATCCACGACACCGTCGAGAATCTGATCATCC TGGCCAACAACAGCCTGAGCAGCAACGGGAACGTGACCGAGAGCGGGTGCAAGGAGTGCGAG GAGCTGGAGGAAAAGAACATCAAGGAGTTCCTGCAGAGCTTCGTGCACATCGTGCAGATGTT CATCAACACCAGC |
| 864 | IL15opt-tPa6-CO11 | ATGGACGCCATGAAGAGGGGCCTCTGCTGCGTACTTCTCCTCTGCGGCGCCGTCTTCGTCAG CCCGAGTCAAGAGATCCACGCGAGGTTCCGGCGGGGCGCCCGCAACTGGGTTAACGTCATAA GCGATCTAAAGAAGATCGAGGATCTCATACAGAGCATGCACATCGACGCCACCCTATACACC GAGTCCGACGTGCACCCCAGCTGTAAGGTAACCGCCATGAAGTGCTTCCTCCTCGAGCTCCA GGTAATTAGCCTGGAGAGCGGGGACGCGAGCATTCACGATACCGTCGAGAACCTTATCATCC TGGCGAATAACAGCCTCTCCAGCAACGGCAACGTCACCGAGTCCGGGTGCAAGGAGTGCGAG GAGCTGGAGGAGAAGAACATAAAGGAGTTCCTCCAGAGCTTCGTGCACATCGTGCAAATGTT CATCAACACCAGC |
| 865 | IL15opt-tPa6-CO12 | ATGGACGCCATGAAACGGGGCCTCTGCTGCGTCCTCCTCCTCTGTGGGGCCGTCTTCGTGTC CCCCAGCCAGGAGATCCACGCCCGGTTCCGCAGGGGCGCCCGGAATTGGGTAAACGTCATCA GCGATCTCAAAAAGATCGAGGACCTCATCCAGAGCATGCACATCGACGCAACGCTCTACACG GAGAGCGACGTTCACCCCAGCTGCAAGGTCACCGCCATGAAGTGCTTCCTTCTCGAACTCCA GGTAATCAGCCTCGAGTCAGGCGACGCCAGCATCCACGACACCGTCGAGAACCTGATCATCC TGGCCAACAACAGCCTGAGCAGTAATGGCAACGTTACCGAGAGCGGATGCAAGGAGTGTGAG GAACTGGAGGAGAAGAACATCAAGGAGTTCCTGCAGAGCTTCGTGCACATCGTGCAGATGTT CATCAACACCAGC |

TABLE 11-continued

Additional sequence optimized nucleic acid encoding IL15 polypeptides

| SEQ ID NO | Name | Sequence |
|---|---|---|
| 866 | IL15opt-tPa6-CO13 | ATGGACGCCATGAAGAGGGGACTCTGCTGCGTCCTCCTCCTCTGCGGCGCCGTCTTCGTCAG CCCCAGCCAAGAGATCCACGCCAGGTTCAGGAGGGGGGCCAGGAACTGGGTCAACGTCATTT CCGACCTCAAGAAGATCGAGGACCTCATCCAGAGCATGCACATCGACGCCACCCTCTACACG GAGTCCGACGTCCACCCCAGCTGCAAGGTCACCGCGATGAAGTGCTTCCTCCTCGAGCTCCA GGTAATCAGCCTCGAGTCAGGCGACGCCAGCATCCACGACACCGTGGAGAACCTCATCATCC TGGCCAACAACAGCCTGTCCAGCAACGGCAACGTGACCGAGAGTGGCTGCAAGGAATGCGAG GAGCTGGAGGAGAAAAATATCAAGGAGTTCCTCCAGAGCTTCGTCCACATCGTGCAGATGTT CATCAACACCAGC |
| 867 | IL15opt-tPa6-CO14 | ATGGACGCCATGAAGAGGGGGCTCTGCTGCGTCCTCCTCTTGTGCGGCGCCGTCTTCGTCTC CCCCAGCCAGGAGATCCACGCCAGATTCAGGAGGGGCGCCAGGAACTGGGTCAACGTCATCA GCGACCTCAAGAAGATCGAGGACCTCATCCAGAGCATGCACATCGACGCCACGCTCTACACC GAGAGCGACGTACACCCCTCCTGCAAGGTCACCGCCATGAAGTGCTTTCTCCTCGAGCTCCA GGTTATCAGCCTCGAGTCCGGGGACGCCAGCATCCACGACACCGTGGAGAACCTGATCATCC TGGCCAACAACAGCCTCAGCTCCAACGGCAATGTGACCGAGAGCGGGTGTAAGGAGTGTGAG GAGCTGGAAGAGAAGAACATTAAGGAGTTTCTACAGTCCTTCGTGCACATCGTGCAAATGTT CATCAACACATCC |
| 868 | IL15opt-tPa6-CO15 | ATGGACGCCATGAAGAGGGGCCTCTGCTGCGTCCTACTCCTCTGCGGGGCGGTCTTCGTTAG CCCGTCCCAGGAGATCCACGCCAGGTTCAGGAGGGGGGCCCGGAACTGGGTCAACGTGATCA GCGATCTAAAGAAGATCGAGGACCTTATCCAGTCGATGCACATCGACGCGACCCTCTACACC GAGAGCGACGTCCACCCCTCCTGCAAAGTCACCGCCATGAAGTGCTTCCTCCTAGAGCTCCA GGTCATCTCCCTCGAGAGCGGCGACGCCAGCATCCACGACACCGTCGAGAACCTGATCATCC TGGCCAACAACAGCCTGAGCAGCAATGGCAATGTGACCGAAAGCGGGTGCAAGGAGTGCGAG GAGCTGGAGGAGAAAAACATCAAGGAGTTTCTGCAGAGCTTCGTGCACATCGTCCAGATGTT TATCAACACCTCC |
| 869 | IL15opt-tPa6-CO16 | ATGGACGCGATGAAGAGGGGCCTCTGCTGTGTCCTCCTCCTCTGCGGGGCCGTTTTCGTCTC CCCCAGCCAGGAGATCCACGCGAGGTTCCGGCGCGGCGCCCGCAACTGGGTTAACGTCATCA GCGACCTCAAGAAGATCGAGGACCTCATACAGAGCATGCATATAGACGCCACCCTCTACACC GAGAGCGACGTCCACCCCAGCTGCAAGGTTACAGCCATGAAGTGCTTCCTCCTCGAGCTCCA GGTCATCAGCTTGGAATCCGGCGACGCCTCGATCCACGACACCGTCGAGAACCTGATCATCC TGGCCAACAACTCCCTGAGCAGCAATGGTAACGTGACCGAGTCCGGCTGCAAGGAGTGCGAG GAGCTCGAGGAGAAGAACATCAAGGAGTTCCTGCAGAGCTTCGTGCACATCGTGCAGATGTT TATCAACACCTCC |
| 870 | IL15opt-tPa6-CO17 | ATGGACGCCATGAAAAGGGGCTTATGCTGCGTCCTCCTCCTCTGCGGGGCCGTCTTCGTCAG CCCCAGCCAGGAGATACACGCCCGGTTCCGGAGGGGGGCGCGCAACTGGGTTAACGTCATCA GCGACCTCAAGAAGATCGAGGACCTAATCCAGAGCATGCACATAGACGCCACCCTCTACACC GAAAGCGACGTGCACCCCAGCTGTAAGGTAACCGCCATGAAGTGCTTCCTCCTCGAGCTCCA GGTCATCAGCCTCGAGAGCGGCGACGCCAGCATCCACGATACGGTCGAGAACCTCATCATCC TGGCCAACAACAGCCTGAGCTCCAACGGGAATGTGACCGAGAGCGGCTGCAAGGAGTGCGAG GAGCTGGAGGAGAAGAACATCAAGGAGTTCCTCCAGAGTTTCGTGCACATCGTGCAGATGTT CATTAACACTAGC |
| 871 | IL15opt-tPa6-CO18 | ATGGACGCCATGAAAAGGGGGCTCTGCTGCGTACTCCTCCTTTGCGGGGCCGTCTTCGTATC CCCGAGCCAGGAGATTCACGCCCGGTTCAGGAGGGGCGCCAGGAACTGGGTAAACGTCATCA GCGACCTCAAGAAGATCGAGGACCTCATCCAATCAATGCACATCGACGCCACGCTCTACACC GAGAGCGACGTCCACCCCAGCTGCAAGGTCACCGCCATGAAGTGCTTCCTCCTCGAGTTACA GGTCATCTCCCTCGAGTCCGGGGACGCCAGCATCCACGACACGGTGGAGAACCTGATCATCC TCGCCAATAACTCCCTGAGCAGCAATGGCAACGTCACGGAGAGCGGATGCAAAGAGTGCGAG GAGCTCGAGGAGAAGAACATCAAAGAATTCCTGCAGAGCTTTGTGCATATCGTGCAGATGTT CATCAACACCAGC |
| 872 | IL15opt-tPa6-CO19 | ATGGACGCCATGAAGCGGGGCCTCTGCTGCGTCCTCCTCCTCTGCGGGGCCGTCTTCGTTTC CCCCAGCCAGGAAATCCACGCCAGGTTTAGGAGGGGCGCCCGCAACTGGGTCAACGTCATCT CCGATCTTAAGAAGATCGAGGACCTCATCCAGAGCATGCATATCGACGCCACCCTCTACACC GAATCCGACGTGCACCCCTCCTGCAAGGTCACAGCCATGAAGTGCTTCTTGCTCGAGCTCCA GGTCATCTCCCTCGAGAGCGGGGACGCCAGCATCCACGATACCGTCGAGAATCTGATCATCC TGGCCAATAATAGCTTGAGCAGCAACGGCAACGTGACCGAGAGCGGCTGTAAGGAGTGCGAG GAGCTGGAGGAGAAGAACATCAAGGAGTTCCTGCAGAGCTTCGTGCACATCGTGCAGATGTT CATCAACACGAGC |
| 873 | IL15opt-tPa6-CO20 | ATGGACGCCATGAAGCGCGGCCTCTGCTGCGTCCTCCTCCTCTGCGGCGCCGTCTTCGTCTC CCCCAGCCAGGAGATACACGCGAGGTTCCGGAGGGGGGCCAGGAACTGGGTCAACGTTATAA GCGACCTTAAGAAGATCGAGGACCTCATACAGTCCATGCACATCGACGCCACGCTCTACACC GAGAGCGACGTACACCCATCCTGCAAGGTTACGGCCATGAAGTGCTTCCTCCTTGAACTCCA GGTCATATCCCTCGAGTCGGGGGACGCCTCAATCCACGACACGGTGGAGAACCTCATCATCC TCGCCAACAATAGCCTGAGTAGCAACGGCAACGTGACCGAGTCCGGCTGCAAGGAATGTGAG GAGCTGGAGGAGAAGAACATCAAGGAGTTCCTGCAGAGCTTCGTGCACATCGTGCAGATGTT CATCAATACCTCC |
| 874 | IL15opt-tPa6-CO21 | ATGGACGCCATGAAGCGGGGGCTATGCTGCGTCCTCCTCCTTTGCGGCGCCGTCTTCGTCTC GCCCAGCCAGGAGATTCACGCCAGGTTTAGGAGGGGCGCCAGGAACTGGGTCAACGTCATCT |

TABLE 11-continued

Additional sequence optimized nucleic acid encoding IL15 polypeptides

| SEQ ID NO | Name | Sequence |
|---|---|---|
| | | CGGACCTCAAGAAGATCGAGGACCTCATCCAGAGCATGCATATCGACGCCACCCTCTATACC GAGTCGGACGTCCACCCCAGCTGCAAGGTCACCGCAATGAAGTGCTTCCTCCTCGAGCTCCA GGTCATCAGCCTCGAGAGCGGCGACGCCTCGATCCACGATACCGTCGAGAATCTCATCATCC TGGCCAATAATTCGCTGAGCAGCAACGGCAACGTGACCGAATCAGGATGTAAGGAGTGCGAG GAGCTCGAGGAGAAGAACATTAAGGAATTCCTGCAGTCCTTCGTGCACATCGTGCAGATGTT CATCAACACCAGC |
| 875 | IL15opt-tPa6-CO22 | ATGGACGCCATGAAGCGGGGCCTCTGTTGCGTCCTCTTGCTTTGTGGCGCCGTCTTCGTGTC CCCCAGCCAGGAGATCCACGCTCGGTTCAGGCGCGGGGCCAGGAACTGGGTCAACGTGATCT CCGACCTCAAGAAGATCGAGGACCTCATCCAGAGCATGCACATCGACGCCACCTTATACACC GAGTCCGACGTCCATCCCTCGTGCAAAGTCACCGCCATGAAGTGCTTCCTCTTAGAGCTCCA GGTCATCAGCCTCGAGTCCGGCGACGCCTCGATCCACGATACCGTCGAGAACCTGATCATCC TGGCCAACAACAGCCTGAGCAGCAACGGGAACGTGACCGAATCGGGGTGCAAGGAGTGCGAG GAGCTGGAGGAGAAGAACATCAAGGAGTTCCTGCAGAGCTTCGTGCACATAGTGCAGATGTT CATCAACACCAGC |
| 876 | IL15opt-tPa6-CO23 | ATGGACGCCATGAAGAGGGGCCTCTGCTGTGTCCTCCTCCTCTGCGGAGCCGTCTTCGTGAG CCCCTCCCAGGAGATCCACGCCCGGTTTCGGCGCGGGGCCCGCAACTGGGTCAACGTCATCT CCGACCTTAAGAAGATAGAGGATCTTATCCAGAGCATGCACATCGACGCCACCCTCTACACG GAGAGCGACGTCCACCCCAGCTGTAAGGTTACCGCGATGAAGTGCTTTCTCCTCGAGCTCCA GGTCATCTCCCTGGAATCGGGGGACGCCAGCATCCACGACACGGTCGAAAACCTGATCATAC TGGCCAACAACAGCCTGTCGAGCAACGGCAACGTGACCGAGTCAGGGTGTAAGGAGTGCGAG GAGCTGGAGGAGAAGAACATAAAGGAATTCCTGCAGTCGTTCGTGCACATCGTGCAGATGTT TATCAACACCAGC |
| 877 | IL15opt-tPa6-CO24 | ATGGACGCCATGAAGCGCGGCCTCTGCTGCGTCCTTCTCCTCTGCGGCGCCGTCTTCGTCAG CCCCAGCCAGGAGATCCACGCACGGTTCAGGAGGGGCGCCCGGAACTGGGTTAACGTAATCT CGGACCTCAAGAAGATCGAGGACCTCATCCAGTCCATGCACATCGACGCCACCCTCTACACC GAGAGCGACGTCCACCCGTCCTGCAAGGTCACCGCCATGAAGTGCTTTCTCCTCGAGCTCCA GGTTATCAGCTTGGAGAGCGGCGACGCCAGCATCCACGACACAGTCGAGAATCTGATCATAC TGGCCAATAACTCCCTGTCCAGCAACGGCAACGTGACCGAGAGCGGCTGCAAGGAGTGCGAG GAGCTGGAGGAGAAGAACATCAAGGAGTTCCTCCAGAGCTTCGTGCACATCGTGCAGATGTT CATCAACACCAGC |
| 878 | IL15opt-tPa6-CO25 | ATGGACGCCATGAAGAGGGGGCTTTGCTGCGTACTCCTCCTCTGCGGGGCCGTCTTCGTCAG CCCCAGCCAGGAGATCCACGCCCGCTTTAGGAGGGGGGCCCGAAATTGGGTCAACGTCATCA GCGACCTCAAAAAGATCGAGGACTTGATCCAGAGCATGCACATCGACGCCACCCTTTATACC GAGTCCGACGTCCACCCCTCCTGCAAGGTCACCGCCATGAAGTGTTTTCTCCTCGAGCTCCA GGTCATCAGCCTCGAGAGCGGCGACGCTTCCATCCACGACACCGTCGAGAACCTGATCATCC TGGCCAACAACAGCCTGAGCAGCAACGGCAACGTGACCGAGAGCGGCTGCAAGGAGTGCGAG GAGCTCGAGGAGAAGAACATCAAGGAGTTCCTCCAGAGCTTTGTGCACATCGTGCAAATGTT CATCAATACCTCG |
| 879 | IL15_RLI-CO01 | ATGGAGACTGACACCCTACTCCTCTGGGTATTGCTTCTCTGGGTACCCGGGAGCACCGGCGA CTACAAAGACGACGACGACAAGATCACCTGTCCCCCGCCCATGAGCGTCGAGCACGCCGACA TCTGGGTCAAAAGCTATAGCCTATACAGCAGGGAGAGGTACATCTGCAATAGCGGCTTCAAG AGGAAGGCCGGCACCAGCAGCCTCACCGAGTGTGTACTCAATAAGGCCACCAACGTTGCCCA TTGGACAACCCCCAGCTTGAAGTGCATTAGGGACCCCGCCCTCGTCCATCAGAGGCCCGCCC CACCTAGCGGCGGGAGCGGCGGGGGAGGCTCCGGGGGCGGCAGTGGCGGCGGCGGATCCCTG CAGAACTGGGTCAATGTGATCTCCGACCTAAAAAAGATCGAAGACCTGATACAGAGCATGCA CATCGACGCTACCCTGTATACCGAGAGCGATGTGCATCCCAGCTGTAAGGTCACAGCCATGA AATGTTTTCTCCTGGAGCTGCAGGTGATCAGTCTGGAGTCAGGCGACGCCAGCATCCACGAC ACTGTAGAGAATCTGATCATCCTGGCCAACAATAGCCTCAGCAGCAACGGCAACGTCACCGA GAGCGGCTGCAAGGAATGCGAAGAACTCGAGGAGAAGAACATAAAGGAGTTCCTGCAGTCCT TTGTGCACATCGTGCAGATGTTTATCAACACCAGC |
| 880 | IL15_RLI-CO02 | ATGGAGACGGATACCTTACTTCTCTGGGTACTTCTATTGTGGGTCCCCGGGAGCACCGGGGA CTACAAGGACGACGACGACAAGATAACCTGCCCGCCCCCCATGAGCGTAGAACACGCCGACA TCTGGGTCAAGTCCTACAGCCTCTACAGCAGGGAGAGGTACATCTGCAATAGCGGCTTTAAG CGTAAGGCCGGAACGTCAAGCCTTACCGAGTGCGTCCTTAACAAGGCCACCAACGTCGCCCA TTGGACCACCCCCAGCCTCAAGTGTATCAGGGATCCCGCCCTCGTACACCAAAGGCCGGCCC CTCCATCCGGGGGCAGCGGCGGGGGTGGTAGCGGAGGTGGCAGCGGCGGCGGTGGCTCGCTC CAAAACTGGGTGAACGTCATCAGCGACCTCAAGAAGATTGAGGATCTGATCCAGTCGATGCA CATCGACGCCACCCTGTATACCGAAAGCGACGTCCATCCCAGCTGCAAAGTCACCGCCATGA AGTGCTTCCTCCTGGAGCTTCAGGTGATCTCCCTGGAGAGCGGGGATGCCTCCATCCACGAC ACCGTGGAGAACCTGATAATCCTTGCCAACAACTCCCTGAGCTCGAATGGCAACGTGACCGA ATCCGGATGCAAAGAGTGCGAGGAGCTCGAGGAAAAGAATATCAAGGAGTTCCTCCAGTCTT TCGTGCACATAGTGCAGATGTTCATAAATACGAGC |
| 881 | IL15_RLI-CO03 | ATGGAAACCGACACCCTACTCCTTTGGGTACTACTCCTTTGGGTCCCCGGGTCCACCGGCGA CTACAAAGACGACGACGACAAGATCACCTGCCCGCCCCCGATGAGCGTCGAACACGCCGACA TCTGGGTCAAATCGTACAGCCTCTATTCCAGGGAAAGGTACATTTGCAACAGCGGATTCAAG CGCAAGGCCGGCACCTCGAGCCTCACGGAGTGCGTACTCAACAAGGCCACCAACGTTGCCCA CTGGACCACCCCCAGCCTCAAGTGCATCAGGGACCCAGCACTCGTCCATCAGCGGCCAGCCC |

TABLE 11-continued

Additional sequence optimized nucleic acid encoding IL15 polypeptides

| SEQ ID NO | Name | Sequence |
| --- | --- | --- |
| | | CTCCCAGCGGCGGCTCCGGGGGCGGCGGGTCAGGAGGCGGCAGCGGAGGCGGCGGAAGCCTT<br>CAGAATTGGGTGAACGTGATAAGTGATCTGAAGAAGATTGAAGATCTGATCCAATCCATGCA<br>CATCGACGCCACCCTGTACACCGAGTCGGATGTCCACCCGTCCTGCAAGGTCACAGCCATGA<br>AGTGCTTCCTGCTCGAACTGCAGGTCATCTCCTTGGAGTCAGGGGACGCCAGCATACACGAT<br>ACTGTGGAGAACCTTATTATACTGGCCAACAACAGCCTGTCCTCCAACGGTAACGTGACAGA<br>GTCCGGCTGCAAGGAGTGCGAGGAGCTCGAAGAGAAAAACATAAAGGAGTTCCTCCAGAGCT<br>TTGTCCATATAGTGCAGATGTTCATCAACACCTCC |
| 882 | IL15_RLI-CO04 | ATGGAAACCGATACCCTCCTCCTCTGGGTTCTTCTCCTATGGGTCCCAGGCAGCACCGGCGA<br>CTACAAGGACGACGACGACAAGATCACCTGTCCCCCGCCCATGTCCGTAGAGCACGCGGACA<br>TCTGGGTCAAGTCATATTCACTCTATAGCAGAGAGAGGTACATCTGCAACTCCGGATTCAAG<br>AGGAAGGCCGGAACCAGCTCCCTTACCGAGTGCGTCCTCAACAAAGCCACCAACGTAGCCCA<br>TTGGACAACACCCTCCCTCAAGTGCATACGAGATCCCGCCCTCGTACACCAAAGGCCCGCCC<br>CGCCCAGCGGGGGCAGCGGCGGCGGAGGCAGCGGAGGCGGCTCCGGAGGCGGGGGAAGCCTG<br>CAGAACTGGGTCAACGTGATAAGCGACCTGAAGAAAATCGAAGATCTTATCCAGAGCATGCA<br>CATAGACGCCACACTGTACACGGAAAGCGACGTGCACCCTTCCTGTAAGGTGACCGCCATGA<br>AGTGCTTCCTGCTGGAGCTGCAGGTGATAAGCCTCGAGTCCGGGGATGCCTCGATCCACGAC<br>ACCGTCGAGAATCTGATCATCCTGGCCAATAACTCCCTGAGCAGCAACGGGAACGTCACCGA<br>GAGCGGCTGCAAGGAATGCGAGGAACTTGAGGAGAAGAACATTAAGGAGTTCCTGCAATCGT<br>TTGTACACATCGTGCAGATGTTCATCAACACCAGC |
| 883 | IL15_RLI-CO05 | ATGGAGACAGACACCCTCCTCCTCTGGGTACTCCTCCTCTGGGTACCCGGGAGCACCGGCGA<br>CTACAAGGACGACGACGACAAGATCACCTGCCCCCCACCCATGTCCGTTGAACACGCCGATA<br>TCTGGGTCAAGTCCTACAGCCTCTACTCCCGAGAGAGGTATATCTGCAACTCCGGATTTAAA<br>CGGAAAGCCGGCACCTCGAGCCTCACAGAGTGCGTCCTCAATAAAGCCACCAACGTAGCTCA<br>CTGGACCACCCCCTCCCTTAAGTGTATTCGGGATCCAGCCCTCGTCCATCAAAGGCCGGCGC<br>CGCCCAGCGGAGGTAGCGGCGGGGGCGGCAGCGGGGGAGGCAGCGGCGGCGGTGGAAGCCTA<br>CAGAACTGGGTCAACGTCATCTCCGACCTGAAGAAGATCGAGGACCTCATCCAGAGCATGCA<br>CATAGATGCCACCCTGTACACCGAGAGCGACGTCCACCCCTCCTGCAAGGTGACCGCGATGA<br>AGTGCTTTCTCCTCGAACTGCAAGTGATTAGCCTGGAGAGCGGCGATGCCTCCATCCACGAT<br>ACCGTGGAAAATCTCATCATCCTGGCCAATAACAGCCTGAGCTCAAATGGAAACGTGACCGA<br>GTCCGGCTGCAAGGAGTGCGAAGAACTGGAGGAGAAAAACATCAAGGAATTCCTGCAGTCCT<br>TTGTGCATATCGTGCAGATGTTCATAAACACCTCC |
| 884 | IL15_RLI-CO06 | ATGGAGACGGACACCCTCCTCCTCTGGGTTCTCCTCCTTTGGGTCCCCGGCAGCACCGGCGA<br>TTACAAGGACGACGACGACAAGATCACCTGCCCGCCCCCCATGTCCGTAGAGCACGCCGACA<br>TCTGGGTCAAGAGCTACAGCCTCTATTCCAGGGAAAGGTACATTTGCAACTCAGGCTTCAAA<br>CGCAAGGCAGGCACCTCCAGCTTGACCGAGTGCGTCCTCAACAAGGCCACCAACGTCGCCCA<br>CTGGACCACCCCAAGCTTAAAGTGCATAAGGGATCCCGCCCTAGTCCACCAACGCCCAGCCC<br>CGCCCAGCGGTGGCAGCGGAGGCGGCGGCTCCGGAGGCGGATCTGGGGGCGGAGGGAGCCTG<br>CAGAACTGGGTGAACGTGATTAGCGATCTGAAGAAGATCGAAGACCTGATCCAGTCCATGCA<br>CATCGATGCCACCCTCTATACCGAGTCAGATGTGCACCCTAGCTGCAAAGTGACCGCAATGA<br>AATGCTTCCTGCTGGAGCTGCAAGTGATCAGCCTGGAGAGCGGCGATGCCAGCATCCACGAT<br>ACCGTGGAAAACCTGATCATCCTCGCCAACAACTCACTCTCCTCCAACGGCAACGTGACCGA<br>AAGCGGCTGTAAGGAGTGCGAGGAATTAGAAGAGAAGAACATCAAGGAATTCCTGCAAAGCT<br>TCGTACACATCGTGCAGATGTTCATCAACACCAGC |
| 885 | IL15_RLI-CO07 | ATGGAGACAGACACTCTCCTCCTCTGGGTACTCCTCCTCTGGGTACCCGGCAGCACCGGGGA<br>CTACAAAGACGACGACGATAAGATTACTTGTCCCCCGCCCATGTCCGTCGAGCACGCCGACA<br>TCTGGGTCAAGTCCTACAGCCTCTATTCCAGGGAAAGGTATATCTGCAACAGCGGTTTCAAG<br>AGAAAGGCCGGGACGAGTTCGCTCACCGAGTGCGTCTTGAATAAAGCCACCAACGTCGCCCA<br>CTGGACGACCCCGAGCCTAAAGTGCATCAGAGATCCCGCCTTGGTTCACCAAAGGCCAGCCC<br>CACCGTCCGGAGGCTCAGGGGGAGGCGGCTCGGGCGGCGGCTCCGGCGGGGGCGGCAGCCTC<br>CAGAACTGGGTCAACGTGATCTCCGACCTAAAGAAGATCGAAGACCTCATCCAGAGCATGCA<br>TATCGATGCCACACTGTATACCGAATCCGACGTACACCCCAGCTGCAAGGTGACCGCTATGA<br>AGTGCTTTCTGCTGGAGCTCCAGGTCATCAGCCTGGAGAGCGGCGATGCCTCCATTCACGAT<br>ACCGTCGAGAACCTGATCATCCTGGCCAACAATAGCCTGTCCAGCAATGGGAATGTGACCGA<br>GTCCGGCTGTAAGGAGTGCGAGGAGCTGGAAGAGAAGAACATCAAGGAGTTCCTGCAGTCCT<br>TCGTGCATATCGTGCAGATGTTCATCAACACCTCC |
| 886 | IL15_RLI-CO08 | ATGGAGACGGATACCTTACTCCTCTGGGTACTTCTCCTCTGGGTTCCCGGCAGCACCGGCGA<br>TTACAAGGACGACGACGACAAAATCACGTGTCCGCCCCCCATGTCCGTAGAGCACGCCGATA<br>TCTGGGTCAAGTCCTATAGCCTCTACAGCCGGGAGCGGTACATTTGTAACAGCGGCTTCAAG<br>CGGAAAGCCGGCACCTCCTCCTTAACCGAGTGCGTTCTCAATAAAGCCACCAACGTTGCACA<br>CTGGACGACCCCCTCTTTGAAGTGTATTAGGGACCCCGCCCTTGTCCATCAGCGTCCCGCCC<br>CACCCAGCGGCGGGAGCGGCGGCGGCGGCTCCGGCGGAGGAAGCGGCGGCGGCGGCAGCCTC<br>CAGAACTGGGTGAATGTGATCAGTGACCTCAAGAAGATCGAGGACCTGATCCAGAGCATGCA<br>CATCGATGCAACACTGTACACCGAATCCGACGTACATCCCAGCTGCAAGGTGACCGCAATGA<br>AGTGTTTCCTGCTGGAGCTGCAGGTGATCTCGCTGGAGAGCGGGGACGCCTCTATCCACGAC<br>ACGGTGGAGAACCTCATCATCCTGGCCAATAACTCGCTCTCCTCGAATGGCAACGTCACCGA<br>GAGCGGCTGCAAGGAATGCGAAGAACTCGAGGAGAAGAACATCAAAGAATTTCTGCAGTCCT<br>TCGTGCACATCGTGCAAATGTTCATCAACACCTCG |

TABLE 11-continued

Additional sequence optimized nucleic acid encoding IL15 polypeptides

| SEQ ID NO | Name | Sequence |
|---|---|---|
| 887 | IL15_RLI-CO09 | ATGGAAACAGACACCCTTCTCCTCTGGGTCCTACTACTCTGGGTACCCGGCAGCACCGGGGA CTATAAGGACGACGACGACAAAATCACCTGCCCACCCCCCATGAGCGTTGAGCACGCCGACA TCTGGGTAAAGAGCTACAGTCTCTATTCCAGGGAGCGCTATATCTGCAACAGCGGTTTCAAG AGGAAAGCCGGCACCAGCAGCCTCACCGAGTGCGTCCTCAACAAGGCGACGAACGTCGCCCA CTGGACCACGCCCAGCCTCAAGTGCATAAGAGATCCGGCTTTAGTCCACCAGCGGCCCGCCC CGCCCTCCGGGGGTAGCGGCGGAGGAGGAAGTGGGGGTGGGAGCGGCGGCGGGGGCAGCCTC CAGAACTGGGTGAACGTGATCAGCGACCTGAAGAAAATCGAGGACCTGATCCAATCCATGCA TATCGACGCCACCCTGTACACCGAGTCAGACGTGCACCCCAGCTGCAAGGTGACTGCCATGA AGTGCTTTCTGTTAGAGCTCCAGGTGATCAGCCTTGAGAGCGGCGACGCCAGCATCCACGAT ACTGTGGAGAATCTGATCATACTGGCCAACAACTCACTGTCCAGCAACGGGAATGTGACCGA GTCCGGTTGCAAGGAGTGCGAAGAACTTGAGGAGAAGAACATAAAGGAGTTCCTGCAGAGCT TCGTGCACATAGTGCAAATGTTCATCAACACCTCC |
| 888 | IL15_RLI-CO10 | ATGGAGACGGACACCCTTCTCCTCTGGGTCCTCCTTCTCTGGGTCCCCGGGAGCACCGGAGA CTACAAGGACGACGACGACAAGATCACCTGCCCCCCGCCAATGAGCGTCGAACACGCCGACA TTTGGGTCAAGAGTTACAGCTTATACAGCAGGGAAAGGTACATTTGCAACTCGGGCTTCAAG CGGAAGGCCGGCACGAGCAGCCTAACCGAGTGCGTCCTCAACAAGGCAACCAACGTCGCCCA CTGGACCACCCCAAGCCTCAAGTGTATCAGGGACCCGGCCCTCGTACACCAAAGACCCGCAC CCCCAAGTGGGGGCAGCGGAGGGGGTGGCAGCGGCGGAGGAAGCGGGGGCGGAGGCAGCCTG CAAAACTGGGTGAACGTGATCTCAGACCTGAAGAAAATCGAGGACCTGATCCAGAGCATGCA CATTGACGCCACCCTGTATACCGAGTCCGATGTGCACCCTAGCTGTAAGGTGACCGCCATGA AGTGCTTCCTGCTGGAGCTGCAGGTGATCAGCCTGGAGAGCGGAGACGCCTCCATCCACGAT ACCGTGGAGAACCTCATCATACTGGCAAATAATAGCCTGTCCTCCAATGGGAACGTGACCGA GAGCGGCTGTAAAGAGTGTGAGGAGCTGGAGGAGAAGAATATCAAGGAGTTCCTGCAGAGCT TCGTGCATATCGTGCAAATGTTTATCAACACGAGC |
| 889 | IL15_RLI-CO11 | ATGGAGACTGACACCTTACTCCTTTGGGTTCTACTCCTCTGGGTACCCGGCAGCACGGGAGA CTACAAGGACGACGACGACAAAATCACCTGTCCCCCGCCCATGAGCGTCGAGCACGCGGACA TCTGGGTAAAGAGCTATTCCCTCTACTCCAGGGAGAGGTATATCTGCAACAGCGGCTTCAAA AGGAAGGCCGGCACCAGCTCTCTCACGGAGTGCGTACTAAATAAGGCCACCAACGTAGCCCA CTGGACCACCCCAAGCCTCAAGTGCATCAGGGATCCCGCCTTAGTTCACCAGAGGCCCGCCC CTCCCAGCGGCGGGTCCGGCGGCGGCGGGAGTGGCGGCGGCTCAGGAGGAGGGGGGAGCCTC CAGAACTGGGTGAACGTGATCAGCGATCTGAAGAAGATCGAGGACCTCATCCAAAGCATGCA TATCGACGCCACGCTGTATACCGAGAGCGACGTCCACCCCTCCTGCAAGGTGACCGCCATGA AATGTTTTCTGCTGGAACTGCAAGTGATCAGCCTGGAGAGCGGTGACGCCAGCATCCACGAC ACAGTGGAAAACCTCATCATCCTCGCCAATAATAGCCTGAGCAGCAACGGCAACGTGACCGA GTCCGGATGCAAGGAATGCGAGGAGCTCGAGGAGAAGAACATCAAAGAGTTCCTGCAGAGCT TCGTGCATATCGTGCAGATGTTCATCAACACCAGC |
| 890 | IL15_RLI-CO12 | ATGGAGACAGACACGTTACTACTATGGGTCCTACTCCTCTGGGTCCCCGGCAGCACCGGGGA CTATAAAGACGACGACGACAAAATCACGTGCCCTCCCCCCATGTCCGTCGAGCACGCAGACA TCTGGGTCAAGAGCTACTCCCTCTACAGCAGGGAAAGGTACATCTGCAACAGCGGCTTCAAG CGGAAGGCCGGTACGAGCAGCCTCACCGAGTGCGTCCTCAACAAGGCCACCAACGTCGCACA CTGGACTACACCCAGCCTTAAGTGCATCCGAGATCCAGCCCTTGTTCACCAGAGGCCCGCCC CGCCTTCCGGAGGCTCCGGCGGCGGCGGGAGCGGCGGTGGCTCCGGCGGTGGAGGCAGCCTG CAGAACTGGGTGAACGTGATCAGCGACCTGAAGAAGATCGAGGATCTTATCCAGAGCATGCA CATCGACGCCACCCTGTACACCGAGAGCGATGTGCACCCGAGCTGCAAAGTGACCGCCATGA AATGCTTCCTGCTGGAGCTGCAAGTGATCAGCCTCGAGTCCGGGGATGCCTCCATCCACGAC ACCGTGGAGAACCTCATTATCCTTGCCAACAACAGCCTGAGCAGCAATGGCAATGTGACAGA AAGCGGCTGCAAGGAGTGTGAGGAGCTGGAAGAGAAGAATATTAAAGAGTTTCTCCAAAGCT TTGTGCACATCGTTCAGATGTTCATCAACACCAGC |
| 891 | IL15_RLI-CO13 | ATGGAAACCGACACGCTCCTCCTCTGGGTTCTTCTTCTATGGGTCCCCGGCTCGACCGGGGA TTATAAGGACGACGACGATAAGATCACCTGTCCCCCGCCCATGAGCGTCGAACACGCGGACA TTTGGGTCAAGTCCTATAGCCTTTACTCCCGGGAGAGGTACATCTGTAACTCCGGTTTTAAG AGGAAGGCGGGGACCAGCAGCCTAACCGAGTGCGTACTCAACAAGGCCACCAACGTCGCGCA CTGGACCACCCCCGAGCTTAAAGTGCATCCGGGACCCCGCACTCGTCCATCAGAGGCCCGCCC CACCTAGCGGTGGCAGCGGGGGTGGAGGCTCCGGCGGCGGCAGCGGGGGCGGAGGAAGCCTG CAAAACTGGGTAAACGTGATCAGCGATCTGAAGAAGATCGAGGACCTGATTCAGAGCATGCA CATCGACGCCACCCTGTATACCGAAAGCGATGTGCACCCCAGCTGCAAGGTGACCGCCATGA AATGTTTTCTGTTAGAGCTCCAGGTGATCTCCCTTGAGAGCGGCGACGCCTCCATTCATGAT ACCGTGGAGAACCTCATCATCCTCGCCAACAACAGCCTGTCCAGCAACGGCAACGTCACGGA GAGCGGCTGCAAGGAGTGCGAGGAGCTGGAGGAAAAGAATATCAAGGAGTTTCTGCAGAGCT TCGTGCACATCGTCCAAATGTTCATCAACACCTCC |
| 892 | IL15_RLI-CO14 | ATGGAGACGGACACCCTACTACTCTGGGTACTTTTACTCTGGGTCCCCGGCAGCACCGGAGA TTACAAAGACGACGACGATAAGATCACCTGCCCGCCTCCCATGAGCGTAGAGCACGCCGACA TCTGGGTAAAATCATACAGCCTCTACAGCCGAGAGAGGTATATCTGCAATAGCGGCTTCAAG CGAAAGGCCGGGACGTCGTCCCTCACCGAGTGCGTACTCAATAAGGCTACCAACGTCGCCCA CTGGACCACCCCCAGCCTAAAGTGTATCAGAGATCCGGCCCTAGTCCATCAGAGGCCCGCCC CGCCCAGCGGCGGCTCCGGGGGCGGCGGGAGCGGTGGCGGGAGCGGCGGTGGCGGAAGCCTC CAGAACTGGGTGAACGTAATCTCGGACCTGAAGAAGATCGAGGACCTGATCCAGAGCATGCA CATCGACGCGACCCTGTATACCGAGTCCGACGTGCACCCTAGCTGCAAGGTGACCGCCATGA AGTGCTTCCTGCTGGAGCTGCAAGTGATCAGCCTGGAGAGCGGCGACGCCAGCATCCACGAC |

TABLE 11-continued

| SEQ ID NO | Name | Sequence |
|---|---|---|
| | | ACCGTTGAGAACCTGATTATCCTGGCCAACAACTCCCTAAGCAGCAATGGCAATGTGACCGA ATCCGGGTGCAAGGAGTGTGAGGAGCTGGAGGAGAAAAACATCAAGGAATTTCTGCAGTCCT TCGTCCATATCGTGCAGATGTTTATAAATACGTCC |
| 893 | IL15_RLI-CO15 | ATGGAAACCGACACCCTCCTCCTCTGGGTCCTCCTCTTGTGGGTTCCCGGCAGCACCGGCGA TTACAAGGACGACGACGACAAGATCACCTGCCCCCCGCCCATGAGCGTCGAGCACGCGGACA TCTGGGTAAAAAGCTATAGCTTATACAGCAGGGAGCGTTACATTTGCAACAGCGGCTTCAAG CGCAAGGCCGGCACCTCCTCCCTCACCGAGTGCGTCTTGAATAAGGCCACAAACGTTGCCCA TTGGACCACGCCCTCGCTCAAGTGCATAAGAGATCCCGCCCTCGTTCACCAGAGGCCCGCCC CACCCTCCGGAGGCAGCGGCGGAGGCGGGTCAGGAGGAGGGTCGGGCGGGGGCGGAAGCCTG CAGAATTGGGTGAACGTGATCTCCGACCTCAAGAAAATCGAGGATCTAATACAGAGCATGCA TATCGACGCCACCCTGTATACCGAGAGCGACGTGCATCCGTCCTGTAAGGTGACCGCCATGA AGTGTTTCCTGCTCGAACTCCAGGTAATCAGCCTCGAGTCCGGGGACGCCAGCATACACGAC ACCGTCGAAAATCTCATCATCCTGGCCAACAACAGCCTGTCGAGCAATGGCAACGTGACCGA AAGCGGCTGCAAGGAGTGCGAGGAGCTGGAAGAAAAGAACATCAAGGAGTTCCTGCAGTCTT TTGTGCACATCGTCCAGATGTTCATCAACACTAGC |
| 894 | IL15_RLI-CO16 | ATGGAAACCGACACCCTCCTCCTCTGGGTTCTCCTACTCTGGGTCCCCGGCAGCACCGGAGA CTACAAGGACGACGACGATAAGATCACCTGCCCCCCGCCCATGTCCGTCGAGCACGCCGATA TCTGGGTAAAGTCCTACTCGCTCTACTCCAGGGAAAGGTATATCTGCAACAGCGGCTTCAAG CGGAAGGCCGGAACCAGCTCCCTCACAGAGTGCGTATTAAATAAGGCGACCAACGTCGCACA CTGGACCACACCCTCACTTAAGTGCATCAGGGACCCGGCCTTGGTACATCAACGCCCGGCCC CGCCTTCCGGCGGCTCCGGCGGCGGGGGCAGCGGTGGAGGCTCCGGGGGCGGCGGCAGCCTG CAGAATTGGGTGAACGTGATCAGCGACCTGAAGAAGATCGAGGACCTGATCCAGAGCATGCA TATCGACGCCACCCTGTATACAGAAAGCGACGTGCACCCCAGCTGTAAGGTCACCGCAATGA AATGCTTCCTGCTGGAGCTTCAGGTCATCTCGCTCGAAAGCGGCGACGCCAGCATCCACGAC ACTGTCGAAAACCTGATAATCCTGGCCAATAACAGCCTGAGCAGCAACGGCAACGTGACCGA GTCCGGCTGCAAGGAATGTGAGGAGCTGGAGGAAAAGAATATCAAGGAGTTTCTTCAAAGCT TTGTGCACATCGTGCAGATGTTTATCAACACCAGC |
| 895 | IL15_RLI-CO17 | ATGGAGACGGACACCCTCCTCCTCTGGGTCCTCCTACTCTGGGTCCCCGGAAGCACCGGCGA CTACAAAGACGACGACGACAAGATCACCTGTCCCCCTCCGATGAGCGTCGAGCACGCCGACA TTTGGGTCAAGTCCTACAGCCTCTACAGCAGGGAAAGGTACATCTGTAATAGCGGATTCAAG CGGAAAGCGGGAACCAGCAGCCTTACCGAGTGCGTTCTTAATAAAGCCACGAACGTCGCCCA TTGGACCACCCCCAGCCTCAAGTGCATCCGAGATCCCGCCTTGGTCCACCAAAGACCGGCCC CACCCAGCGGCGGAAGCGGCGGCGGCGGGAGCGGGGGCGGCAGCGGTGGAGGCGGCTCCCTG CAGAATTGGGTGAACGTGATCAGCGATCTGAAGAAGATAGAGGACCTGATCCAGAGCATGCA TATCGATGCCACCCTGTACACCGAGTCCGATGTCCACCCCAGCTGTAAGGTGACTGCGATGA AGTGCTTCCTGCTCGAGCTGCAGGTGATTAGCCTGGAGAGCGGCGACGCCAGCATACATGAC ACCGTGGAGAATCTGATCATCCTGGCCAATAACTCCCTGAGTAGCAACGGGAACGTGACAGA GAGCGGCTGTAAGGAGTGCGAAGAACTGGAAGAGAAGAACATCAAGGAGTTTCTGCAGAGCT TCGTGCACATCGTGCAGATGTTCATAAACACAAGC |
| 896 | IL15_RLI-CO18 | ATGGAGACAGACACCTTACTCCTCTGGGTCCTCCTCTTGTGGGTTCCCGGAAGCACCGGAGA CTACAAGGACGACGACGATAAGATAACCTGCCCACCCCCCATGAGCGTTGAACACGCCGACA TCTGGGTCAAGAGCTATAGCCTCTACAGTAGGGAGAGGTACATCTGCAACAGCGGCTTTAAG CGTAAGGCCGGTACCTCCTCGCTCACCGAGTGCGTCCTTAACAAGGCCACCAACGTTGCACA CTGGACCACCCCTAGCCTTAAGTGCATCAGGGACCCCGCGCTTGTACACCAGCGTCCCGCCC CTCCGAGCGGAGGATCCGGCGGCGGGGGCAGCGGGGGAGGGAGCGGGGGAGGCGGCAGCCTG CAAAACTGGGTAAATGTGATCAGCGACCTGAAGAAGATTGAAGACTTGATACAAAGCATGCA CATCGACGCCACCCTGTACACCGAGAGCGACGTGCACCCCTCCTGTAAAGTGACCGCGATGA AGTGCTTCCTGCTCGAGCTCCAGGTGATCTCCCTGGAGAGCGGGGACGCCAGCATCCACGAC ACTGTGGAGAACCTGATCATTCTCGCCAATAACAGCCTGAGCAGCAATGGGAACGTGACGGA GAGCGGGTGCAAGGAATGCGAGGAGCTGGAGGAAAAGAATATAAAGGAGTTCCTCCAGAGCT TCGTGCACATCGTGCAGATGTTCATCAACACCTCC |
| 897 | IL15_RLI-CO19 | ATGGAGACGGATACCCTCTTACTTTGGGTACTCCTTCTTTGGGTCCCCGGCTCCACGGGCGA CTATAAGGACGACGACGACAAGATTACCTGTCCCCCACCCATGTCCGTCGAACACGCCGACA TCTGGGTCAAGTCCTACAGCCTCTACAGCAGAGAGAGGTACATCTGCAACAGCGGCTTCAAA AGGAAGGCGGGGACATCGAGCCTCACAGAGTGTGTCCTTAACAAGGCCACGAACGTTGCCCA TTGGACCACGCCATCATTGAAGTGCATCAGGGATCCCGCCCTAGTTCACCAACGTCCGGCAC CCCCCAGTGGCGGCTCAGGCGGCGGAGGCAGCGGGGGAGGCAGCGGGGGCGGAGGCAGCCTC CAGAACTGGGTCAACGTGATCAGCGACCTGAAGAAGATAGAGGACCTGATCCAGAGCATGCA CATCGACGCGACCCTGTACACCGAGAGCGACGTGCACCCCAGCTGCAAGGTGACCGCCATGA AGTGCTTCCTCCTGGAGCTCCAGGTGATTTCCCTGGAATCCGGCGATGCCAGCATCCACGAT ACCGTGGAGAACCTGATCATCCTGGCCAACAATTCGCTGAGTAGCAACGGCAACGTGACCGA GTCGGGCTGCAAGGAGTGCGAGGAACTGGAAGAGAAGAACATAAAGGAGTTTCTCCAGTCCT TTGTGCACATCGTGCAGATGTTCATCAATACCAGC |
| 898 | IL15_RLI-CO20 | ATGGAGACGGACACCCTACTACTCTGGGTCCTCCTCTTGTGGGTCCCCGGGTCCACCGGCGA CTACAAAGACGACGACGATAAAATCACCTGCCCACCCCCCATGAGCGTCGAGCACGCCGACA TTTGGGTAAAGAGCTACTCCTTGTATAGCCGGGAGAGGTACATCTGCAACTCCGGCTTTAAG AGAAAAGCCGGCACCTCCAGCCTCACCGAGTGCGTCTTAAACAAGGCCACCAACGTAGCCCA CTGGACTACGCCCTCACTTAAGTGTATCCGCGACCCGGCCCTTGTCCATCAAAGGCCCGCCC |

TABLE 11-continued

Additional sequence optimized nucleic acid encoding IL15 polypeptides

| SEQ ID NO | Name | Sequence |
|---|---|---|
| | | CGCCCAGCGGAGGCAGCGGCGGGGGCGGCAGCGGGGGCGGATCCGGCGGAGGGGGGAGCCTG<br>CAGAACTGGGTGAACGTGATCTCAGACCTGAAGAAGATCGAAGACCTCATCCAGAGCATGCA<br>CATAGACGCCACCCTGTATACCGAGTCCGATGTGCATCCAAGTTGCAAAGTGACAGCCATGA<br>AATGCTTCCTGCTGGAGCTGCAGGTAATCTCCCTGGAGTCCGGCGACGCCTCCATCCACGAC<br>ACCGTGGAGAACCTGATCATCCTGGCGAACAACTCCCTTAGCTCAAATGGCAACGTGACCGA<br>GAGCGGGTGCAAAGAGTGTGAGGAGCTGGAGGAGAAGAACATCAAGGAGTTTCTGCAGAGTT<br>TTGTGCACATCGTGCAGATGTTCATCAATACCAGC |
| 899 | IL15_RLI-CO21 | ATGGAGACAGATACTTTACTCCTCTGGGTACTCTTACTTTGGGTCCCGGGAAGCACCGGCGA<br>CTATAAGGACGACGACGACAAGATCACCTGTCCCCCACCGATGAGCGTCGAGCACGCAGACA<br>TCTGGGTAAAGAGCTACAGCCTCTACAGCAGGGAGCGATACATCTGCAACAGCGGCTTCAAA<br>AGGAAAGCCGGTACCAGCTCCCTTACCGAGTGCGTACTCAACAAGGCCACCAACGTGGCCCA<br>CTGGACCACCCCTAGCTTGAAGTGTATCCGGGACCCCGCCTTAGTCCACCAGAGGCCAGCCC<br>CACCCAGCGGTGGCAGCGGCGGAGGCGGCTCCGGGGGAGGCAGCGGCGGGGGCGGCTCCCTG<br>CAGAATTGGGTGAACGTGATCAGCGATCTGAAGAAAATCGAAGACCTGATCCAGAGCATGCA<br>CATCGACGCCACCCTGTACACCGAGTCCGACGTGCACCCCAGCTGTAAGGTCACCGCCATGA<br>AATGCTTCCTGCTGGAGCTGCAGGTGATCAGCCTCGAGTCCGGGGACGCCAGCATCCACGAC<br>ACCGTGGAGAACCTGATTATCCTGGCTAACAACTCGCTGTCCAGCAACGGAAATGTGACCGA<br>ATCCGGCTGCAAGGAGTGCGAAGAACTTGAAGAGAAGAACATCAAGGAGTTCCTTCAAAGCT<br>TCGTGCACATCGTGCAGATGTTCATCAACACCAGC |
| 900 | IL15_RLI-CO22 | ATGGAGACAGATACCTTGTTACTCTGGGTCCTCCTCCTCTGGGTCCCCGGCAGCACCGGCGA<br>CTACAAGGACGACGACGATAAAATTACCTGTCCACCACCCATGAGCGTCGAGCACGCCGACA<br>TTTGGGTCAAGAGCTATAGCCTCTACAGCCGAGAAAGGTACATCTGCAACAGCGGCTTTAAG<br>AGGAAGGCCGGGACCAGCAGCCTCACCGAGTGCGTCTTAAACAAGGCCACCAACGTCGCCCA<br>CTGGACCACCCCCTCCCTCAAGTGCATAAGGGATCCCGCCCTAGTACACCAACGCCCCGCCC<br>CACCGAGCGGCGGCAGCGGAGGCGGCGGCTCCGGTGGCGGCAGTGGGGGAGGGGGGAGCCTG<br>CAGAACTGGGTGAACGTGATCAGCGACCTTAAGAAGATCGAAGACCTGATCCAGAGCATGCA<br>CATCGACGCCACCCTGTACACCGAGTCCGACGTGCACCCCAGCTGTAAGGTCACCGCCATGA<br>AGTGCTTCCTGCTTGAGCTCCAGGTCATCTCACTGGAGAGCGGCGATGCCAGCATCCACGAT<br>ACCGTGGAAAACCTTATCATCCTCGCAAACAATAGCCTCAGCAGCAATGGGAATGTGACCGA<br>GAGCGGCTGTAAAGAGTGTGAGGAGCTGGAGGAAAAGAACATCAAGGAGTTCCTGCAGTCCT<br>TCGTGCACATCGTTCAAATGTTTATCAACACCAGC |
| 901 | IL15_RLI-CO23 | ATGGAGACGGACACCTTACTCTTATGGGTTCTTCTCCTTTGGGTTCCCGGGTCCACCGGCGA<br>CTACAAGGACGACGACGACAAAATCACCTGCCCGCCCCCCATGTCCGTCGAACACGCGGATA<br>TCTGGGTAAAGTCCTACTCCCTCTACAGCCGGGAAAGGTACATCTGCAACTCCGGCTTTAAA<br>AGGAAGGCGGGGACCTCCAGCCTCACCGAGTGTGTATTAAACAAGGCCACCAACGTAGCGCA<br>TTGGACCACCCCCAGCCTCAAGTGCATCCGGGACCCCGCCCTCGTTCATCAGAGGCCGGCCC<br>CACCCTCAGGCGGCTCCGGTGGTGGGGGCAGCGGAGGCGGCAGCGGAGGCGGAGGCTCCCTG<br>CAGAACTGGGTGAACGTGATCTCCGACCTCAAGAAGATCGAGGACCTGATCCAGTCCATGCA<br>CATCGATGCCACGCTGTACACGGAGAGCGACGTGCACCCCAGCTGCAAGGTGACGGCCATGA<br>AATGCTTCCTACTGGAGCTCCAGGTGATCAGCCTGGAGTCGGGCGACGCCTCGATCCACGAC<br>ACGGTCGAGAATCTGATTATACTCGCCAACAACAGCCTGTCCAGCAACGGCAATGTGACCGA<br>AAGCGGCTGTAAGGAGTGTGAAGAACTGGAGGAGAAAAATATCAAGGAATTCCTGCAGAGCT<br>TTGTGCATATAGTGCAGATGTTCATCAACACCAGC |
| 902 | IL15_RLI-CO24 | ATGGAGACGGACACCCTCCTACTCTGGGTCCTCCTACTCTGGGTCCCCGGAAGCACAGGCGA<br>CTACAAGGACGACGACGACAAGATCACCTGCCCGCCCCCCATGAGCGTCGAGCACGCCGATA<br>TCTGGGTCAAGAGCTATTCACTCTATAGCAGGGAGAGGTACATCTGCAACTCCGGCTTCAAG<br>AGGAAGGCCGGCACGAGCAGCTTAACCGAGTGTGTTCTCAACAAGGCAACGAACGTAGCCCA<br>TTGGACCACGCCCTCCCTAAAGTGCATCAGGGACCCCGCCTTAGTCCACCAGCGGCCGGCCC<br>CACCATCCGGAGGGAGCGGCGGCGGAGGAAGCGGCGGCGGCAGCGGGGGCGGAGGCAGCCTG<br>CAGAACTGGGTGAACGTGATCAGCGACCTGAAGAAAATAGAGGACCTGATCCAGAGCATGCA<br>CATCGACGCTACCCTGTACACCGAGTCCGACGTGCACCCCAGCTGTAAGGTGACCGCGATGA<br>AGTGCTTTCTGCTGGAACTGCAGGTGATCAGCCTGGAGAGCGGCGATGCCTCCATCCACGAC<br>ACCGTGGAGAACCTGATCATCCTTGCCAATAACAGCCTGTCCTCAAATGGCAACGTGACGGA<br>AAGTGGCTGTAAGGAATGCGAGGAGCTGGAAGAGAAAAATATCAAGGAGTTTCTGCAGAGCT<br>TTGTGCACATCGTACAGATGTTTATAAACACCAGC |
| 903 | IL15_RLI-CO25 | ATGGAGACGGATACCCTACTTCTCTGGGTCCTCCTCCTATGGGTCCCCGGCTCCACCGGCGA<br>CTACAAAGACGACGACGACAAGATCACGTGTCCCCCGCCCATGAGCGTAGAGCACGCCGACA<br>TCTGGGTCAAAAGCTACAGCCTCTACAGCAGGGAGCGCTACATCTGCAATAGCGGATTCAAG<br>CGCAAAGCGGGCACCAGCAGCCTCACCGAGTGCGTCCTCAATAAAGCCACCAACGTCGCCCA<br>TTGGACCACTCCCAGTCTTAAGTGCATCCGGGACCCCGCCCTTGTTCACCAAAGACCCGCCC<br>CACCGTCCGGCGGGTCCGGCGGCGGCGGGAGCGGAGGCGGCAGCGGGGGCGGAGGGAGCCTG<br>CAAAACTGGGTCAACGTGATCTCCGACCTCAAGAAGATCGAGGACCTGATCCAGAGCATGCA<br>TATCGACGCCACCCTATACACGGAGAGCGATGTCCACCCCAGCTGTAAGGTGACAGCCATGA<br>AGTGTTTTCTGTTAGAGCTGCAGGTGATCTCCCTGGAGTCCGGCGACGCCAGCATCCACGAC<br>ACCGTGGAAAACTTAATAATCCTGGCCAACAACTCTCTGAGCAGCAATGGCAACGTGACCGA<br>GAGTGGCTGCAAAGAGTGCGAGGAACTGGAAGAGAAAAATATCAAGGAGTTCCTGCAGAGCT<br>TCGTCCATATCGTACAGATGTTTATCAACACGAGC |

TABLE 11-continued

Additional sequence optimized nucleic acid encoding IL15 polypeptides

| SEQ ID NO | Name | Sequence |
|---|---|---|
| 904 | IL15Ra_WT_miR 122-CO01 | ATGGCCCCCAGGAGGGCCAGGGGGTGCCGCACCCTCGGCCTCCCCGCGCTATTATTACTCCT CCTGTTACGACCCCCCGCCACCAGGGGGATCACCTGTCCCCCGCCCATGTCCGTCGAGCACG CGGACATTTGGGTCAAGAGCTACTCCCTCTATTCCCGGGAGCGGTACATCTGCAACTCCGGC TTCAAGAGGAAGGCCGGCACCAGCAGCCTCACCGAGTGTGTCCTCAATAAGGCCACCAACGT CGCCCACTGGACCACCCCCAGCTTGAAGTGCATCCGGGACCCCGCCCTCGTCCACCAGAGGC CGGCCCCGCCCAGCACAGTCACAACCGCAGGTGTCACCCCCCAGCCGGAGTCCCTCAGCCCG AGCGGCAAGGAGCCCGCCGCCTCCAGCCCGAGTTCGAACAACACCGCGGCCACCACCGCCGC CATCGTGCCCGGGAGCCAGCTGATGCCCAGCAAGAGCCCCTCCACCGGGACCACCGAGATCA GCAGCCACGAGTCGAGCCACGGGACCCCCAGCCAGACCACCGCCAAGAACTGGGAGCTGACC GCGTCCGCGTCACATCAGCCCCCCGGGGTCTACCCCCAAGGCCACAGCGACACCACCGTGGC CATTAGCACAAGCACCGTCCTGCTGTGCGGCCTGAGCGCGGTGAGCCTGCTGGCCTGCTACC TGAAAAGCAGGCAGACCCCGCCCCTGGCGAGCGTGGAGATGGAGGCGATGGAGGCCCTGCCC GTGACCTGGGGCACCAGCTCAAGGGACGAGGACCTGGAGAACTGTAGCCACCACCTG |
| 905 | IL15Ra_WT_miR 122-CO02 | ATGGCCCCCAGGCGGGCCAGGGGCTGCAGGACGTTGGGCCTCCCCGCCCTCCTCTTGCTCCT CTTGTTAAGGCCCCCCGCCACCCGGGGCATCACTTGTCCCCCGCCAATGAGCGTAGAGCACG CCGACATCTGGGTCAAGAGCTACAGCCTATACTCCCGGGAGCGGTACATCTGTAACAGCGGC TTCAAGAGGAAGGCCGGCACCAGTAGCCTCACAGAGTGCGTCCTCAACAAGGCCACGAACGT AGCCCACTGGACCACCCCCTCGCTCAAGTGCATCAGGGACCCCGCCCTCGTGCACCAGCGAC CCGCGCCGCCCTCCACCGTAACCACCGCCGGGGTTACCCCCCAGCCTGAAAGCCTGAGCCCC AGCGGAAAGGAGCCCGCCGCCAGCAGCCCCAGCAGCAATAATACCGCCGCTACGACCGCGGC CATCGTCCCTGGGAGCCAGCTGATGCCCAGCAAGTCGCCCAGCACCGGGACCACGGAGATCA GCAGCCACGAGAGCAGCCACGGCACGCCCAGCCAGACCACCGCCAAGAACTGGGAGCTGACC GCCAGCGCCTCCCACCAGCCGCCAGGCGTCTACCCCCAGGGCCACAGCGACACCACCGTGGC CATCTCAACCAGCACGGTCCTGCTGTGCGGCCTGAGCGCCGTGAGCCTGCTGGCCTGCTACC TGAAAAGCAGGCAGACCCCACCGCTGGCCTCCGTGGAGATGGAGGCCATGGAGGCCCTGCCC GTGACATGGGGCACCAGCAGCAGGGACGAGGACCTGGAGAACTGCTCCCACCACCTG |
| 906 | IL15Ra_WT_miR 122-CO03 | ATGGCCCCTCGGAGGGCAAGGGGGTGTCGGACGCTCGGCCTCCCCGCCCTCCTTCTCCTCCT CCTCCTCAGGCCCCCCGCCACCAGGGGCATCACCTGCCCTCCCCCCATGTCGGTAGAACACG CCGACATCTGGGTCAAGAGCTACTCCCTCTACAGCAGGGAGCGGTACATTTGCAACAGCGGC TTTAAGAGGAAGGCCGGCACTAGCAGCCTTACCGAGTGCGTCCTCAACAAGGCGACCAACGT CGCCCACTGGACCACGCCCAGCTTGAAGTGCATCAGGGACCCCGCCCTGGTCCACCAGAGGC CAGCCCCGCCCTCCACCGTGACCACGGCGGGCGTGACCCCCCAGCCCGAAAGCCTCTCCCCC AGCGGCAAAGAGCCTGCCGCCTCAAGCCCCAGCAGCAACAACACGGCGGCCACCACGGCCGC CATCGTGCCCGGCAGCCAGCTGATGCCAAGCAAGTCCCCGTCCACCGGCACAACCGAGATTT CCAGCCACGAGAGCAGCCACGGCACCCCCTCCCAAACCACCGCCAAGAACTGGGAGCTGACC GCCAGCGCGTCCCACCAGCCCCCCGGCGTCTACCCGCAGGGGCACAGCGACACCACCGTGGC CATCTCGACCTCCACGGTGCTGCTGTGCGGCCTGAGCGCCGTCTCGCTCCTGGCCTGTTACC TGAAAAGCAGGCAGACCCCTCCCCTCGCCTCCGTGGAAATGGAAGCCATGGAGGCCCTGCCC GTGACCTGGGGGACCAGCTCCCGGGACGAGGACCTGGAGAACTGCAGCCACCATCTG |
| 907 | IL15Ra_WT_miR 122-CO04 | ATGGCCCCCCGGCGGGCCAGGGGCTGCCGCACCCTCGGCCTCCCCGCCCTCCTCCTTCTCCT CCTCCTAAGACCACCGGCCACCAGGGGAATCACCTGCCCACCCCCGATGAGCGTAGAGCACG CCGATATTTGGGTCAAGAGCTACAGCCTCTATAGCAGGGAGAGGTACATCTGCAACTCCGGG TTCAAGAGGAAGGCCGGCACCTCCAGCCTCACGGAGTGCGTCCTTAACAAGGCCACCAACGT CGCCCACTGGACCACCCCGAGCCTCAAGTGCATCCGGGACCCCGCCCTCGTACACCAGAGGC CCGCCCCACCCAGCACGGTCACCACAGCCGGTGTGACCCCACAGCCCGAAAGCCTGAGCCCC AGCGGCAAGGAGCCCGCCGCCAGCAGCCCCAGCAGCAACAACACCGCGGCAACGACCGCCGC GATCGTGCCGGGCAGCCAGCTGATGCCCAGCAAAAGCCCCAGCACCGGCACGACGGAAATCA GCTCCCACGAGTCGAGCCACGGCACTCCCTCCCAGACCACTGCCAAGAACTGGGAGCTTACA GCCTCCGCCAGCCACCAGCCCCCCGGGGTGTACCCCCAGGGGCACTCCGACACCACCGTGGC CATCTCCACCAGCACCGTGCTGCTGTGCGGCCTGAGCGCCGTGAGCCTGCTCGCCTGCTACC TGAAAAGCAGGCAAACGCCCCCGCTGGCCTCCGTCGAGATGGAGGCCATGGAAGCCCTCCCC GTGACCTGGGGCACCAGCAGCCGGGATGAAGATCTGGAGAATTGCAGCCACCACCTG |
| 908 | IL15Ra_WT_miR 122-CO05 | ATGGCCCCGAGGAGGGCCAGAGGCTGCAGGACCCTCGGCCTCCCCGCCCTCTTACTCCTCCT CTTGCTCCGACCCCCGGCCACCAGGGGCATCACCTGCCCCCCGCCGATGTCGGTCGAACACG CCGACATCTGGGTTAAGAGCTATTCCCTATACTCCCGGGAGCGGTATATTTGCAACAGCGGC TTCAAGAGGAAGGCCGGCACCAGCTCCCTCACCGAGTGCGTCCTCAACAAGGCCACCAACGT GGCCCACTGGACCACACCCAGCCTCAAGTGCATTAGGGACCCCGCCCTCGTACACCAGAGGC CCGCCCCACCTAGCACCGTGACGACCGCCGGCGTCACCCCCCAGCCAGAGAGCCTGAGCCCC AGCGGCAAAGAGCCCGCTGCCAGCAGCCCCAGCAGCAATAACACGGCGGCCACCACCGCCGC AATCGTGCCCGGGAGCCAGCTCATGCCCAGCAAGTCCCCCAGCACCGGCACCACCGAGATCA GCAGCCATGAGAGCTCCCACGGGACCCCCTCCCAGACCACCGCCAAGAACTGGGAGCTGACC GCCAGCGCCTCCCACCAACCGCCCGGCGTGTACCCCCAGGGGCACAGCGACACCACCGTCGC CATCTCGACCTCGACCGTGCTGCTGTGCGGCCTGAGCGCCGTGAGCCTCCTGGCGTGCTACC TCAAGAGCCGCCAGACGCCCCCGCTGGCCTCCGTGGAAATGGAGGCCATGGAGGCGCTGCCC GTGACGTGGGGCACCTCCAGCCGAGACGAGGATCTGGAAAATTGCAGCCACCACCTG |
| 909 | IL15Ra_WT_miR 122-CO06 | ATGGCCCCCCGGAGAGCTAGGGGGTGCAGAACCCTCGGCCTCCCCGCCCTCCTTCTCCTCTT GCTCCTCCGGCCCCCCGCCACCAGGGGCATCACCTGCCCCCCGCCCATGTCGGTCGAGCACG CCGACATCTGGGTCAAGAGCTACAGCCTTTACAGCAGGGAGAGGTACATCTGCAACTCCGGC TTCAAACGGAAAGCCGGAACCAGCTCCCTCACCGAGTGCGTCCTCAACAAGGCCACCAACGT |

TABLE 11-continued

Additional sequence optimized nucleic acid encoding IL15 polypeptides

| SEQ ID NO | Name | Sequence |
|---|---|---|
| | | GGCCCACTGGACCACCCCCAGCTTGAAGTGCATCCGGGACCCCGCGTTGGTCCACCAGAGGC<br>CCGCCCCGCCGAGCACCGTGACCACAGCGGGAGTGACTCCGCAGCCCGAGAGCCTGTCCCCC<br>TCGGGGAAAGAGCCCGCCGCAAGCAGCCCCAGCAGCAACAACACCGCAGCCACCACTGCCGC<br>CATCGTCCCCGGCTCCCAGCTGATGCCCTCCAAGAGCCCGAGCACCGGGACCACCGAGATCA<br>GCTCCCACGAGAGCAGCCACGGGACCCCAAGCCAGACCACCGCCAAAAACTGGGAGCTCACA<br>GCCTCGGCCAGCCACCAGCCCCCGGCGTGTACCCGCAGGGACACAGCGATACCACCGTGGC<br>CATAAGCACGAGCACGGTGCTGCTGTGTGGGCTGTCCGCGGTGTCCCTGCTGGCCTGCTACC<br>TGAAAAGCAGGCAGACCCCGCCCCTCGCAAGCGTGGAAATGGAGGCGATGGAAGCCCTCCCG<br>GTGACCTGGGGCACCAGCAGCAGGGATGAGGACCTGGAGAATTGTTCCCACCACCTG |
| 910 | IL15Ra_WT_miR 122-CO07 | ATGGCGCCCCGTAGGGCGAGGGGCTGCCGGACCTTGGGCCTCCCCGCCCTACTTCTTCTCCT<br>CCTCCTCCGCCCGCCCGCCACGAGGGGTATCACCTGCCCGCCCCCCATGAGCGTCGAGCACG<br>CCGACATTTGGGTAAAGAGCTACTCACTCTACAGCAGGGAGAGGTACATCTGCAACAGCGGC<br>TTTAAGAGGAAGGCGGGGACGAGCTCCCTAACCGAGTGCGTCCTCAACAAGGCCACCAACGT<br>GGCCCACTGGACCACCCCATCGCTCAAGTGCATACGGGACCCGGCATTAGTACACCAGCGGC<br>CCGCGCCGCCCAGCACGGTGACGACCGCGGGTGTTACGCCTCAACCCGAAAGCCTGAGCCCC<br>AGTGGCAAGGAGCCCGCGGCCAGCTCCCCCTCCAGCAACAATACTGCCGCCACCACCGCCGC<br>CATCGTCCCCGGGAGCCAGCTGATGCCCAGCAAGAGCCCCAGCACCGGGACCACCGAAATCA<br>GCTCACACGAAAGCTCCCACGGTACCCCCTCCCAGACCACCGCCAAGAACTGGGAGCTGACC<br>GCCTCCGCCAGCCATCAGCCCCCGGTGTGTACCCCCAAGGCCATAGCGACACCACGGTGGC<br>CATCAGCACCAGCACCGTGCTGCTCTGCGGCCTGTCCGCCGTGAGCCTGCTGGCCTGTTATC<br>TCAAGAGCAGGCAGACCCCACCGCTGGCGAGCGTGGAGATGGAGGCCATGGAGGCCCTGCCC<br>GTGACTTGGGGCACGTCCAGCCGAGACGAGGACCTGGAGAACTGCTCCCACCATCTG |
| 911 | IL15Ra_WT_miR 122-CO08 | ATGGCCCCCAGGAGGGCCAGGGGCTGTAGGACCCTCGGCCTCCCGGCCCTACTCCTCCTTCT<br>ACTCCTCCGCCCGCCCGCCACCAGGGGCATCACCTGTCCCCCACCGATGAGCGTCGAGCACG<br>CGGACATCTGGGTCAAGAGCTACAGCCTCTACAGCAGGGAGAGGTACATCTGTAACAGCGGG<br>TTCAAGAGGAAGGCCGGAACCTCAAGCCTCACCGAGTGCGTTCTCAATAAGGCCACCAACGT<br>CGCCCACTGGACGACCCCCTCGCTCAAGTGCATCAGGGATCCCGCGTTGGTACACCAACGGC<br>CGGCCCCTCCCTCCACGGTGACGACCGCAGGGGTGACTCCGCAGCCCGAGAGCCTCTCCCCC<br>AGCGGGAAAGAGCCGGCCGCGAGCAGCCCCAGCAGCAATAACACCGCCGCCACAACGGCCGC<br>CATCGTGCCCGGGAGCCAGCTGATGCCCTCCAAGTCCCCCAGCACCGGCACGACCGAGATCT<br>CCTCCCACGAGTCCTCCCACGGGACCCCGAGCCAGACCACCGCCAAAAACTGGGAGCTGACA<br>GCCAGCGCCTCCCACCAGCCCCCGGCGTGTACCCGCAAGGACACAGCGATACGACGGTGGC<br>CATCTCCACCAGCACCGTCCTGCTGTGCGGGCTCTCAGCCGTGAGCCTGCTGGCCTGTTACC<br>TGAAAAGCAGGCAGACCCCGCCACTGGCCAGCGTCGAGATGGAGGCGATGGAGGCGCTGCCC<br>GTGACCTGGGGCACGAGCAGCAGGGACGAGGACCTCGAGAACTGCTCCCATCACCTG |
| 912 | IL15Ra_WT_miR 122-CO09 | ATGGCCCCGAGGAGGGCGAGGGGCTGCCGCACCCTTGGTCTGCCCGCCCTCCTCCTCCTCCT<br>CTTGCTCAGGCCACCGGCCACCAGGGGGATCACGTGTCCCCCTCCCATGTCCGTTGAGCACG<br>CCGACATCTGGGTTAAGTCCTACTCCCTTTACAGCCGCGAGAGGTACATTTGCAACTCCGGC<br>TTTAAGAGGAAGGCCGGCACCTCCAGCCTCACCGAGTGCGTCCTTAATAAAGCCACCAACGT<br>GGCCCACTGGACCACCCCGAGCCTCAAGTGCATAAGGGACCCCGCCCTCGTCCATCAGAGGC<br>CCGCCCCTCCCAGCACTGTGACCACGGCTGGCGTCACGCCGCAGCCCGAGAGCCTGAGTCCC<br>AGCGGCAAGGAACCCGCCGCGTCCAGCCCCAGCAGCAATAACACCGCCGCCACCACCGCCGC<br>TATCGTGCCGGGGTCCCAGCTGATGCCCAGCAAGAGCCCCAGCACCGGTACGACCGAGATAA<br>GCAGCCATGAGAGCTCGCACGGCACCCCCTCGCAGACCACAGCCAAGAACTGGGAGCTGACG<br>GCCTCGGCGTCCCACCAGCCCCCGGCGTGTACCCCCAGGGCCACTCCGACACCACCGTCGC<br>CATCAGCACCAGCACGGTCCTGCTCTGCGGCCTGTCGGCCGTTTCCCTGCTGGCCTGCTACC<br>TGAAGTCCAGGCAGACCCCACCGCTGGCGTCCGTGGAAATGGAGGCCATGGAGGCTCTGCCC<br>GTGACCTGGGGGACCTCCTCCAGGGACGAGGATCTGGAAAATTGCAGCCACCACCTG |
| 913 | IL15Ra_WT_miR 122-CO10 | ATGGCCCCCAGGCGAGCCAGGGGCTGTAGGACCCTCGGCCTCCCCGCGCTCCTCCTCCTCCT<br>CCTCCTTAGGCCCCCGGCCACGCGGGGCATAACCTGCCCCCCGCCGATGTCCGTCGAGCACG<br>CCGACATTTGGGTTAAGAGCTACAGCCTCTACAGCAGGGAGAGGTACATCTGCAACAGCGGG<br>TTCAAAAGGAAGGCCGGCACCAGCAGCCTCACGGAGTGCGTCCTTAACAAGGCCACCAACGT<br>CGCTCACTGGACCACCCCATCCCTCAAGTGCATAAGGGACCCGGCCTTGGTACACCAGAGGC<br>CCGCCCCGCCGAGCACCGTGACCACGGCAGGAGTGACACCCCAGCCGGAGTCCCTGAGCCCG<br>AGCGGCAAAGAGCCGGCCGCCTCGAGCCCCAGCAGCAACAACACGGCCGCCACAACTGCCGC<br>CATCGTCCCCGGCAGCCAGCTGATGCCCAGCAAAAGCCCCAGCACGGGCACGACGGAGATCA<br>GCTCCCACGAAAGCTCCCACGGCACCCCCAGCCAGACCACCGCCAAGAACTGGGAGCTCACC<br>GCCTCCGCGTCGCACCAGCCCCCGGCGTGTATCCGCAGGGCCACAGCGACACAACCGTGGC<br>CATCAGCACCAGCACCGTGCTGCTGTGCGGCCTGTCCGCCGTGTCTCTGCTGGCATGCTACC<br>TGAAGTCCCGGCAGACCCCGCCCCTGGCCTCCGTGGAGATGGAGGCCATGGAGGCCCTGCCC<br>GTGACCTGGGGAACCAGCAGCAGGGACGAGGACCTGGAGAATTGCTCCCACCACCTG |
| 914 | IL15Ra_WT_miR 122-CO11 | ATGGCGCCCAGGCGGGCGCGGGGCTGCAGGACCCTCGGGCTTCCGGCCCTACTCCTCCTCCT<br>CTTACTCAGGCCCCCCGCGACGCGAGGCATCACCTGCCCTCCCCCCATGAGCGTCGAGCACG<br>CCGACATCTGGGTCAAGAGCTACTCCTTGTACAGCCGCGAACGTTACATCTGTAACAGCGGC<br>TTCAAGAGGAAGGCCGGCACGAGCTCCCTCACGGAGTGCGTACTCAACAAGGCCACCAACGT<br>GGCCCACTGGACCACGCCCTCCCTCAAGTGCATCAGGGACCCCGCCCTCGTTCATCAGAGGC<br>CTGCCCCACCAAGCACAGTGACGACCGCAGGTGTGACACCCCAGCCCGAGTCCCTATCCCCC<br>AGCGGCAAGGAGCCCGCCGCCAGCAGCCCCAGCAGCAACAACACCGCCGCCACCACGGCGGC<br>CATCGTGCCAGGCAGCCAGCTGATGCCCTCAAAATCACCCAGCACCGGCACCACCGAAATCA |

TABLE 11-continued

Additional sequence optimized nucleic acid encoding IL15 polypeptides

| SEQ ID NO | Name | Sequence |
|---|---|---|
| | | GCTCCCACGAGAGCAGCCATGGCACCCCCAGCCAGACGACCGCCAAAAACTGGGAGCTGACC<br>GCCAGCGCCAGCCACCAGCCCCCCGGGGTGTACCCCCAGGGGCACAGCGACACCACTGTGGC<br>CATCAGCACCAGCACCGTGCTCCTGTGCGGCTTGTCCGCCGTCTCCCTGCTGGCATGTTACC<br>TGAAAAGCAGGCAAACGCCCCCGCTGGCCTCCGTGGAGATGGAGGCCATGGAGGCCCTGCCC<br>GTGACCTGGGGAACCAGCTCGCGGGACGAAGATCTCGAGAATTGCTCCCATCACCTG |
| 915 | IL15Ra_WT_miR 122-CO12 | ATGGCCCCCAGGAGGGCCAGAGGCTGCAGGACCCTTGGGCTCCCCGCCCTCCTTCTCCTCCT<br>CCTCCTAAGGCCCCCGGCCACCCGCGGGATCACCTGCCCGCCCCCCATGAGCGTCGAACACG<br>CCGACATCTGGGTCAAGTCCTACAGCCTCTACAGCCGGGAGAGGTACATCTGCAACAGCGGC<br>TTCAAGCGTAAGGCCGGGACGAGCTCACTAACAGAGTGCGTCCTCAACAAGGCCACTAACGT<br>TGCGCACTGGACGACCCCCAGCCTCAAGTGCATCCGCGACCCGGCCCTCGTACACCAGAGGC<br>CCGCCCCGCCGAGCACCGTGACCACCGCCGGAGTGACACCCCAGCCTGAGAGCCTGTCTCCC<br>AGCGGGAAGGAGCCCGCTGCCTCCAGCCCGAGCAGCAACAACACCGCAGCGACCACCGCGGC<br>CATAGTGCCCGGCTCCCAGCTTATGCCCAGCAAGAGCCCCAGCACGGGAACCACCGAGATCA<br>GCTCGCACGAGTCCAGCCACGGGACACCCTCCCAGACCACCGCTAAGAATTGGGAGCTGACC<br>GCTAGCGCTTCCCACCAGCCCCCTGGGGTGTACCCACAGGGGCACAGCGACACCACGGTCGC<br>CATCAGCACCAGCACCGTGCTGCTGTGCGGCCTAAGCGCGGTGTCCCTGCTGGCGTGTTACC<br>TGAAGTCGCGGCAGACCCCACCCCTGGCCAGCGTCGAGATGGAGGCCATGGAGGCCCTGCCC<br>GTGACCTGGGGCACCAGCTCCAGGGATGAAGACCTCGAGAACTGCAGCCACCACCTA |
| 916 | IL15Ra_WT_miR 122-CO13 | ATGGCCCCCAGAAGGGCCAGGGGTTGCCGCACCCTCGGCCTCCCAGCCCTACTCCTCCTTCT<br>TCTCCTCCGCCCGCCCGCCACGAGGGGCATCACGTGCCCACCCCCCATGAGCGTCGAGCACG<br>CCGACATCTGGGTCAAGAGCTACAGCCTCTACTCCCGCGAGCGGTACATCTGCAATAGCGGG<br>TTCAAGAGGAAGGCCGGCACCTCCAGCCTCACCGAGTGCGTCCTCAACAAGGCCACCAACGT<br>CGCCCACTGGACCACCCCCAGTCTCAAGTGCATCAGGGATCCCGCCCTTGTCCACCAGAGGC<br>CCGCCCCACCCAGCACCGTGACCACCGCGGGGGTAACCCCCCAACCTGAGTCGCTGAGCCCC<br>AGCGGCAAGGAGCCCGCCGCCAGCAGCCCCAGCTCAAACAATACCGCCGCGACCACCGCCGC<br>CATCGTGCCCGGGAGCCAGCTGATGCCCAGCAAGTCCCCCAGCACGGGCACCACGGAGATCT<br>CCAGCCACGAGAGCAGCCACGGCACTCCCTCCCAAACCACCGCCAAGAACTGGGAGCTGACC<br>GCGTCCGCCTCGCATCAGCCTCCCGGCGTGTACCCCCAGGGCCACAGCGACACCACGGTCGC<br>CATCAGCACCAGCACCGTGCTCCTGTGTGGGCTGAGCGCCGTCAGCCTGCTGGCCTGCTACC<br>TGAAAAGCCGCCAGACCCCGCCCCTGGCGTCCGTCGAGATGGAGGCCATGGAGGCCCTGCCC<br>GTGACCTGGGGAACCAGCTCCAGGGACGAGGACCTGGAGAATTGCAGCCACCACCTC |
| 917 | IL15Ra_WT_miR 122-CO14 | ATGGCCCCCCGAAGGGCGAGGGGGTGCCGGACCCTCGGCCTCCCCGCCCTCTTACTCCTCTT<br>GCTCCTCCGCCCGCCCGCGACCAGGGGGATCACCTGTCCGCCGCCCATGTCCGTCGAGCACG<br>CCGACATCTGGGTCAAGTCCTACAGCCTCTATTCCCGGGAGAGGTACATCTGCAACAGCGGC<br>TTCAAACGTAAGGCCGGGACAAGCAGCCTTACGGAGTGCGTCCTCAACAAAGCCACCAACGT<br>GGCGCATTGGACCACCCCCAGCCTCAAGTGCATCAGGGATCCCGCCCTCGTTCACCAGAGGC<br>CCGCCCCACCCAGCACCGTGACAACCGCCGGGGTGACCCCCCAGCCCGAATCCCTGTCCCCG<br>AGCGGCAAGGAACCCGCCGCGAGCAGCCCCTCCAGCAACAACACCGCCGCTACCACCGCCGC<br>GATCGTGCCAGGCTCGCAGCTGATGCCCAGCAAGAGCCCGAGCACCGGGACGACCGAGATCT<br>CCAGCCACGAGTCCAGCCACGGGACCCCCAGCCAGACCACGGCCAAGAACTGGGAGCTCACC<br>GCCAGCGCGAGCCACCAGCCGCCCGGAGTCTACCCCCAGGGCCACAGCGACACCACCGTTGC<br>CATCTCCACGAGCACGGTGCTTCTGTGCGGCCTGTCGGCGGTGAGTCTCCTGGCCTGCTATC<br>TGAAATCCCGGCAGACCCCGCCCCTGGCCAGCGTCGAGATGGAGGCCATGGAGGCGCTGCCC<br>GTGACCTGGGGGACCTCCTCGCGCGATGAGGACCTGGAGAACTGCTCCCATCACCTG |
| 918 | IL15Ra_WT_miR 122-CO15 | ATGGCGCCCAGGAGGGCCAGGGGCTGCCGGACGCTCGGCCTCCCCGCCCTCCTCCTCCTATT<br>ACTCCTAAGGCCCCCCGCCACCAGGGGAATCACCTGTCCCCCGCCCATGTCCGTCGAGCACG<br>CCGACATCTGGGTCAAGAGCTACAGCCTCTACAGCAGGGAGCGGTACATCTGCAACAGCGGC<br>TTCAAGAGGAAGGCCGGCACCAGCAGCCTCACGGAGTGCGTCCTCAACAAGGCGACCAACGT<br>CGCCCATTGGACCACCCCGAGCTTAAAGTGCATCCGGGACCCCGCCCTTGTCCATCAAAGAC<br>CGGCGCCCCCCTCCACCGTGACGACAGCCGGGGTAACCCCCCAACCCGAGTCCCTGTCCCCC<br>TCCGGAAAGGAGCCCGCAGCCAGCTCCCCCAGCTCCAACAACACCGCCGCAACCACCGCCGC<br>GATCGTGCCGGGCAGCCAACTGATGCCCTCCAAGAGCCCATCCACCGGAACCACCGAGATCA<br>GCAGCCACGAGTCAAGCCACGGCACCCCCTCACAGACCACCGCCAAAAACTGGGAGCTGACC<br>GCCAGCGCCAGCCACCAGCCCCCCGGCGTGTACCCGCAGGGCCATAGCGACACAACCGTCGC<br>CATCAGCACCTCCACGGTGCTGCTGTGTGGTCTGAGCGCCGTCAGCCTGCTGGCCTGCTACC<br>TCAAGAGCCGCCAGACCCCTCCCCTGGCCTCCGTGGAGATGGAGGCCATGGAGGCCCTGCCC<br>GTCACGTGGGGGACGAGCAGCAGGGACGAGGACCTGGAGAACTGCTCCCATCACCTC |
| 919 | IL15Ra_WT_miR 122-CO16 | ATGGCCCCCAGGCGGGCCAGGGGCTGTAGGACACTCGGTCTGCCCGCCCTACTCCTCCTTCT<br>ACTACTCAGGCCCCCCGCCACACGCGGCATCACCTGTCCCCCGCCCATGAGCGTCGAGCACG<br>CGGACATCTGGGTCAAGAGCTATAGCCTCTATTCAAGGGAGCGGTACATCTGCAACAGCGGC<br>TTCAAGCGGAAGGCCGGGACCAGCTCGCTCACCGAGTGCGTCTTGAACAAAGCCACGAACGT<br>GGCCCACTGGACCACCCCCAGCCTCAAGTGCATCCGCGACCCCGCCCTCGTCCATCAGAGGC<br>CTGCCCCACCGTCCACGGTAACCACGGCCGGGGTCACCCCCCAACCCGAGTCCCTGAGCCCG<br>AGCGGCAAGGAGCCCGCCGCCAGCAGCCCCTCCAGCAACAACACGGCCGCCACGACCGCTGC<br>CATCGTGCCCGGCTCCCAGCTCATGCCGAGCAAGTCCCCCAGCACCGGCACCACGGAGATCA<br>GCTCCCACGAGTCCAGCCACGGGACCCCCTCCCAGACCACCGCCAAGAATTGGGAGCTGACG<br>GCCAGCGCCAGCCACCAGCCCCCCGGGGTGTACCCGCAAGGGCACTCCGACACCACCGTGGC<br>CATCAGCACCAGCACGGTGCTCCTGTGCGGCCTGAGCGCCGTCAGCCTGCTGGCGTGCTATC<br>TGAAAAGCAGGCAGACCCCGCCCCTGGCGTCCGTCGAGATGGAGGCTATGGAGGCCCTGCCG |

TABLE 11-continued

Additional sequence optimized nucleic acid encoding IL15 polypeptides

| SEQ ID NO | Name | Sequence |
|---|---|---|
| | | GTGACCTGGGGGACCAGCAGCCGTGACGAGGACCTGGAGAACTGTAGCCACCACCTG |
| 920 | IL15Ra_WT_miR 122-CO17 | ATGGCCCCACGCCGGGCCCGGGGCTGCAGGACCCTCGGCCTCCCCGCCCTCCTCCTCTTATT GCTCCTCCGGCCGCCCGCCACCAGAGGAATCACCTGCCCACCCCCGATGTCCGTCGAGCACG CCGACATCTGGGTCAAGAGCTACTCCCTCTACAGCAGGGAGAGGTACATCTGCAACAGCGGC TTCAAACGTAAAGCCGGCACCTCGTCCTTGACGGAGTGCGTCTTGAACAAGGCCACCAACGT CGCGCACTGGACCACCCCCTCCCTCAAGTGCATCAGGGATCCCGCCCTCGTACACCAGAGGC CCGCCCCACCCAGCACGGTGACCACGGCCGGGGTGACGCCGCAACCCGAATCACTGTCACCC TCCGGGAAGGAGCCCGCCGCGAGCAGCCCCAGCAGCAACAATACCGCCGCCACCACCGCGGC CATCGTGCCAGGGTCGCAGCTGATGCCCAGCAAGAGCCCCTCCACCGGCACCACGGAGATCT CCAGCCACGAGAGCAGCCACGGCACCCCAAGCCAGACCACCGCGAAGAACTGGGAGCTGACC GCCAGCGCCAGCCACCAGCCCCCCGGCGTGTACCCCCAGGGCCACAGCGACACCACGGTGGC CATCAGCACCTCAACCGTGCTGCTGTGCGGCCTGTCGGCCGTCTCCCTGCTGGCCTGCTACC TGAAAAGCAGGCAGACCCCGCCCCTGGCCTCCGTCGAGATGGAGGCAATGGAGGCCCTGCCC GTGACCTGGGGGACCAGCAGCCGGGACGAGGACCTCGAGAACTGCAGCCACCACCTC |
| 921 | IL15Ra_WT_miR 122-CO18 | ATGGCCCCGCGGAGGGCCAGGGGCTGCCGAACCTTAGGCCTACCAGCCCTCCTCCTCCTTCT CCTCCTCAGGCCCCCCGCCACCAGGGGGATCACGTGCCCGCCCCCCATGAGCGTAGAACACG CCGATATCTGGGTCAAGAGCTACTCCCTCTACTCCCGCGAGAGGTACATCTGTAACTCCGGC TTCAAGAGGAAGGCCGGGACCTCCAGCCTCACGGAGTGTGTCCTCAATAAGGCCACCAACGT CGCCCACTGGACCACCCCCAGCTTAAAGTGCATCCGCGACCCCGCACTCGTTCACCAGAGGC CCGCCCCGCCCAGCACCGTCACGACCGCAGGCGTGACGCCCCAGCCCGAAAGCCTGTCACCA AGCGGCAAGGAGCCGGCCGCCAGCTCACCAAGTTCCAACAACACCGCGGCGACCACCGCCGC GATCGTGCCCGGCAGCCAGCTGATGCCGAGCAAGAGCCCCTCCACGGGGACCACCGAGATCT CCAGCCACGAATCCAGCCACGGCACCCCCTCCCAGACCACCGCCAAGAACTGGGAGCTGACG GCCTCCGCCAGCCACCAGCCCCCCGGCGTGTACCCCCAGGGGCACAGCGACACGACCGTGGC CATCTCCACCTCCACCGTCCTGCTGTGCGGGCTCAGCGCCGTGAGCCTGCTGGCCTGCTACC TGAAGTCCAGGCAGACCCCTCCCCTGGCCAGCGTGGAAATGGAGGCCATGGAGGCGCTGCCC GTGACATGGGGCACCTCCAGCAGGGACGAGGACCTGGAGAATTGCTCGCACCACCTG |
| 922 | IL15Ra_WT_miR 122-CO19 | ATGGCCCCGCGGAGGGCCCGGGGTTGCCGGACCCTCGGCCTCCCCGCCCTCCTACTCCTCCT ATTGTTACGCCCGCCCGCCACCAGGGGGATCACCTGTCCCCCTCCCATGAGCGTCGAGCACG CGGACATCTGGGTCAAAAGCTACAGCTTGTATAGCCGCGAAAGGTACATCTGCAACTCCGGC TTTAAGAGGAAGGCCGGCACGTCCTCCCTCACCGAGTGCGTCCTCAACAAGGCCACCAACGT CGCCCATTGGACGACCCCCTCCCTCAAGTGCATCAGGGACCCCGCCCTCGTCCATCAGAGGC CAGCCCCACCGTCCACGGTCACCACCGCCGGGGTCACGCCCCAGCCCGAATCCCTGAGCCCC TCAGGCAAGGAGCCCGCCGCGAGCAGCCCCAGCTCCAATAACACGGCCGCGACCACCGCGGC CATCGTGCCCGGGTCCCAGCTGATGCCCAGCAAGAGCCCCAGCACCGGCACCACGGAGATCT CCAGCCACGAGAGCTCCCACGGCACCCCCAGCCAGACGACCGCTAAGAACTGGGAGCTGACC GCCTCGGCCAGCCACCAACCCCCCGGCGTCTACCCCCAGGGCCATAGCGACACCACCGTCGC CATCAGCACCAGCACGGTCCTGCTGTGCGGGCTGAGCGCAGTGAGCCTGCTCGCCTGCTACC TTAAGAGCAGGCAGACCCCGCCCCTGGCCAGCGTGGAGATGGAGGCCATGGAGGCCCTGCCC GTCACTTGGGGAACGAGCAGCCGCGACGAAGACCTGGAGAACTGCAGCCACCACCTG |
| 923 | IL15Ra_WT_miR 122-CO20 | ATGGCCCCCCGTCGGGCCAGGGGCTGCCGGACCCTCGGGCTCCCGGCCCTTTTGCTCTTGCT CCTCCTTAGGCCCCCCGCCACCCGAGGCATCACCTGCCCGCCCCCCATGTCCGTTGAGCACG CGGACATCTGGGTCAAGTCCTACTCCCTCTATAGCAGAGAACGGTACATCTGCAACAGCGGA TTCAAGCGGAAGGCGGGCACCAGCAGCCTCACCGAGTGCGTCCTCAACAAGGCCACCAACGT CGCCCACTGGACCACCCCCTCCCTCAAGTGCATCAGGGACCCGGCCCTCGTTCATCAGAGGC CCGCACCCCCCAGCACCGTGACCACCGCCGGTGTCACCCCGCAGCCCGAAAGCCTGAGCCCT AGCGGCAAGGAGCCCGCCGCCAGCAGCCCCAGCAGCAACAACACTGCCGCGACGACCGCCGC CATCGTGCCCGGAAGCCAGCTGATGCCCTCCAAATCGCCCAGCACCGGCACGACCGAGATAA GCAGCCACGAGAGCAGCCACGGGACGCCCAGCCAAACGACGGCCAAGAATTGGGAGCTGACC GCTTCCGCCTCCCACCAGCCCCCCGGGGTGTACCCACAGGGGCATAGCGACACCACCGTGGC CATCAGCACCTCGACCGTGCTGCTGTGTGGTCTGAGCGCCGTGTCACTGCTGGCCTGCTACC TGAAGTCCCGTCAGACCCCACCCCTGGCCTCGGTGGAGATGGAAGCCATGGAGGCCCTGCCC GTGACCTGGGGCACCAGCAGCAGGGACGAGGACCTGGAGAACTGCTCCCACCACCTG |
| 924 | IL15Ra_WT_miR 122-CO21 | ATGGCCCCTAGGAGGGCCCGGGGCTGCCGGACGTTGGGCCTCCCCGCCCTACTCCTCTTGTT GCTCCTCAGGCCCCCGGCCACCCGAGGCATCACCTGCCCTCCCCCCATGAGCGTCGAGCACG CCGACATCTGGGTAAAGAGCTACAGCTTGTACTCCAGGGAACGGTATATCTGCAATAGCGGG TTCAAGAGAAAGGCCGGGACTAGCAGCCTCACCGAGTGCGTACTCAACAAAGCCACCAACGT CGCCCACTGGACGACCCCGTCCCTAAAGTGCATCAGGGACCCCGCCCTCGTACACCAAAGGC CCGCCCCGCCGAGCACCGTGACCACCGCCGGGGTGACCCCTCAACCGGAGAGCCTGTCACCC AGCGGCAAAGAGCCCGCCGCCAGCTCCCCCAGCAGCAACAACACCGCCGCCACGACGGCGGC CATCGTGCCCGGCAGCCAGCTCATGCCGTCGAAAAGCCCCAGCACGGGGACCACGGAGATCT CCAGCCACGAATCCTCCCACGGGACCCCGAGCCAAACCACGGCCAAGAACTGGGAGCTGACC GCCAGCGCCAGCCACCAGCCCCCCGGCGTGTACCCCCAGGGCCACAGCGACACGACGGTGGC CATCAGCACCAGCACAGTCCTGCTGTGCGGGCTGTCGGCCGTGAGCCTCCTGGCATGCTACC TGAAAAGCCGGCAGACCCCGCCACTGGCCAGCGTGGAGATGGAGGCCATGGAGGCTCTCCCG GTGACCTGGGGCACCTCCAGCAGGGACGAGGACCTGGAGAACTGCAGCCACCACCTG |
| 925 | IL15Ra_WT_miR 122-CO22 | ATGGCCCCACGAAGGGCCCGGGGCTGTCGCACCCTCGGCCTCCCCGCCCTCCTCCTCCTACT CCTCCTCAGGCCGCCCGCCACCAGAGGCATCACGTGCCCTCCCCCCATGTCGGTCGAGCACG |

TABLE 11-continued

Additional sequence optimized nucleic acid encoding IL15 polypeptides

| SEQ ID NO | Name | Sequence |
|---|---|---|
| | | CCGATATCTGGGTCAAGAGCTACAGCCTCTACTCCAGGGAGAGGTACATCTGCAACTCCGGG<br>TTTAAGAGGAAAGCCGGGACCAGCAGCCTCACCGAGTGCGTCCTCAACAAGGCGACCAACGT<br>CGCCCACTGGACAACCCCCTCGCTCAAGTGTATCAGGGACCCCGCCCTAGTTCACCAGCGGC<br>CCGCCCCACCCAGCACTGTGACCACTGCCGGCGTAACCCCCCAGCCCGAGAGCCTCAGCCCC<br>AGCGGCAAGGAACCCGCCGCCAGCAGTCCCAGCAGCAACAATACGGCCGCCACTACGGCTGC<br>CATCGTCCCCGGCAGCCAGCTGATGCCCAGCAAGAGCCCGAGCACCGGGACCACCGAGATCA<br>GCAGCCACGAGAGCTCCCATGGCACACCCAGCCAGACCACCGCCAAGAACTGGGAGCTGACC<br>GCCTCCGCCTCCCACCAGCCCCCGGGGTGTACCCCCAGGGCCACAGCGACACCACCGTGGC<br>CATCAGCACCAGCACCGTGCTGCTGTGTGGTCTGAGCGCCGTGTCCCTGCTCGCGTGTTACC<br>TCAAGAGCAGGCAGACGCCTCCCCTGGCCAGCGTGGAGATGGAGGCCATGGAGGCCCTGCCC<br>GTGACCTGGGGCACCAGCTCCAGGGACGAGGACTTGGAGAACTGCTCCCACCACCTG |
| 926 | IL15Ra_WT_miR 122-CO23 | ATGGCCCCCCGGAGGGCCCGGGGGTGCCGCACCCTTGGGCTCCCCGCCCTCCTCCTTCTCCT<br>CCTCTTAAGACCGCCCGCCACCAGGGGCATCACGTGTCCCCCGCCCATGTCCGTTGAGCACG<br>CGGACATCTGGGTCAAGTCCTACAGCCTCTACAGCCGCGAGAGGTACATCTGTAACAGCGGC<br>TTCAAACGGAAGGCCGGGACCTCCAGCCTCACGGAGTGCGTCTTGAACAAAGCCACCAACGT<br>GGCCCACTGGACGACCCCCAGTCTCAAGTGTATACGGGACCCGGCCCTTGTACACCAGAGGC<br>CCGCCCCACCGTCCACCGTGACTACTGCCGGCGTGACGCCCCAACCGGAGTCCCTGAGCCCC<br>TCCGGCAAGGAGCCCGCCGCCTCGAGCCCAAGCAGCAACAACACCGCAGCTACCACCGCCGC<br>CATCGTGCCCGGCTCCCAGCTGATGCCCTCCAAGAGCCCCTCTACCGGTACCACCGAGATCT<br>CCAGCCACGAATCGTCGCACGGGACCCCCCAGCCAGACCACGGCCAAGAACTGGGAGCTGACG<br>GCCTCCGCCAGCCACCAGCCCCCCGGCGTGTACCCCCAGGGGCACTCCGACACAACCGTGGC<br>CATCTCCACCAGCACCGTTCTGCTGTGCGGCCTGAGCGCCGTCTCCCTGCTCGCCTGCTATC<br>TGAAAAGCAGGCAGACCCCGCCCCTGGCCTCCGTGGAGATGGAGGCCATGGAGGCCCTCCCG<br>GTCACGTGGGGCACGTCGAGCCGTGACGAGGACCTCGAGAACTGCTCACACCACCTG |
| 927 | IL15Ra_WT_miR 122-CO24 | ATGGCGCCCAGGAGGGCGCGAGGCTGCAGGACCCTCGGCCTCCCCGCCCTCCTCCTCCTACT<br>CCTCCTCAGGCCCCCCGCCACCAGGGGGATAACCTGCCCACCCCCCCATGAGCGTAGAGCACG<br>CGGACATCTGGGTCAAGAGCTACAGCCTCTACAGCAGGGAGAGGTACATCTGCAACAGCGGC<br>TTTAAGCGGAAGGCCGGCACCAGCTCGCTTACGGAGTGTGTCCTCAACAAGGCCACCAACGT<br>CGCCCACTGGACCACCCCCAGCCTCAAGTGCATCAGGGACCCGGCCCTCGTCCATCAGAGGC<br>CCGCCCCACCCAGCACCGTCACCACAGCCGGGGTAACACCCCAGCCCGAGAGCCTGAGCCCG<br>AGCGGCAAGGAGCCTGCCGCCTCCTCCCCGAGCAGCAACAATACCGCCGCAACGACTGCCGC<br>CATCGTGCCGGGCTCACAGCTGATGCCAAGCAAGAGCCCCAGCACCGGCACCACCGAGATCA<br>GCAGCCATGAGAGCTCGCACGGCACCCCCCAGCCAAACCACCGCCAAGAACTGGGAGCTGACC<br>GCCAGCGCCTCCCACCAGCCCCCCGGCGTGTACCCCCAGGGCCACTCGGATACCACCGTGGC<br>CATAAGCACCTCCACGGTGCTGCTCTGTGGCCTCAGCGCCGTGTCCCTGCTGGCCTGCTATC<br>TGAAAAGCCGGCAGACCCCACCCCTGGCCAGCGTGGAGATGGAGGCCATGGAGGCCCTGCCC<br>GTGACCTGGGGTACGTCCTCCAGGGACGAGGATCTCGAGAACTGCTCCCACCACCTG |
| 928 | IL15Ra_WT_miR 122-CO25 | ATGGCCCCCCGGAGGGCCCGAGGGTGCCGGACGCTCGGGTTACCCGCCCTTCTCCTCCTATT<br>GCTCCTCCGCCCACCCGCCACGAGGGGTATCACCTGCCCTCCGCCCATGAGCGTCGAGCACG<br>CGGACATCTGGGTCAAGTCCTACAGCCTCTACAGCCGCGAGCGGTACATCTGCAACAGCGGT<br>TTCAAGAGGAAGGCAGGGACCAGCTCCCTCACGGAGTGCGTCCTCAACAAGGCCACCAACGT<br>CGCGCACTGGACCACCCCGAGCCTCAAGTGCATCAGGGACCCCGCCCTCGTCCACCAGAGGC<br>CAGCCCCGCCCAGCACCGTCACCACCGCCGGCGTGACCCCTCAGCCCGAAAGCCTGAGCCCC<br>AGCGGCAAGGAACCGGCGGCCAGCTCCCCAAGCAGCAACAACACGGCCGCCACCACCGCCGC<br>CATCGTGCCCGGGAGCCAGCTGATGCCCAGCAAGTCCCCGAGCACGGGCACCACCGAGATCT<br>CCAGCCACGAGTCCTCCCACGGCACCCCCCAGCCAGACCACCGCCAAGAACTGGGAGCTGACG<br>GCCAGCGCCAGCCACCAGCCGCCGGGCGTCTACCCGCAGGGGCACTCCGATACCACCGTAGC<br>CATATCCACCAGCACCGTTCTGCTGTGTGGCCTCTCCGCCGTCTCCCTGCTGGCCTGCTACC<br>TGAAAAGCAGGCAGACCCCACCACTGGCCAGCGTGGAGATGGAAGCCATGGAGGCCCTGCCC<br>GTGACCTGGGGCACCTCCAGCCGCGACGAGGACCTCGAGAATTGCTCCCATCACCTG |
| 929 | IL15opt-tPa6-CO26 | ATGGACGCCATGAAGCGCGGTTTGTGTTGCGTCCTCCTTCTCTGCGGGGCGGTCTTCGTCAG<br>CCCGTCCCAGGAGATCCACGCCAGGTTCAGGCGGGGAGCCCGCAACTGGGTCAACGTTATCA<br>GCGATCTTAAAAAGATCGAGGACCTCATCCAATCGATGCACATCGACGCCACGTTATACACG<br>GAGTCCGACGTGCACCCCAGCTGCAAGGTCACCGCCATGAAGTGCTTCCTCCTCGAGCTCCA<br>AGTCATATCGCTCGAAAGCGGAGACGCGAGCATCCACGACACCGTCGAGAACCTGATCATCC<br>TGGCCAACAACAGCCTGTCGAGCAACGGGAACGTGACCGAGAGCGGGTGCAAGGAGTGCGAG<br>GAGCTGGAGGAGAAGAACATCAAGGAGTTCCTGCAGAGCTTCGTGCACATCGTCCAGATGTT<br>CATAAACACCAGC |
| 930 | IL15opt-tPa6-CO27 | ATGGACGCCATGAAAAGGGGGCTCTGCTGCGTCCTCCTCCTCTGCGGGGCCGTCTTCGTGAG<br>CCCCAGCCAGGAGATCCACGCCCGGTTCAGGAGGGGGGCCCGGAATTGGGTAAACGTCATCA<br>GCGACCTCAAGAAGATCGAGGACCTCATCCAGTCCATGCACATCGACGCCACGCTCTATACC<br>GAGAGCGACGTCCACCCAAGCTGCAAGGTCACCGCCATGAAGTGCTTCCTCCTCGAGCTCCA<br>GGTCATCAGCCTCGAGAGCGGCGACGCCAGCATCCACGACACCGTTGAGAACCTCATCATCC<br>TGGCCAACAATAGCCTCTCCTCAAACGGCAACGTGACCGAGAGCGGGTGCAAAGAGTGTGAG<br>GAGCTGGAGGAGAAAAACATCAAGGAGTTCCTGCAGAGCTTCGTGCACATCGTGCAGATGTT<br>CATCAACACCAGC |
| 931 | IL15opt-tPa6-CO28 | ATGGACGCAATGAAGAGGGGCCTCTGTTGCGTCCTACTCTTGTGCGGGGCCGTCTTCGTCAG<br>CCCCAGCCAGGAGATCCACGCGAGGTTCCGCAGGGGCGCGAGGAATTGGGTCAACGTCATCT |

TABLE 11-continued

Additional sequence optimized nucleic acid encoding IL15 polypeptides

| SEQ ID NO | Name | Sequence |
|---|---|---|
| | | CGGACCTCAAGAAAATCGAGGACCTCATCCAGTCGATGCACATCGACGCCACCCTCTACACCGAGTCCGACGTGCATCCCAGTTGCAAGGTCACCGCCATGAAGTGCTTCCTCCTCGAGCTCCAGGTCATCTCCCTTGAGTCCGGCGACGCCAGTATCCACGACACGGTCGAGAACCTGATCATCCTGGCCAACAACAGCCTGTCCAGCAACGGCAACGTGACCGAGTCCGGCTGCAAGGAGTGCGAGGAGCTGGAGGAGAAGAACATCAAGGAGTTCCTCCAAAGCTTCGTGCACATCGTGCAGATGTTCATAAATACCAGC |
| 932 | IL15opt-tPa6-CO29 | ATGGACGCCATGAAGAGGGGCCTCTGTTGCGTCCTTCTCCTCTGCGGGGCCGTCTTCGTCAGCCCCAGCCAGGAGATACACGCAAGGTTCCGCAGGGGGGCCCGCAACTGGGTCAACGTGATCAGCGACCTCAAGAAAATCGAGGACCTCATACAGAGCATGCACATCGACGCCACCCTCTACACCGAGAGCGACGTCCACCCCAGCTGTAAGGTCACCGCCATGAAGTGCTTCCTCTTGGAACTCCAGGTCATCAGCCTCGAGAGCGGCGACGCCTCGATCCACGACACCGTTGAGAACCTGATCATCCTGGCCAACAACAGCCTCAGCTCCAACGGCAATGTGACGGAGAGCGGCTGCAAGGAGTGCGAGGAGCTGGAGGAGAAGAACATCAAAGAGTTCCTCCAGTCCTTCGTGCACATCGTGCAGATGTTCATCAACACCAGC |
| 933 | IL15opt-tPa6-CO30 | ATGGACGCCATGAAGAGGGGCTTATGCTGCGTCCTCCTCCTGTGCGGAGCCGTCTTCGTCAGCCCCAGCCAGGAGATCCACGCCAGGTTCAGGCGCGGCGCCAGGAACTGGGTCAACGTCATCTCCGACCTCAAAAAGATCGAGGACCTCATACAGAGCATGCACATCGACGCCACGCTCTACACGGAGTCAGACGTCCACCCCAGCTGCAAGGTAACCGCCATGAAGTGTTTCCTCCTCGAGCTCCAGGTCATCAGCTTGGAGAGCGGGGACGCCTCCATCCACGACACGGTAGAGAACCTCATCATCCTGGCCAACAACAGCCTGAGCTCCAACGGCAACGTGACGGAGTCCGGCTGCAAGGAGTGCGAGGAACTGGAGGAGAAGAACATCAAGGAGTTCCTGCAGTCCTTCGTGCACATCGTGCAGATGTTCATCAACACGTCT |
| 934 | IL15opt-tPa6-CO31 | ATGGACGCCATGAAGAGGGGGCTTTGTTGCGTACTCCTCCTTTGCGGGGCCGTCTTCGTAAGCCCCAGCCAGGAGATACACGCCCGGTTTAGGAGGGGAGCGCGCAACTGGGTCAACGTCATCTCCGACCTCAAGAAGATCGAGGATCTCATTCAGTCGATGCACATCGACGCCACCCTCTACACCGAGTCCGACGTCCACCCCAGCTGCAAGGTAACCGCAATGAAGTGTTTCCTACTCGAGCTACAGGTAATCTCTCTCGAGTCCGGGGACGCCTCGATCCACGACACCGTAGAGAACCTCATCATACTGGCCAACAATTCGCTGTCCTCCAACGGGAATGTGACCGAGAGCGGCTGTAAGGAGTGCGAGGAGCTGGAGGAGAAGAACATAAAGGAGTTCCTGCAGAGCTTCGTGCACATCGTGCAAATGTTCATCAACACCAGC |
| 935 | IL15opt-tPa6-CO32 | ATGGACGCCATGAAGAGGGGCCTCTGTTGCGTCCTTCTCTTGTGCGGGGCCGTCTTCGTCAGCCCCTCGCAGGAGATACACGCGCGATTCAGGAGGGGGGCCAGGAACTGGGTCAACGTCATAAGCGATCTAAAGAAGATCGAGGACCTCATCCAGAGCATGCACATAGACGCCACCCTCTACACCGAGAGCGACGTGCACCCCTCCTGCAAGGTAACCGCCATGAAGTGCTTCCTCCTCGAGTTGCAGGTCATCTCGCTCGAGAGCGGAGACGCCTCCATCCACGACACCGTCGAGAATCTCATCATCCTTGCCAACAACTCACTCAGCAGCAACGGAAACGTCACCGAGTCCGGCTGCAAAGAGTGCGAGGAGCTGGAGGAGAAAAACATCAAGGAGTTCCTGCAGAGCTTCGTGCACATCGTGCAGATGTTCATCAACACCAGC |
| 936 | IL15opt-tPa6-CO33 | ATGGACGCCATGAAGAGGGGCCTCTGCTGTGTCCTCCTCCTCTGTGGCGCCGTCTTCGTCAGCCCCAGCCAGGAGATCCACGCCCGCTTCAGGAGGGGCGCCCGGAATTGGGTCAACGTCATCAGCGACCTAAAGAAGATCGAGGATCTCATACAGAGCATGCACATCGACGCCACGCTCTACACAGAGAGCGACGTCCACCCGAGCTGCAAGGTAACCGCCATGAAGTGCTTCCTCCTCGAGCTTCAGGTCATCTCGCTCGAGAGCGGGGACGCTAGCATACACGATACAGTCGAGAACCTGATCATCCTGGCCAACAACTCTCTCTCCAGCAACGGGAACGTGACCGAGAGCGGGTGCAAGGAATGCGAGGAGCTGGAGGAGAAGAACATCAAGGAGTTCCTCCAAAGCTTTGTGCACATCGTGCAGATGTTTATCAACACCAGC |
| 937 | IL15opt-tPa6-CO34 | ATGGACGCCATGAAGCGCGGCCTCTGCTGTGTACTCCTCTTGTGCGGCGCCGTTTTCGTCAGCCCCTCCCAGGAGATCCACGCGCGATTCAGGAGGGGGGCCAGGAACTGGGTCAACGTTATCAGCGATCTCAAGAAGATCGAGGACTTGATCCAGAGTATGCACATCGACGCCACGCTCTACACCGAGAGCGACGTGCACCCCTCGTGCAAGGTTACCGCCATGAAGTGCTTCCTCCTCGAGCTCCAGGTAATCAGCCTCGAGTCCGGGGACGCCAGCATCCACGACACAGTCGAGAACCTGATCATCCTGGCCAACAACAGCCTGTCGAGCAACGGAAACGTGACCGAGAGCGGGTGCAAGGAATGCGAGGAGCTGGAGGAGAAGAATATAAAGGAGTTCCTGCAGTCCTTTGTGCATATCGTGCAGATGTTCATCAACACGAGC |
| 938 | IL15opt-tPa6-CO35 | ATGGACGCGATGAAGCGGGGCTTATGCTGTGTCCTCCTTCTCTGCGGCGCCGTCTTCGTGAGCCCGTCCCAGGAGATCCACGCCAGGTTTCGCCGGGGCGCCAGGAACTGGGTCAACGTCATCAGCGACCTCAAAAAGATCGAGGACCTCATCCAGTCCATGCACATCGACGCCACCCTTTACACCGAGTCCGACGTGCACCCCAGCTGCAAGGTCACCGCCATGAAGTGCTTCCTCCTCGAGCTCCAGGTCATCAGCCTTGAGTCCGGCGACGCGAGCATCCACGACACCGTCGAGAACCTGATCATCCTGGCCAACAACAGCCTCTCGAGCAACGGGAATGTGACGGAGTCGGGATGTAAGGAGTGCGAGGAGCTGGAGGAGAAGAACATCAAGGAGTTTCTTCAGTCCTTTGTGCACATAGTGCAGATGTTTATCAACACCAGT |
| 939 | IL15opt-tPa6-CO36 | ATGGACGCCATGAAGAGGGGGCTCTGCTGTGTCTTGCTCCTCTGCGGCGCCGTTTTCGTCAGCCCGAGCCAAGAGATCCACGCGCGGTTTCGGCGCGGCGCCCGGAACTGGGTCAACGTCATATCCGACCTAAAGAAGATCGAGGACCTCATCCAGAGCATGCACATCGACGCCACCCTCTACACCGAGTCCGACGTCCACCCCAGCTGCAAGGTTACGGCCATGAAGTGCTTCCTCCTCGAGCTCCA |

TABLE 11-continued

Additional sequence optimized nucleic acid encoding IL15 polypeptides

| SEQ ID NO | Name | Sequence |
|---|---|---|
| | | GGTCATCAGCTTAGAGAGCGGGGACGCCAGCATCCACGACACCGTCGAGAATCTGATCATTC TGGCGAACAACAGCCTGAGCAGCAATGGGAACGTGACCGAGTCGGGGTGTAAGGAGTGCGAG GAGCTGGAGGAGAAGAACATCAAGGAGTTTCTGCAGTCCTTCGTGCACATCGTGCAGATGTT TATCAACACCTCG |
| 940 | IL15opt-tPa6-CO37 | ATGGACGCCATGAAGCGGGGGCTCTGCTGCGTACTCCTCCTCTGCGGCGCCGTCTTCGTCAG CCCCAGCCAGGAGATACACGCCCGCTTTCGGAGGGGCGCTAGGAACTGGGTTAACGTAATCT CCGACCTCAAGAAGATCGAGGACCTCATCCAGAGCATGCACATCGACGCCACCCTCTACACC GAAAGCGACGTCCACCCGAGCTGCAAGGTCACGGCCATGAAGTGTTTTCTCCTCGAGCTCCA GGTTATCAGCCTTGAGAGCGGCGACGCCTCCATCCACGACACCGTCGAGAATCTGATCATCC TGGCCAATAACAGCCTCAGCTCGAACGGCAACGTGACCGAGAGCGGGTGCAAAGAGTGCGAG GAGCTGGAGGAGAAGAACATCAAGGAGTTCCTGCAGTCCTTCGTGCATATCGTGCAGATGTT CATCAACACCAGC |
| 941 | IL15opt-tPa6-CO38 | ATGGACGCCATGAAGCGCGGCCTCTGCTGCGTCCTACTCCTTTGCGGGGCCGTATTCGTCAG CCCCAGCCAGGAGATCCACGCCCGGTTCCGGAGGGGCGCTAGGAACTGGGTTAACGTGATCA GCGACTTGAAGAAGATCGAGGACCTCATCCAGAGCATGCACATCGACGCGACCTTGTATACC GAGTCGGACGTCCACCCCAGCTGCAAGGTCACCGCCATGAAGTGCTTTCTCCTCGAGCTCCA GGTCATCTCTCTCGAAAGCGGCGACGCCAGCATCCACGACACCGTCGAGAACCTGATCATCC TGGCCAATAACTCCCTGTCCTCCAACGGCAATGTGACGGAGTCCGGGTGCAAGGAGTGCGAG GAGCTCGAGGAGAAGAACATCAAGGAGTTCCTCCAAAGCTTTGTGCACATCGTGCAGATGTT CATCAACACCAGC |
| 942 | IL15opt-tPa6-CO39 | ATGGACGCCATGAAGAGGGGCCTTTGCTGCGTCTTGCTCCTCTGCGGCGCCGTATTCGTGAG CCCATCCCAGGAGATCCACGCCAGGTTCCGCAGGGGGGCCCGCAACTGGGTCAACGTCATCA GCGACCTTAAAAAGATCGAGGACCTCATCCAGTCCATGCACATCGACGCAACCCTATACACC GAGTCGGACGTGCATCCCAGTTGCAAGGTAACCGCCATGAAGTGCTTTCTCCTCGAGCTCCA GGTAATCAGCTTAGAGAGCGGAGACGCCAGCATCCACGACACGGTTGAAAACCTCATTATCC TGGCCAACAACTCCCTGTCCAGCAACGGCAACGTGACCGAGTCGGGGTGCAAGGAGTGCGAG GAGCTGGAGGAGAAGAACATCAAGGAGTTCCTGCAAAGCTTCGTGCACATCGTGCAGATGTT CATCAACACCAGC |
| 943 | IL15opt-tPa6-CO40 | ATGGACGCCATGAAGAGGGGCCTCTGCTGCGTCCTCCTCCTCTGCGGCGCCGTCTTCGTGTC GCCCAGCCAGGAGATCCACGCCAGATTCCGGCGAGGGGCCAGGAACTGGGTCAACGTCATTA GCGACCTTAAGAAGATCGAGGACCTCATCCAGAGCATGCACATCGACGCCACGCTCTACACC GAGTCCGACGTCCACCCCAGCTGCAAGGTCACCGCCATGAAGTGTTTCCTCCTCGAGCTCCA GGTCATCTCCCTAGAGAGCGGGGACGCCTCGATACACGACACCGTTGAGAACCTGATCATCC TCGCGAACAACTCCCTCAGCTCCAACGGGAACGTGACCGAGAGCGGGTGTAAGGAATGCGAG GAGCTGGAGGAGAAGAACATCAAAGAGTTTCTGCAGAGCTTCGTGCACATCGTGCAGATGTT CATCAACACGAGC |
| 944 | IL15opt-tPa6-CO41 | ATGGACGCGATGAAGAGGGGCCTCTGTTGCGTCCTCCTCCTCTGCGGGGCCGTCTTCGTGAG CCCCAGCCAGGAGATCCACGCGAGGTTCAGGCGGGGCGCCAGGAACTGGGTCAACGTCATCA GCGATCTAAAGAAGATCGAGGACCTCATCCAGTCCATGCACATCGACGCCACCCTATATACC GAGAGCGACGTTCACCCCAGCTGCAAGGTTACCGCCATGAAGTGCTTCCTCCTAGAGCTCCA AGTCATCAGCCTCGAAAGCGGCGACGCCTCCATCCACGACACCGTCGAGAACCTGATCATCC TCGCCAATAATAGCCTGTCCAGCAACGGGAATGTGACGGAGTCGGGATGCAAGGAGTGCGAG GAGCTGGAGGAGAAGAACATCAAAGAGTTCCTCCAGAGCTTTGTGCACATCGTGCAGATGTT CATCAATACCAGC |
| 945 | IL15opt-tPa6-CO42 | ATGGACGCCATGAAGAGGGGCCTCTGCTGCGTCCTCCTTCTCTGCGGGGCGGTGTTCGTGAG CCCCAGCCAGGAGATCCACGCCCGCTTCCGCCGCGGCGCCCGGAACTGGGTCAACGTCATCA GCGACCTTAAGAAGATCGAGGACCTAATCCAGAGCATGCACATCGACGCCACGCTATATACC GAGAGCGACGTGCACCCCAGCTGCAAGGTCACCGCCATGAAGTGCTTCCTCCTCGAGCTCCA GGTCATCAGCCTCGAGAGCGGCGACGCCAGCATCCACGACACCGTTGAGAACCTGATCATCC TGGCCAACAACAGCCTCAGCTCCAACGGCAACGTGACCGAGAGCGGCTGCAAGGAGTGCGAG GAGCTCGAGGAGAAGAACATCAAGGAGTTCCTCCAGTCCTTCGTGCACATCGTGCAGATGTT CATCAACACCTCC |
| 946 | IL15opt-tPa6-CO43 | ATGGACGCCATGAAGCGGGGGCTCTGCTGCGTCCTCCTCCTTTGCGGGGCCGTCTTCGTCAG CCCCAGCCAAGAGATACACGCCAGGTTCCGCCGCGGGGCCAGAAACTGGGTTAACGTAATCA GCGACCTCAAGAAGATCGAGGACCTTATCCAGAGCATGCATATCGACGCCACGCTCTACACG GAGAGCGACGTCCATCCCAGCTGCAAGGTCACCGCCATGAAGTGTTTTCTCCTCGAGCTTCA GGTCATTTCCTTGGAAAGCGGGGACGCCTCCATCCACGACACGGTCGAAAACCTCATCATCC TGGCCAACAACAGCCTCTCCTCCAACGGGAACGTGACCGAGTCCGGGTGCAAGGAATGCGAG GAGCTGGAGGAGAAAAACATCAAGGAGTTTCTGCAGAGCTTTGTCCACATCGTGCAGATGTT CATCAACACCAGC |
| 947 | IL15opt-tPa6-CO44 | ATGGACGCCATGAAGCGGGGTCTGTGTTGCGTCCTCCTCCTCTGCGGAGCGGTTTTCGTTAG CCCCAGCCAGGAGATCCACGCCCGGTTCAGGAGGGGCGCCCGCAACTGGGTAAACGTCATCT CCGACCTTAAGAAGATCGAGGACCTCATTCAGAGCATGCACATCGACGCCACCCTCTACACG GAGTCCGACGTGCACCCCTCCTGTAAGGTCACCGCCATGAAGTGCTTTCTCCTCGAGCTCCA GGTCATCAGCCTGGAGAGCGGGGACGCCTCCATACACGACACGGTGGAGAACCTAATCATCC TAGCCAACAACAGCCTGAGCTCGAACGGAAATGTGACCGAAAGCGGCTGCAAGGAGTGCGAG |

TABLE 11-continued

Additional sequence optimized nucleic acid encoding IL15 polypeptides

| SEQ ID NO | Name | Sequence |
|---|---|---|
| | | GAACTGGAGGAGAAGAACATCAAGGAGTTCCTGCAGAGCTTCGTGCACATCGTCCAGATGTT<br>CATAAACACCAGC |
| 948 | IL15opt-tPa6-CO45 | ATGGACGCGATGAAGAGGGGCCTCTGCTGCGTCCTCCTCCTCTGCGGCGCCGTTTTCGTCAG<br>CCCCAGCCAGGAGATACACGCCCGGTTTCGGAGGGGCGCCAGGAACTGGGTTAACGTCATCT<br>CCGATCTCAAGAAGATCGAGGACCTAATCCAGAGCATGCACATCGACGCCACGCTCTACACG<br>GAATCCGACGTCCACCCCAGCTGCAAGGTTACCGCCATGAAGTGCTTCCTCCTCGAGCTCCA<br>GGTCATCAGCTTAGAGAGCGGGGACGCGAGCATCCACGACACCGTGGAGAACCTCATCATCC<br>TGGCCAACAACTCCCTGAGCAGCAACGGCAACGTGACGGAGTCCGGCTGCAAGGAGTGCGAG<br>GAGCTGGAGGAAAAGAATATCAAGGAGTTCCTGCAGAGCTTCGTGCACATTGTCCAGATGTT<br>CATCAACACGTCC |
| 949 | IL15opt-tPa6-CO46 | ATGGACGCCATGAAGAGGGGGCTCTGCTGCGTCCTCCTCCTCTGCGGCGCCGTCTTCGTCTC<br>ACCGTCCCAGGAGATCCACGCCAGGTTCAGGAGGGGCGCCCGGAACTGGGTTAACGTCATCT<br>CCGACCTCAAGAAGATAGAGGACCTCATACAGTCGATGCACATCGACGCCACCCTTTACACC<br>GAGAGCGACGTCCACCCCAGCTGCAAGGTCACGGCCATGAAGTGTTTCCTCTTGGAGCTCCA<br>AGTCATCAGCCTCGAGAGCGGCGACGCCTCGATCCACGACACGGTCGAGAATCTGATCATCC<br>TGGCCAACAACAGCCTGAGCAGCAATGGAAACGTCACGGAGTCGGGCTGCAAGGAGTGCGAG<br>GAGCTGGAGGAGAAGAACATCAAGGAGTTCCTGCAGAGCTTCGTACACATAGTCCAGATGTT<br>CATCAACACCAGC |
| 950 | IL15opt-tPa6-CO47 | ATGGACGCCATGAAGAGGGGACTCTGCTGCGTCCTCCTCCTCTGCGGGGCCGTCTTCGTCAG<br>CCCCAGCCAGGAGATTCACGCCCGGTTCAGGAGGGGAGCCAGGAATTGGGTCAACGTCATCA<br>GCGACTTGAAGAAGATCGAGGACCTCATCCAGTCCATGCACATCGACGCCACCCTCTACACG<br>GAGTCCGACGTACATCCCAGCTGCAAGGTCACCGCCATGAAGTGCTTCCTCCTCGAGCTCCA<br>GGTCATCAGCCTTGAGAGCGGAGACGCCTCCATCCACGACACCGTTGAGAACCTGATCATCC<br>TGGCCAACAACAGCCTGAGCAGCAACGGCAACGTGACGGAGAGCGGGTGCAAGGAGTGCGAG<br>GAGCTGGAAGAGAAGAACATCAAGGAGTTTCTGCAAAGCTTCGTCCATATAGTGCAGATGTT<br>CATCAATACGAGC |
| 951 | IL15opt-tPa6-CO48 | ATGGACGCCATGAAGCGCGGGCTCTGCTGCGTACTCCTCCTCTGCGGGGCCGTCTTCGTGAG<br>CCCCAGCCAGGAGATCCACGCCCGCTTCAGGCGGGGGGCCCGCAACTGGGTAAACGTCATCA<br>GCGACCTCAAGAAGATCGAGGACCTCATCCAGAGCATGCACATCGACGCCACCCTTTACACC<br>GAGTCCGACGTTCACCCGTCCTGCAAGGTCACCGCCATGAAGTGTTTCCTACTCGAACTCCA<br>AGTCATATCCTTGGAGTCCGGAGACGCCTCCATCCACGACACCGTCGAGAACCTGATCATCC<br>TGGCCAACAACTCGCTGTCCAGCAACGGCAACGTGACGGAGAGCGGATGCAAGGAGTGTGAG<br>GAGCTGGAGGAAAAGAACATCAAGGAGTTCCTGCAGAGCTTTGTGCACATCGTGCAGATGTT<br>TATCAACACCTCC |
| 952 | IL15opt-tPa6-CO49 | ATGGACGCCATGAAGCGGGGACTCTGCTGCGTCCTACTCCTCTGCGGGGCCGTCTTCGTAAG<br>CCCCAGCCAGGAGATCCACGCCCGCTTTAGGAGGGGCGCCAGGAACTGGGTCAACGTCATAA<br>GCGACCTCAAAAAGATCGAGGACCTCATCCAGTCGATGCACATCGACGCCACCCTCTATACC<br>GAGTCCGACGTGCACCCGTCCTGTAAGGTTACCGCAATGAAGTGCTTCCTCTTGGAACTCCA<br>GGTCATCAGCCTCGAGAGCGGCGACGCCAGCATCCACGACACCGTCGAGAACCTGATCATCC<br>TGGCCAACAACTCCCTGAGCAGCAACGGCAACGTGACCGAAAGCGGGTGCAAGGAGTGCGAG<br>GAGCTGGAGGAGAAGAATATCAAGGAATTTCTGCAGTCGTTTGTGCATATAGTGCAGATGTT<br>CATCAACACCTCT |
| 953 | IL15opt-tPa6-CO50 | ATGGACGCGATGAAGCGCGGGCTATGCTGCGTCCTATTGCTCTGCGGCGCCGTCTTCGTCAG<br>CCCGAGCCAAGAGATACACGCCCGCTTTAGGAGGGGGGCCAGGAACTGGGTCAACGTAATAT<br>CCGACTTAAAGAAGATCGAGGATCTCATCCAGAGCATGCACATCGACGCCACCCTCTACACG<br>GAGAGCGACGTCCACCCCAGCTGCAAGGTCACCGCCATGAAGTGTTTCCTTCTTGAGCTCCA<br>GGTCATCAGCCTAGAGTCCGGGGACGCCAGCATCCACGACACGGTTGAGAACCTGATAATCC<br>TGGCCAACAACAGCCTGAGCAGCAACGGCAATGTGACCGAGAGCGGGTGCAAGGAGTGCGAG<br>GAGCTGGAGGAGAAGAACATCAAGGAGTTCCTCCAGAGCTTCGTCCACATCGTGCAGATGTT<br>CATCAACACCAGC |
| 954 | IL15_Fc_RLI-CO01 | ATGGAAACCGACACCCTCCTCCTCTGGGTCCTCCTACTCTGGGTTCCCGGAAGCACCGGCGA<br>ACCGAAAAGCTGCGACAAGACCCACACCTGCCCCCCGTGCCCCGCCCCCGAGCTCCTCGGGG<br>GCCCCAGCGTCTTCCTCTTCCCCCCGAAGCCCAAAGATACCTTAATGATCAGCCGGACCCCG<br>GAGGTCACGTGCGTCGTCGTCGCCGTCAGCCACGAGGACCCGGAGGTTAAGTTCAACTGGTA<br>CGTCGACGGCGTCGAGGTCCACAACGCGAAAACCAAGCCCCGGGAAGAACAGTATAATAGCA<br>CTTACCGGGTGGTGTCCGTGCTGACCGTTCTTCACCAGGACTGGCTGAACGGCAAGGAGTAC<br>AAGTGCAAGGTGTCCAATAAGGCCCTGCCCGCGCCCATCGAGAAGACCATCAGCAAGGCCAA<br>GGGCCAGCCCAGGGAACCCCAGGTATACACCCTGCCACCCAGCCGGGACGAGCTCACCAAGA<br>ACCAGGTGAGCCTGACCTGCCTGGTGAAGGGGTTCTATCCCAGCGACATCGCTGTCGAATGG<br>GAGAGCAACGGCCAGCCCGAGAACAACTATAAGACCACACCCCCCGTGCTGGACAGCGACGG<br>CAGCTTCTTCCTGTACAGCAAGCTGACCGTCGACAAAAGCCGGTGGCAGCAAGGCAACGTGT<br>TTAGCTGCTCCGTCATGCACGAGGCCCTGCACAACCACTACACCCAGAAGAGTCTGAGCCTG<br>TCCCCCGGCAAGATCACCTGCCCGCCCCCAATGAGCGTGGAGCACGCCGACATCTGGGTGAA<br>GTCGTACTCCCTGTACAGCAGGGAGAGGTACATCTGCAACAGTGGATTCAAGCGGAAGGCCG<br>GGACCAGCAGCCTGACCGAGTGCGTCCTGAATAAGGCCACCAACGTGGCCCACTGGACCACC<br>CCCTCGCTGAAATGTATAAGGGATCCCGCCCTGGTGCACCAGAGGCCCGCCCCACCGAGCGG<br>TGGCTCCGGCGGAGGCGGCAGCGGGGGCGGAAGCGGCGGAGGCGGGAGCCTGCAGAACTGGG |

TABLE 11-continued

Additional sequence optimized nucleic acid encoding IL15 polypeptides

| SEQ ID NO | Name | Sequence |
|---|---|---|
| | | TGAACGTCATCTCCGACCTGAAAAAGATCGAGGACCTTATCCAGAGCATGCACATCGACGCG<br>ACCCTCTACACCGAGAGCGATGTACACCCCTCCTGTAAGGTGACCGCCATGAAGTGCTTCCT<br>GCTGGAGCTGCAGGTGATCAGCCTGGAGTCCGGCGACGCCTCCATCCACGACACCGTGGAGA<br>ACCTAATCATCCTCGCGAACAACAGCCTGAGCTCGAACGGGAACGTGACGGAGAGCGGCTGC<br>AAAGAGTGTGAGGAGCTGGAGGAGAAGAACATCAAGGAGTTCCTGCAGTCCTTCGTCCACAT<br>CGTCCAGATGTTCATCAATACCTCC |
| 955 | IL15_Fc_RLI-CO02 | ATGGAGACGGACACCTTACTCCTCTGGGTCCTCCTCCTTTGGGTCCCGGGCTCCACCGGGGA<br>GCCCAAAAGCTGCGACAAGACGCACACCTGCCCGCCCTGTCCCGCCCCCGAACTCTTGGGCG<br>GCCCCAGCGTCTTCTTGTTTCCCCCCAAGCCCAAAGACACGCTCATGATCTCTCGGACCCCC<br>GAGGTTACCTGTGTAGTCGTCGCCGTCAGCCACGAGGACCCCGAGGTCAAGTTCAACTGGTA<br>CGTGGACGGGGTCGAGGTACACAACGCCAAGACCAAGCCACGGGAAGAACAGTACAACAGCA<br>CCTATCGGGTGGTGAGCGTCCTGACCGTGCTCCACCAAGACTGGCTGAACGGGAAGGAGTAC<br>AAGTGCAAGGTGTCCAACAAGGCCCTGCCGGCCCCGATCGAAAAGACCATTTCGAAGGCCAA<br>AGGCCAGCCCAGGGAACCCCAGGTGTACACCCTCCCACCCAGCCGCGACGAGCTCACGAAGA<br>ACCAAGTGAGCCTCACCTGCCTGGTGAAGGGCTTCTACCCGAGCGACATCGCTGTGGAGTGG<br>GAGAGCAACGGCCAGCCAGAGAACAACTATAAGACCACCCCTCCGGTGCTGGACAGCGACGG<br>CAGCTTCTTTCTCTATAGCAAGCTGACCGTGGACAAATCCCGGTGGCAGCAGGGCAACGTGT<br>TCTCCTGCAGCGTGATGCACGAGGCCCTGCATAATCATTACACCCAGAAAAGCCTGAGCCTG<br>AGCCCCGGCAAGATCACCTGCCCGCCCCCCATGAGCGTGGAACACGCCGACATCTGGGTGAA<br>GTCCTACTCCCTGTATAGCAGGGAGAGGTACATCTGCAACAGCGGCTTCAAGAGGAAGGCCG<br>GCACCAGCTCCCTGACCGAGTGTGTGCTCAACAAGGCCACAAATGTGGCCCATTGGACCACA<br>CCGTCCCTGAAGTGCATAAGAGATCCAGCCCTCGTGCACCAGAGGCCTGCCCCGCCCTCCGG<br>GGGAAGCGGGGGTGGGGGTAGCGGCGGCGGGAGCGGGGGCGGAGGCTCCCTCCAAAACTGGG<br>TTAACGTGATTAGCGACCTGAAGAAGATCGAGGACCTGATCCAGAGCATGCACATCGACGCC<br>ACCCTCTACACCGAGTCCGACGTGCACCCCAGCTGCAAGGTGACCGCCATGAAGTGTTTCCT<br>CCTGGAGCTGCAGGTAATCTCCCTGGAGAGCGGGGACGCCAGCATCCATGATACGGTGGAAA<br>ACCTGATCATCCTGGCGAACAACTCCCTGAGCAGCAATGGCAACGTCACCGAGAGCGGATGC<br>AAGGAGTGCGAGGAGCTGGAGGAAAAGAATATCAAGGAGTTCCTGCAGTCCTTCGTCCACAT<br>CGTGCAGATGTTCATCAACACCTCG |
| 956 | IL15_Fc_RLI-CO03 | ATGGAGACAGACACCCTCCTCCTCTGGGTCCTCCTCCTCTGGGTCCCCGGGAGCACCGGGGA<br>ACCCAAGAGCTGCGACAAAACCCACACCTGCCCCCCGTGCCCCGCCCCGGAACTCCTCGGCG<br>GGCCCAGCGTCTTTCTCTTCCCTCCCAAGCCCAAAGACACGCTCATGATCTCCAGGACCCCC<br>GAGGTAACCTGCGTAGTCGTCGCCGTTAGTCACGAGGACCCGGAGGTCAAGTTCAACTGGTA<br>CGTCGACGGCGTCGAAGTCCACAACGCGAAGACCAAGCCCCGGGAGGAACAGTACAACAGCA<br>CCTACAGGGTGGTGAGCGTGCTCACCGTCCTGCATCAGGACTGGCTCAACGGCAAGGAGTAC<br>AAGTGTAAGGTCAGCAACAAGGCACTGCCCGCCCCCATCGAGAAAACCATCAGCAAGGCCAA<br>GGGCCAGCCCCGCGAGCCCCAGGTGTACACCCTGCCCCCGAGCCGGGACGAGCTCACCAAGA<br>ACCAGGTGAGCCTGACCTGTCTGGTGAAAGGCTTCTACCCCTCAGACATAGCCGTGGAGTGG<br>GAGAGCAATGGGCAGCCGGAGAACAACTATAAGACCACCCCTCCCGTGCTAGACTCGGACGG<br>GAGTTTCTTTCTGTACTCCAAGCTGACCGTAGACAAGAGCAGGTGGCAGCAGGGGAACGTGT<br>TCAGCTGCTCCGTGATGCACGAGGCCCTGCACAATCACTACACTCAGAAAAGCCTGTCCCTG<br>AGCCCCGGCAAAATCACCTGCCCCCCGCCCATGAGCGTCGAGCACGCCGACATCTGGGTGAA<br>AAGCTACTCGCTGTACAGCCGGGAGCGGTACATCTGCAACTCGGGCTTCAAACGGAAGGCCG<br>GCACCAGCTCTCTGACCGAGTGTGTTCTCAATAAGGCCACCAACGTGGCACACTGGACCACC<br>CCCTCCCTAAAGTGCATTAGGGACCCCGCCCTGGTGCATCAGAGGCCCGCCCCTCCAAGCGG<br>GGGGAGCGGCGGTGGCGGCTCGGGGGGAGGCAGCGGGGGCGGGGGTTCCCTGCAGAACTGGG<br>TGAACGTGATCTCCGACCTGAAGAAGATCGAAGATCTGATCCAGTCGATGCACATCGACGCC<br>ACACTGTATACCGAGAGCGACGTCCACCCCAGTTGCAAGGTGACCGCGATGAAGTGTTTCCT<br>GCTGGAGCTCCAGGTGATCAGCCTGGAGAGCGGGGACGCCAGCATCCACGACACGGTGGAGA<br>ACCTGATCATCCTGGCCAACAATAGCCTCAGCAGCAATGGCAACGTGACCGAAAGCGGGTGC<br>AAGGAGTGCGAGGAGCTGGAGGAGAAGAACATCAAGGAATTCCTGCAAAGCTTCGTCCACAT<br>CGTCCAGATGTTTATCAACACCAGT |
| 957 | IL15_Fc_RLI-CO04 | ATGGAGACTGATACGCTACTCCTCTGGGTCCTCCTCCTCTGGGTCCCCGGGAGCACCGGGGA<br>GCCGAAGTCCTGCGACAAGACCCACACGTGCCCACCCTGCCCCGCCCCCGAACTCCTCGGGG<br>GCCCCTCCGTCTTCCTCTTTCCCCCTAAGCCCAAGGACACCTTGATGATCAGCAGAACGCCC<br>GAGGTCACCTGTGTAGTCGTCGCCGTCAGCCACGAGGACCCGGAGGTCAAATTCAACTGGTA<br>CGTGGACGGCGTCGAGGTTCACAACGCCAAGACCAAGCCCCGGGAGGAGCAGTACAATAGCA<br>CCTACAGGGTGGTGAGCGTGCTGACGGTGCTACACCAGGACTGGCTGAACGGGAAAGAGTAT<br>AAGTGCAAGGTGAGCAACAAGGCCCTGCCCGCCCCGATCGAGAAGACCATCAGCAAGGCCAA<br>GGGCCAGCCCAGGGAGCCCCAGGTCTACACCCTGCCCCCCAGCAGGGATGAGCTGACGAAGA<br>ACCAGGTCAGCCTGACTTGCCTGGTCAAGGGCTTCTACCCCAGCGATATCGCCGTGGAGTGG<br>GAAAGCAACGGCCAGCCCGAGAATAACTACAAGACCACCCCGCCCGTGCTGGATTCCGACGG<br>CAGCTTTTTCCTGTACTCCAAGCTGACCGTCGACAAAAGCAGGTGGCAGCAGGGCAACGTGT<br>TCAGCTGTAGCGTTATGCACGAGGCCCTGCACAACCACTACACCCAGAAAAGCCTCAGCCTG<br>TCCCCCGGCAAGATCACCTGCCCCCCGCCGATGAGCGTGGAGCACGCCGACATCTGGGTCAA<br>GAGCTACAGCCTGTACAGCAGGGAGAGGTACATCTGCAACAGCGGCTTCAAGAGGAAGGCGG<br>GCACCAGCAGCCTGACGGAGTGCGTGCTTAACAAGGCCACGAACGTCGCCCATTGGACCACC<br>CCGAGCCTTAAGTGTATCAGGGATCCGGCCCTGGTCCACCAGAGGCCCGCCCCGCCCTCCGG<br>AGGCAGCGGAGGCGGCGGAAGCGGTGGCGGAAGCGGGGGCGGTGGCAGCCTACAGAACTGGG<br>TGAACGTGATCTCAGATCTGAAAAAGATCGAGGACCTGATCCAGTCCATGCACATCGATGCA<br>ACCCTGTATACCGAGAGCGACGTGCACCCCAGCTGCAAGGTGACCGCCATGAAATGTTTCCT |

TABLE 11-continued

Additional sequence optimized nucleic acid encoding IL15 polypeptides

| SEQ ID NO | Name | Sequence |
|---|---|---|
| | | GCTGGAGCTGCAGGTGATCAGCCTGGAAAGCGGGGACGCCTCCATCCACGACACCGTGGAGA ACCTGATCATCCTCGCCAACAACAGCCTGAGCAGCAACGGCAACGTGACCGAGAGCGGGTGC AAAGAGTGTGAGGAGCTGGAGGAGAAGAACATAAAGGAGTTCCTGCAGAGCTTCGTGCACAT CGTCCAGATGTTCATCAACACCTCC |
| 958 | IL15_Fc_RLI-CO05 | ATGGAGACGGACACCCTACTCCTATGGGTCCTTCTCCTCTGGGTCCCGGGCAGCACCGGCGA GCCCAAGAGCTGCGACAAGACGCACACCTGCCCGCCGTGCCCCGCCCCCGAGCTCCTCGGGG GCCCCAGCGTATTCCTCTTCCCCCCAAAGCCCAAGGACACCCTCATGATCAGCCGGACCCCC GAGGTCACCTGCGTCGTCGTAGCCGTCTCCCACGAGGACCCCGAGGTCAAGTTTAACTGGTA CGTTGACGGCGTCGAGGTCCACAACGCGAAGACCAAGCCCCGGGAGGAGCAATACAACTCCA CATACCGCGTGGTGAGCGTGTTGACCGTGCTCCACCAGGACTGGCTCAATGGCAAAGAGTAC AAATGCAAGGTGAGCAACAAGGCCCTGCCGGCCCCAATCGAGAAGACCATCAGCAAGGCGAA AGGGCAACCCAGGGAGCCCCAGGTGTATACGCTCCCACCCAGCAGGGACGAGCTCACCAAGA ACCAGGTGAGCCTGACGTGCCTCGTGAAGGGCTTTTACCCGAGCGACATCGCCGTCGAGTGG GAGAGCAACGGGCAACCCGAGAACAACTACAAAACCACCCCTCCCGTGCTGGACAGCGACGG CAGCTTCTTTCTGTACAGCAAGCTGACCGTGGACAAGAGCCGGTGGCAGCAGGGGAACGTTT TTAGCTGCTCCGTCATGCACGAGGCCCTGCACAACCATTACACCCAGAAAAGCCTGAGCCTT AGCCCCGGGAAGATCACGTGCCCGCCCCCAATGAGCGTGGAGCACGCCGACATATGGGTCAA GTCGTACAGCCTGTACAGCCGGGAGAGGTACATATGCAACTCCGGCTTCAAGCGGAAAGCGG GCACCTCCAGCCTGACCGAGTGCGTGCTGAACAAGGCCACTAATGTGGCCCATTGGACCACC CCCTCCCTGAAATGTATCAGAGATCCGGCCCTGGTCCACCAGAGGCCCGCCCCACCCAGCGG CGGCAGCGGTGGCGGCGGCAGTGGAGGCGGCTCAGGGGGCGGGGGCAGCCTGCAGAACTGGG TGAACGTGATCTCCGACCTGAAGAAGATCGAGGACCTGATCCAGTCCATGCACATCGATGCC ACACTGTACACGGAAAGCGATGTGCACCCCAGCTGCAAGGTGACCGCCATGAAGTGCTTCCT GCTGGAGCTCCAGGTCATCTCCCTGGAATCAGGGGACGCCAGCATCCACGACACCGTGGAAA ACCTGATCATCCTGGCCAACAATAGCCTGAGCAGCAACGGGAACGTAACCGAGAGCGGCTGC AAGGAGTGCGAGGAGCTGGAGGAGAAGAACATAAAGGAGTTCCTCCAGAGCTTCGTGCACAT CGTGCAGATGTTTATCAACACCAGC |
| 959 | IL15_Fc_RLI-CO06 | ATGGAGACAGATACCCTGCTCCTCTGGGTTCTCCTCTTGTGGGTCCCCGGCAGCACCGGAGA GCCCAAGAGCTGTGACAAGACACACACCTGCCCGCCCTGCCCCGCCCCCGAGCTCTTGGGCG GGCCCTCCGTGTTCTTGTTCCCGCCCAAGCCTAAGGACACCCTCATGATATCGAGGACCCCG GAGGTTACCTGCGTCGTCGTAGCGGTGTCCCACGAAGACCCCGAGGTCAAATTTAACTGGTA CGTGGACGGCGTCGAGGTACATAACGCGAAGACCAAGCCCCGGGAGGAGCAATACAACTCCA CCTACAGGGTCGTGAGTGTCCTGACCGTACTGCACCAGGACTGGCTCAACGGGAAGGAGTAC AAGTGCAAGGTGAGCAATAAGGCCCTGCCCGCCCCGATCGAGAAAACCATCAGCAAGGCCAA GGGCCAGCCGAGGGAGCCCCAGGTGTACACCCTCCCGCCCTCACGCGACGAGCTGACCAAGA ACCAGGTGTCGCTGACCTGCCTGGTCAAGGGTTTCTACCCGAGCGACATCGCCGTGGAGTGG GAGAGCAACGGCCAGCCGGAAAACAACTACAAGACGACACCACCCGTCCTGGACAGCGACGG GAGCTTCTTTCTGTATTCTAAGCTCACCGTGGACAAGAGCCGGTGGCAGCAGGGCAACGTGT TCTCCTGCTCCGTCATGCACGAAGCCCTGCACAACCACTACACCCAGAAAAGCCTGAGCCTC TCCCCCGGCAAGATCACGTGCCCCCCGCCCATGAGCGTGGAGCACGCGGACATTTGGGTCAA GAGCTACAGCCTGTACAGCCGGGAACGCTACATCTGTAACTCGGGCTTCAAGAGGAAGGCCG GCACCAGCTCACTGACCGAGTGCGTGCTGAACAAGGCCACCAACGTGGCCCACTGGACCACC CCCTCCCTCAAGTGTATCCGCGACCCCGCCCTGGTGCACCAAAGGCCCGCCCCACCTAGTGG CGGGAGCGGCGGCGGTGGATCAGGCGGCGGCTCCGGGGGAGGGGGTAGCCTGCAAAACTGGG TGAATGTAATCAGCGACCTCAAGAAGATCGAAGACCTGATCCAGAGCATGCACATCGACGCG ACCCTGTACACGGAAAGCGACGTGCACCCCAGCTGCAAGGTGACCGCCATGAAGTGCTTCCT GCTGGAGCTGCAGGTGATCAGCCTGGAGAGCGGGGATGCCAGCATCCACGACACCGTGGAAA ACCTCATCATCCTGGCCAATAACTCCCTGAGCAGCAACGGGAACGTGACCGAGTCCGGCTGC AAGGAGTGCGAGGAACTCGAAGAGAAAAACATCAAGGAATTCCTGCAGTCGTTCGTGCATAT CGTGCAGATGTTCATCAACACCAGC |
| 960 | IL15_Fc_RLI-CO07 | ATGGAGACGGACACGCTCCTCCTCTGGGTCTTGCTCCTCTGGGTCCCCGGCAGCACGGGCGA GCCCAAGTCCTGCGACAAGACCCACACCTGCCCGCCCTGCCCGGCCCCCGAGCTACTCGGGG GCCCCAGCGTATTCCTCTTCCCACCCAAGCCTAAGGACACGCTCATGATCTCGCGGACCCCG GAGGTCACGTGCGTCGTCGTCGCCGTCTCCCACGAGGACCCCGAGGTCAAATTTAACTGGTA CGTCGACGGCGTCGAGGTCCACAACGCCAAGACCAAGCCCCGGGAAGAACAGTACAATTCGA CGTACCGCGTGGTGTCCGTGCTGACCGTCCTGCACCAGGACTGGCTCAATGGGAAGGAGTAC AAGTGCAAAGTCAGCAACAAGGCCCTGCCTGCCCCCATCGAAAAGACCATCAGCAAGGCAAA GGGCCAACCAAGGGAGCCCCAGGTGTACACACTGCCCCCCAGCAGGGACGAGCTGACAAAGA ATCAGGTGAGCCTGACCTGCCTGGTCAAGGGGTTTTACCCCAGCGACATAGCCGTGGAGTGG GAGTCCAACGGGCAGCCCGAGAATAATTACAAGACCACCCCGCCCGTGCTGGACAGCGACGG GAGCTTCTTCCTGTACTCCAAGCTGACCGTGGACAAAAGCAGGTGGCAGCAGGGCAACGTCT TTAGCTGCTCCGTGATGCACGAGGCCCTGCACAACCATTACACCCAGAAGTCCCTCAGCCTG AGCCCCGGCAAGATCACCTGCCCGCCCCCCATGTCCGTGGAGCACGCCGACATATGGGTGAA ATCGTACAGCCTGTACTCACGGGAGCGGTACATCTGCAACAGCGGATTCAAGAGAAAGGCCG GCACCAGCAGCCTGACCGAGTGCGTGCTGAACAAGGCCACCAACGTGGCCCACTGGACCACG CCCTCCCTCAAGTGTATACGGGATCCCGCACTCGTGCATCAAAGGCCCGCCCCACCCTCCGG AGGCTCCGGGGGAGGAGGAAGCGGGGGCGGGTCCGGCGGCGGGGGAAGCCTGCAGAACTGGG TGAACGTGATCAGCGACCTCAAGAAGATCGAGGACCTGATACAGTCCATGCACATCGACGCC ACCCTCTACACCGAGAGCGACGTCCACCCCTCGTGCAAGGTGACCGCCATGAAGTGCTTCCT GCTGGAGCTCCAGGTGATAAGCCTGGAGTCCGGCGATGCATCGATCCACGACACCGTGGAGA ACCTAATCATCCTCGCAAACAACAGCCTCTCCTCGAACGGCAACGTTACCGAGAGCGGTTGC |

TABLE 11-continued

Additional sequence optimized nucleic acid encoding IL15 polypeptides

| SEQ ID NO | Name | Sequence |
|---|---|---|
| | | AAGGAATGCGAGGAGCTGGAGGAAAAGAATATCAAGGAGTTCCTGCAGAGCTTCGTCCACAT<br>CGTCCAGATGTTCATCAACACCTCC |
| 961 | IL15_Fc_RLI-CO08 | ATGGAGACGGACACCCTCCTCCTCTGGGTCCTCCTCCTCTGGGTCCCCGGTAGCACCGGGGA<br>GCCCAAGTCCTGCGACAAGACCCACACGTGTCCCCCCTGCCCCGCCCCGGAGTTGCTCGGCG<br>GGCCGAGCGTCTTCCTCTTTCCCCCCAAGCCCAAAGACACCTTAATGATCAGCCGGACCCCC<br>GAGGTTACGTGTGTCGTCGTCGCGGTGTCCCACGAAGACCCCGAGGTCAAATTTAACTGGTA<br>CGTGGACGGGGTCGAGGTTCACAACGCCAAGACCAAGCCCCGGGAGGAGCAGTACAACTCCA<br>CCTACCGCGTGGTGTCCGTGCTGACCGTGCTGCACCAGGACTGGCTGAATGGGAAGGAGTAT<br>AAGTGCAAGGTGTCCAACAAGGCCCTGCCCGCCCCGATCGAAAAGACGATCTCCAAGGCCAA<br>GGGCCAGCCCAGGGAGCCTCAGGTGTACACCCTGCCCCCCTCCCGGGATGAGCTGACCAAAA<br>ATCAAGTGTCCCTGACCTGCCTGGTGAAGGGATTCTATCCCAGCGACATCGCGGTCGAGTGG<br>GAGAGCAACGGGCAGCCCGAGAACAACTACAAGACGACCCCTCCCGTGCTGGATAGCGACGG<br>GAGCTTCTTCCTGTACAGCAAGCTGACCGTGGACAAGAGCAGGTGGCAGCAGGGCAACGTTT<br>TTAGCTGCAGCGTGATGCACGAGGCCCTGCACAACCACTACACACAGAAAAGCCTCAGCCTG<br>TCCCCCGGGAAAATCACCTGCCCACCCCCCATGTCCGTGGAGCACGCCGACATCTGGGTGAA<br>AAGCTACAGCCTCTACTCCCGGGAGCGCTACATCTGCAATTCCGGCTTCAAGAGGAAGGCCG<br>GCACCTCCAGCCTCACCGAATGCGTGCTGAACAAGGCCACCAACGTGGCGCATTGGACCACA<br>CCCAGCCTGAAGTGTATCCGAGATCCGGCCCTGGTACACCAGCGTCCCGCACCCCCGAGCGG<br>GGGCTCCGGCGGCGGCGGGAGCGGGGGCGGTAGTGGGGGAGGCGGTAGCCTCCAGAATTGGG<br>TGAACGTGATCTCCGATCTGAAGAAGATCGAGGACCTGATCCAGTCCATGCATATAGATGCG<br>ACCCTGTACACGGAATCCGACGTGCACCCCAGCTGTAAGGTGACCGCCATGAAGTGCTTTCT<br>CCTGGAACTCCAGGTGATCAGCCTGGAGAGCGGCGACGCCTCAATCCACGACACGGTGGAGA<br>ACCTCATCATCCTGGCGAACAATTCGCTCAGCTCCAACGGCAACGTGACCGAGAGCGGGTGC<br>AAGGAATGCGAGGAGCTGGAGGAGAAGAACATCAAAGAGTTCCTGCAGTCCTTTGTGCATAT<br>CGTGCAGATGTTCATCAACACCTCC |
| 962 | IL15_Fc_RLI-CO09 | ATGGAGACAGACACGCTCCTCCTGTGGGTACTCCTCCTCTGGGTCCCCGGAAGCACGGGGGA<br>ACCAAAGAGCTGCGACAAGACCCACACCTGCCCCCCGTGCCCCGCCCCCGAGCTACTCGGCG<br>GGCCGTCCGTCTTCCTCTTCCCGCCCAAGCCCAAAGACACGCTCATGATCAGCAGGACCCCG<br>GAGGTAACCTGCGTAGTCGTCGCCGTTAGCCACGAAGACCCGGAGGTCAAGTTCAACTGGTA<br>CGTCGACGGGGTCGAGGTCCACAACGCCAAGACCAAGCCCCGCGAGGAGCAGTACAACAGCA<br>CGTACAGGGTCGTCTCCGTGCTGACCGTGCTGCATCAGGACTGGCTCAACGGCAAGGAGTAT<br>AAGTGCAAGGTGAGCAACAAGGCCCTGCCCGCCCCCATCGAGAAGACCATCAGCAAGGCTAA<br>GGGCCAGCCCAGGGAGCCCCAGGTGTACACCCTGCCCCCCAGCAGGGACGAACTCACCAAGA<br>ACCAGGTGAGCCTGACCTGCCTGGTAAAGGGCTTCTACCCCAGCGATATCGCGGTGGAGTGG<br>GAGAGCAATGGCCAGCCCGAAAACAACTACAAGACGACCCCGCCGGTCCTGGACAGCGACGG<br>CAGCTTCTTCCTGTATTCCAAGCTCACCGTGGACAAATCCAGGTGGCAGCAGGGCAATGTGT<br>TCAGCTGCAGCGTGATGCACGAGGCCCTGCACAACCACTACACCCAGAAGTCCCTGAGCCTG<br>TCCCCCGGGAAGATCACCTGCCCGCCCCCCATGAGCGTGGAGCACGCGGATATCTGGGTGAA<br>GTCCTACAGCCTGTACAGTCGAGAACGGTACATCTGCAACAGCGGCTTTAAGCGGAAGGCCG<br>GCACCAGCAGCCTCACCGAGTGCGTGTTGAACAAGGCCACCAACGTCGCCCACTGGACAACC<br>CCCAGCCTGAAATGTATCCGAGATCCCGCGCTAGTCCACCAACGACCCGCCCCTCCCTCCGG<br>CGGGAGCGGCGGCGGTGGGTCGGGCGGCGGCAGCGGGGGTGGCGGCAGCCTCCAGAACTGGG<br>TGAACGTGATCAGCGATCTGAAAAAGATCGAGGACCTGATCCAGTCGATGCACATCGACGCG<br>ACCCTCTACACAGAGTCCGACGTCCATCCCAGCTGCAAGGTGACCGCCATGAAATGCTTCCT<br>GCTGGAGCTCCAGGTGATCAGCCTGGAAAGCGGGGACGCCTCCATACACGACACCGTGGAGA<br>ACCTGATCATCCTGGCCAACAACAGCCTCAGCAGCAATGGGAACGTGACCGAATCTGGCTGC<br>AAGGAGTGCGAGGAGCTGGAGGAGAAGAACATCAAGGAGTTTCTCCAATCCTTCGTGCACAT<br>CGTCCAGATGTTCATCAACACCAGC |
| 963 | IL15_Fc_RLI-CO10 | ATGGAGACTGACACCCTCCTCCTATGGGTCCTACTACTCTGGGTCCCGGGCAGCACCGGCGA<br>GCCAAAGTCCTGCGACAAGACCCATACCTGCCCGCCCTGCCCCGCCCCGGAGCTCCTCGGCG<br>GCCCGAGCGTCTTCCTCTTCCCTCCCAAGCCCAAGGACACCCTCATGATCAGCCGGACCCCC<br>GAGGTAACCTGTGTCGTCGTCGCCGTCAGCCACGAGGACCCAGAGGTAAAATTCAATTGGTA<br>CGTCGACGGCGTCGAGGTCCACAACGCCAAGACCAAGCCGCGCGAGGAGCAGTACAACAGCA<br>CGTACAGGGTGGTCAGCGTGCTGACCGTGCTGCATCAGGACTGGCTCAACGGCAAGGAGTAT<br>AAGTGCAAGGTAAGCAACAAGGCCCTGCCCGCCCCCATCGAGAAGACCATCTCTAAGGCCAA<br>AGGACAGCCCCGAGAGCCCCAGGTGTATACCCTGCCACCCAGCCGGGACGAGCTCACCAAAA<br>ACCAGGTGAGCCTGACCTGCCTGGTGAAGGGCTTTTACCCGAGCGACATCGCCGTGGAGTGG<br>GAGAGCAACGGCCAACCGGAGAACAACTACAAGACGACACCCCCCGTGCTGGACTCCGACGG<br>CAGCTTCTTTCTGTACTCGAAGCTCACCGTGGACAAGAGCCGATGGCAGCAGGGGAATGTGT<br>TCTCCTGCAGCGTCATGCATGAGGCGCTGCACAACCACTACACCCAGAAAAGCCTGAGCCTT<br>TCACCCGGCAAGATCACCTGCCCCCCTCCGATGAGCGTGGAACACGCGGACATCTGGGTGAA<br>AAGCTACTCCCTGTACAGCAGGGAGCGGTACATCTGCAACAGCGGCTTCAAGCGGAAAGCCG<br>GCACCAGCTCCCTGACCGAGTGCGTCCTGAATAAGGCCACGAACGTGGCGCACTGGACAACC<br>CCCAGCCTGAAGTGCATCAGGGATCCCGCCCTGGTGCACCAAAGGCCCGCCCCGCCGAGCGG<br>GGGCTCCGGCGGGGGTGGCAGCGGTGGCGGTTCGGGAGGGGGAGGAAGCCTGCAAAACTGGG<br>TGAACGTGATCTCCGACCTGAAGAAGATCGAGGACCTGATCCAGAGCATGCACATCGACGCG<br>ACCCTGTATACCGAGTCCGACGTGCACCCCTCCTGTAAGGTCACCGCGATGAAGTGCTTCCT<br>CCTGGAACTGCAGGTTATCAGCCTGGAGTCCGGAGACGCCTCCATTCACGACACTGTGGAGA<br>ACCTGATCATCCTGGCGAACAACAGCCTGAGCTCCAACGGAAATGTGACCGAGAGCGGGTGC<br>AAAGAGTGCGAGGAGCTGGAAGAGAAGAACATTAAGGAGTTCCTACAGAGCTTCGTGCACAT<br>CGTGCAGATGTTCATAAACACCAGC |

TABLE 11-continued

Additional sequence optimized nucleic acid encoding IL15 polypeptides

| SEQ ID NO | Name | Sequence |
| --- | --- | --- |
| 964 | IL15_Fc_RLI-CO11 | ATGGAGACTGACACACTCCTCTTGTGGGTCCTCCTCCTGTGGGTACCCGGGAGCACCGGAGA<br>GCCCAAGAGCTGCGACAAGACGCATACCTGTCCGCCCTGCCCCGCCCCCGAGCTTCTCGGGG<br>GACCCAGCGTATTCCTCTTCCCCCCGAAGCCGAAAGATACCTTAATGATCTCCAGGACGCCC<br>GAGGTAACCTGCGTCGTCGTCGCGGTCAGCCACGAGGACCCGGAGGTCAAGTTCAACTGGTA<br>CGTTGACGGGGTCGAGGTCCACAACGCCAAGACGAAGCCCCGGGAGGAGCAATACAACAGTA<br>CCTACAGGGTGGTGAGCGTGCTGACGGTGCTGCACCAAGACTGGCTGAACGGCAAAGAGTAT<br>AAATGCAAAGTGAGCAACAAAGCGCTGCCGGCCCCCATCGAAAAGACCATCTCCAAGGCCAA<br>AGGCCAGCCCCGGGAGCCGCAGGTGTACACCCTCCCGCCCAGCCGGGACGAGCTGACCAAGA<br>ATCAGGTCAGCCTCACCTGCCTGGTGAAGGGATTCTACCCCAGCGACATCGCTGTGGAGTGG<br>GAGTCCAACGGCCAGCCCGAGAATAACTACAAGACCACTCCCCCCGTGCTGGACAGCGACGG<br>CTCCTTCTTCCTGTATAGCAAACTGACGGTGGACAAATCCCGGTGGCAGCAAGGCAACGTGT<br>TCAGCTGCAGCGTGATGCACGAAGCGCTGCACAACCATTACACCCAGAAGTCCCTGTCGCTG<br>AGCCCCGGCAAGATCACCTGCCCGCCCCCCATGAGCGTGGAGCACGCCGACATCTGGGTGAA<br>AAGCTATAGCCTCTACAGCCGGGAACGCTACATTTGTAACTCCGGGTTCAAGAGGAAGGCCG<br>GAACCAGCTCCCTGACCGAGTGCGTCCTGAACAAAGCCACCAATGTGGCCCATTGGACCACC<br>CCCTCCCTGAAGTGTATCAGGGATCCCGCGCTGGTGCACCAAAGGCCCGCTCCCCCGAGCGG<br>AGGCAGCGGGGGTGGGGGCTCAGGGGGAGGGAGCGGCGGCGGCGGTTCCCTGCAGAACTGGG<br>TCAATGTCATCTCCGATCTCAAAAAGATCGAGGACCTGATCCAGAGCATGCACATCGACGCC<br>ACCTTGTATACAGAGTCCGACGTGCATCCCAGCTGCAAGGTGACCGCCATGAAATGCTTCCT<br>GCTGGAACTGCAGGTGATCAGCCTGGAGAGCGGCGACGCATCCATCCACGACACCGTGGAGA<br>ACCTGATCATCCTGGCGAATAACAGCCTGAGCTCCAATGGCAACGTGACCGAGAGCGGGTGC<br>AAGGAGTGTGAGGAGCTGGAGGAGAAGAATATCAAGGAGTTCCTGCAGAGCTTCGTGCACAT<br>CGTCCAAATGTTCATCAACACCAGC |
| 965 | IL15_Fc_RLI-CO12 | ATGGAGACGGACACCCTTCTCCTCTGGGTCCTCCTTCTCTGGGTCCCCGGAAGCACCGGGGA<br>GCCGAAAAGCTGCGACAAGACCCACACCTGCCCGCCCTGCCCCGCGCCCGAGCTCCTCGGCG<br>GGCCATCCGTCTTCCTATTCCCGCCCAAGCCCAAGGACACTTTGATGATAAGCAGGACCCCG<br>GAGGTCACGTGCGTCGTAGTAGCGGTCAGCCACGAAGACCCCGAGGTCAAGTTCAACTGGTA<br>CGTCGACGGCGTCGAAGTCCACAACGCCAAGACCAAACCACGCGAGGAGCAATACAACTCGA<br>CCTACAGGGTGGTGAGCGTGCTGACGGTCCTGCATCAGGACTGGCTGAACGGCAAGGAGTAT<br>AAATGTAAGGTGAGCAACAAGGCCCTGCCCGCCCCCATCGAGAAGACCATCAGCAAGGCCAA<br>GGGCCAACCGAGGGAGCCCCAGGTCTACACGCTGCCCCCCTCGCGGGACGAGCTGACCAAGA<br>ACCAGGTGAGCCTGACCTGCCTGGTGAAGGGCTTCTACCCCTCCGATATCGCCGTGGAGTGG<br>GAGAGCAACGGGCAGCCAGAGAACAACTACAAGACCACGCCCCCGGTGCTCGACAGCGACGG<br>CAGCTTCTTCCTGTATAGCAAGCTGACCGTGGACAAGAGCCGCTGGCAGCAGGGCAACGTGT<br>TTAGCTGCAGCGTGATGCACGAAGCCCTGCATAACCACTACACCCAGAAAAGCCTGTCACTG<br>AGCCCGGGAAAGATCACCTGCCCCCCACCCATGAGCGTGGAGCACGCCGACATCTGGGTGAA<br>GTCCTACTCCCTGTACAGCAGGGAGCGGTACATCTGCAACAGCGGGTTCAAGCGCAAGGCCG<br>GCACCAGCTCGCTGACCGAGTGCGTGCTGAACAAGGCCACAAACGTCGCCCACTGGACGACC<br>CCATCACTGAAGTGTATCAGGGATCCCGCCCTGGTGCACCAGAGGCCCGCCCCGCCTTCAGG<br>CGGCAGCGGGGGAGGAGGATCCGGCGGTGGGAGCGGCGGCGGGGGATCGCTGCAAAACTGGG<br>TGAACGTCATATCGGACCTGAAGAAGATCGAGGACCTCATCCAGAGCATGCACATCGACGCA<br>ACCCTGTACACAGAGAGTGACGTCCATCCCTCCTGCAAGGTCACCGCCATGAAGTGCTTCCT<br>GCTGGAGCTTCAGGTCATCAGCCTGGAATCCGGGGACGCCTCCATCCATGATACCGTGGAGA<br>ACCTGATCATCCTGGCCAACAACTCGCTCAGCAGCAACGGGAATGTCACCGAGAGCGGGTGC<br>AAGGAGTGCGAGGAGCTGGAGGAGAAAAACATCAAGGAATTCCTGCAAAGCTTCGTGCACAT<br>CGTGCAGATGTTTATCAACACCTCG |
| 966 | IL15_Fc_RLI-CO13 | ATGGAGACGGACACCCTTCTCCTCTGGGTCCTCCTTCTGTGGGTCCCCGGGAGCACCGGGGA<br>GCCAAAGAGCTGCGACAAGACCCACACCTGCCCGCCCTGCCCGGCCCCCGAGTTACTCGGCG<br>GCCCCAGCGTCTTCCTCTTCCCTCCCAAGCCCAAGGACACCCTCATGATCTCGAGGACCCCC<br>GAGGTCACCTGCGTTGTCGTCGCCGTCAGCCACGAGGATCCAGAGGTTAAGTTCAACTGGTA<br>CGTTGACGGCGTCGAGGTCCACAACGCCAAGACGAAGCCCCGCGAGGAGCAATATAACTCCA<br>CCTATCGGGTGGTGAGCGTGCTCACCGTGTTGCACCAGGACTGGCTGAACGGGAAGGAGTAC<br>AAATGTAAGGTGTCCAATAAGGCCCTGCCCGCCCCGATAGAAAAGACCATCTCCAAGGCCAA<br>GGGGCAGCCCAGGGAGCCCCAGGTATACACCCTCCCACCTAGCCGCGACGAGCTGACCAAGA<br>ACCAGGTGAGCCTGACGTGCCTGGTGAAGGGCTTTTACCCCAGCGATATTGCGGTGGAGTGG<br>GAAAGCAACGGCCAGCCGGAGAACAACTACAAGACCACACCCCCGGTGCTGGACTCGGACGG<br>CAGCTTCTTTCTGTATTCGAAGCTCACCGTGGACAAGTCCAGGTGGCAGCAGGGCAATGTGT<br>TCAGCTGCAGCGTGATGCATGAGGCCCTGCACAACCACTACACCCAGAAAAGCCTGAGCCTG<br>AGCCCCGGGAAGATAACCTGCCCTCCCCCCATGTCCGTGGAACACGCCGACATCTGGGTGAA<br>AAGCTACAGCCTGTATAGCCGCGAGCGTTACATCTGCAACAGCGGGTTCAAAAGGAAGGCAG<br>GCACCTCCAGCCTGACCGAATGTGTCCTGAACAAGGCCACCAACGTGGCACACTGGACCACA<br>CCGAGCCTGAAGTGCATAAGGGACCCAGCCCTGGTGCATCAGAGGCCGGCCCCACCCAGTGG<br>GGGCAGCGGCGGCGGCGGATCGGGCGGCGGCAGCGGTGGCGGAGGCTCCCTCCAGAATTGGG<br>TGAACGTGATAAGCGACCTCAAGAAGATCGAGGACCTGATCCAGAGCATGCACATCGATGCC<br>ACGCTCTACACGGAATCCGACGTGCACCCCTCGTGCAAAGTGACCGCCATGAAGTGCTTCCT<br>ACTGGAGCTCCAGGTGATCTCCCTCGAGTCCGGAGATGCCTCCATCCACGACACCGTGGAGA<br>ACCTGATCATCCTCGCCAACAACAGCCTGTCCAGCAACGGCAATGTTACCGAGAGCGGGTGC<br>AAGGAGTGTGAGGAGCTGGAGGAGAAGAACATCAAAGAGTTCCTCCAGAGCTTCGTGCACAT<br>CGTCCAAATGTTCATCAACACTTCC |
| 967 | IL15_Fc_RLI-CO14 | ATGGAGACAGACACGCTCCTCTTATGGGTCCTCCTCCTCTGGGTCCCCGGCAGCACCGGGGA<br>GCCCAAGAGCTGCGACAAGACCCACACCTGCCCGCCCTGCCCCGCCCCCGAGCTCCTCGGCG |

TABLE 11-continued

Additional sequence optimized nucleic acid encoding IL15 polypeptides

| SEQ ID NO | Name | Sequence |
|---|---|---|
| | | GTCCCAGCGTCTTCCTCTTCCCGCCCAAGCCGAAGGATACCTTAATGATCAGCCGGACCCCC GAGGTCACCTGTGTAGTCGTCGCCGTCAGCCACGAGGACCCCGAAGTCAAGTTCAACTGGTA CGTCGACGGCGTTGAGGTACACAACGCGAAGACCAAGCCCAGGGAGGAGCAGTACAACAGCA CCTACCGGGTGGTGAGCGTGCTGACCGTGCTCCACCAGGACTGGCTGAACGGCAAGGAGTAC AAGTGCAAGGTGTCCAACAAGGCCCTCCCCGCCCCGATCGAGAAGACCATCAGCAAGGCCAA GGGCCAACCCAGAGAGCCCCAGGTATACACCCTGCCCCCCAGCCGGGACGAGCTGACCAAGA ACCAGGTCAGCCTGACCTGCCTGGTGAAGGGCTTCTACCCCAGCGACATCGCCGTGGAGTGG GAGAGCAACGGCCAGCCCGAAAACAATTACAAGACCACCCCGCCCGTGCTGGACTCCGACGG CAGCTTCTTCCTCTACAGCAAGCTGACCGTGGACAAAAGCCGCTGGCAGCAGGGGAATGTGT TCAGCTGCTCGGTCATGCACGAAGCCCTCCACAACCACTACACCCAGAAAAGCCTGAGCCTG TCGCCTGGCAAGATCACCTGCCCGCCCCCCATGTCGGTCGAGCACGCCGACATCTGGGTCAA GAGCTATTCCCTGTATAGCAGGGAGCGGTACATTTGCAACTCAGGTTTCAAGAGGAAGGCCG GCACCAGCAGCCTCACCGAGTGTGTGCTGAACAAGGCCACCAACGTGGCTCACTGGACCACC CCCAGCCTGAAATGCATCCGTGATCCCGCACTGGTACACCAGAGGCCCGCCCCGCCCAGCGG CGGCTCGGGCGGAGGAGGGTCCGGGGGCGGCAGCGGTGGCGGTGGCTCGCTGCAGAACTGGG TGAATGTGATCAGCGACCTGAAAAAGATCGAGGATCTTATCCAAAGCATGCACATAGATGCC ACCCTGTACACCGAAAGCGACGTGCACCCCAGCTGCAAAGTGACCGCCATGAAGTGTTTCCT GCTCGAGCTGCAGGTCATCAGCCTGGAGAGCGGCGACGCCAGCATCCACGATACCGTGGAGA ACCTGATCATCCTGGCGAACAACAGCCTCAGCTCCAACGGAAATGTGACCGAGAGCGGCTGC AAGGAGTGCGAGGAGCTGGAGGAAAAGAACATCAAAGAGTTCCTGCAGAGCTTCGTGCATAT AGTGCAGATGTTCATTAACACCAGC |
| 968 | IL15_Fc_RLI-CO15 | ATGGAGACGGACACCCTCCTCTTATGGGTCCTCCTCCTCTGGGTCCCCGGGAGCACCGGCGA GCCCAAGTCCTGCGACAAGACCCACACCTGCCCGCCCTGCCCCGCCCCCGAGCTCTTAGGCG GCCCCTCGGTATTCCTCTTCCCGCCCAAGCCGAAGGACACACTTATGATATCGAGGACCCCG GAGGTCACCTGCGTAGTCGTCGCCGTATCCCACGAGGACCCGGAGGTCAAGTTCAACTGGTA CGTCGACGGCGTCGAGGTCCACAACGCGAAGACGAAACCGAGGGAGGAGCAGTATAACAGCA CTTACAGGGTGGTGTCCGTGCTGACCGTGCTGCACCAGGACTGGCTGAACGGGAAAGAGTAC AAGTGCAAGGTCAGCAACAAGGCCCTGCCCGCCCCCATTGAGAAGACCATCAGCAAGGCCAA GGGCCAGCCCAGGGAGCCCCAGGTGTACACCCTGCCCCCCTCCAGGGACGAGCTGACCAAGA ATCAGGTGTCCCTGACCTGCCTCGTGAAAGGCTTCTACCCCAGCGACATCGCGGTGGAGTGG GAGAGCAACGGCCAGCCGGAAAATAACTACAAGACCACCCCGCCCGTGCTGGACAGCGACGG AAGCTTCTTCCTCTACAGCAAGCTGACCGTGGACAAGAGCAGGTGGCAGCAGGGCAACGTCT TCAGCTGCTCCGTGATGCACGAGGCCCTGCACAACCACTACACCCAGAAAAGCCTCAGCCTG AGCCCCGGGAAGATCACCTGTCCCCCACCCATGTCCGTGGAGCACGCCGACATTTGGGTGAA AAGCTACAGCCTGTACTCCCGGGAGCGCTACATTTGCAACAGCGGCTTCAAAAGGAAGGCCG GCACCTCCTCCCTGACGGAGTGCGTCCTGAACAAGGCCACGAACGTGGCCCACTGGACAACT CCTAGCCTGAAGTGCATCAGGGATCCCGCACTGGTGCACCAGAGGCCCGCCCCACCCTCCGG GGGCTCCGGAGGAGGCGGAAGCGGGGGAGGCTCGGGCGGCGGAGGCAGCCTGCAGAACTGGG TCAACGTCATCAGCGACCTCAAGAAGATCGAGGACCTGATCCAGTCCATGCACATCGACGCC ACCCTATACACCGAGAGTGATGTGCACCCCAGCTGCAAGGTCACAGCGATGAAGTGCTTCCT GCTCGAGCTCCAGGTGATCAGCCTGGAAAGCGGCGACGCCTCCATCCACGACACCGTGGAGA ATCTGATCATCCTGGCCAACAACAGCCTGAGCAGCAACGGCAACGTGACCGAGTCGGGTTGC AAGGAGTGCGAGGAACTGGAGGAGAAGAATATAAAGGAGTTCCTGCAGAGCTTCGTCCATAT CGTGCAGATGTTCATCAACACCTCC |
| 969 | IL15_Fc_RLI-CO16 | ATGGAGACTGACACGCTCCTCCTCTGGGTCCTCCTCCTCTGGGTCCCGGGCAGCACCGGCGA GCCAAAGTCCTGCGACAAGACCCACACCTGCCCCCCGTGTCCGGCGCCAGAGCTCCTTGGGG GGCCCTCCGTCTTCCTTTTCCCGCCCAAGCCCAAGGACACCCTCATGATCAGCCGCACACCG GAGGTCACGTGTGTAGTCGTCGCCGTCTCCCACGAGGACCCGGAGGTTAAATTTAACTGGTA CGTGGACGGCGTTGAGGTCCACAACGCCAAGACCAAACCCAGGGAGGAGCAGTACAACAGTA CCTACCGGGTGGTCAGCGTGCTGACCGTGCTGCATCAGGACTGGCTGAACGGTAAGGAGTAC AAGTGTAAAGTGAGCAACAAGGCCCTTCCAGCCCCCATCGAAAAGACCATCAGCAAGGCCAA GGGTCAGCCGCGGGAGCCCCAGGTGTACACCCTGCCCCCCTCCAGGGATGAGCTGACCAAGA ACCAAGTGTCCCTGACCTGTCTGGTGAAGGGCTTCTACCCGTCCGACATCGCGGTAGAGTGG GAGTCCAACGGGCAGCCGGAGAACAACTACAAAACCACCCCACCCGTGCTGGACAGCGACGG GAGCTTCTTCCTGTACTCAAAGCTGACGGTCGACAAGTCCAGGTGGCAGCAGGGCAATGTGT TCAGCTGCAGCGTAATGCACGAGGCCCTGCACAACCATTACACTCAAAAGAGCCTCAGCCTG AGCCCAGGCAAGATCACATGTCCCCCGCCCATGAGCGTGGAGCACGCCGACATCTGGGTGAA GTCCTATAGCCTTTACTCCAGGGAAAGGTACATCTGTAACAGCGGCTTCAAGCGGAAGGCGG GGACCAGCAGCCTGACCGAATGCGTCCTGAACAAGGCCACCAATGTCGCCCACTGGACTACC CCCAGCCTGAAGTGTATCCGGGATCCCGCCCTGGTGCATCAGCGACCCGCCCCGCCCTCCGG CGGTTCCGGGGGTGGCGGAAGCGGCGGAGGCTCCGGCGGTGGCGGATCCCTGCAGAACTGGG TGAACGTGATCTCCGATCTGAAGAAGATCGAGGACCTGATCCAAAGCATGCACATCGACGCC ACGCTCTACACAGAGAGCGACGTGCACCCCAGCTGCAAGGTCACCGCGATGAAATGCTTCCT CCTGGAGCTGCAGGTGATCAGCCTGGAATCGGGGGACGCCAGCATCCACGACACCGTGGAGA ACCTCATCATCCTCGCCAACAATAGCCTGAGCAGCAACGGCAACGTGACCGAATCCGGCTGC AAGGAATGTGAGGAGCTGGAGGAGAAGAACATCAAAGAGTTCCTGCAGAGCTTCGTCCATAT CGTGCAGATGTTCATCAACACCAGC |
| 970 | IL15_Fc_RLI-CO17 | ATGGAGACAGACACCTTGCTCCTCTGGGTCCTCCTCCTCTGGGTTCCGGGCAGCACGGGCGA GCCCAAGAGCTGCGACAAAACCCATACGTGCCCTCCCTGCCCCGCCCCCGAGTTGCTCGGGG GGCCCTCCGTATTCCTTTTCCCACCCAAGCAAAGGACACCCTAATGATCAGCCGGACCCCC GAAGTCACCTGCGTCGTTGTTGCCGTCTCCCACGAAGACCCCGAGGTCAAGTTCAACTGGTA |

TABLE 11-continued

Additional sequence optimized nucleic acid encoding IL15 polypeptides

| SEQ ID NO | Name | Sequence |
|---|---|---|
| | | CGTCGACGGGGTCGAGGTACACAACGCCAAAACGAAGCCGAGGGAGGAGCAGTACAACTCCA<br>CCTACAGAGTGGTGTCCGTGCTGACGGTGCTGCACCAAGATTGGCTCAACGGGAAGGAGTAC<br>AAGTGCAAGGTGAGCAACAAAGCTCTGCCCGCCCCCATCGAAAAGACGATTAGCAAAGCCAA<br>GGGGCAGCCCAGGGAGCCCCAGGTCTACACGCTGCCTCCCAGCCGTGACGAACTGACCAAGA<br>ACCAGGTAAGCCTGACCTGTCTCGTGAAGGGCTTCTACCCCAGCGACATCGCCGTGGAGTGG<br>GAAAGCAACGGACAACCCGAAAACAACTACAAGACCACCCCACCCGTGCTCGACTCGGACGG<br>CAGCTTCTTCCTGTATAGCAAGCTGACCGTCGACAAGAGCAGGTGGCAGCAGGGCAATGTGT<br>TCAGCTGCTCGGTGATGCACGAAGCCCTCCACAACCACTACACCCAGAAAAGCCTGTCCCTC<br>AGCCCGGGCAAGATCACCTGCCCGCCGCCCATGTCCGTGGAGCACGCGGACATCTGGGTGAA<br>AAGCTACTCCCTGTACTCCAGGGAGAGGTATATCTGCAACAGCGGCTTCAAACGGAAGGCCG<br>GGACCAGCAGCCTGACGGAGTGCGTCCTGAACAAGGCCACCAACGTGGCCCATTGGACCACG<br>CCCTCGCTCAAGTGTATCAGGGACCCCGCCCTGGTGCACCAGAGGCCCGCCCCACCCTCCGG<br>AGGTTCCGGCGGAGGGGGCAGTGGCGGGGGCTCCGGCGGAGGTGGGAGCCTGCAGAACTGGG<br>TCAACGTGATCAGCGACCTGAAGAAGATCGAAGACCTGATACAGAGCATGCACATCGACGCC<br>ACCCTGTACACCGAGAGCGACGTCCACCCCAGCTGCAAGGTGACCGCCATGAAGTGCTTTCT<br>GCTGGAGCTGCAGGTGATCAGCCTCGAGTCCGGGGATGCCTCCATCCATGACACCGTGGAGA<br>ACCTGATAATCCTGGCCAATAATAGTCTGAGCAGCAACGGCAACGTGACCGAGAGCGGCTGC<br>AAGGAGTGCGAGGAGCTGGAAGAGAAGAACATCAAGGAGTTCCTGCAGTCCTTCGTGCATAT<br>AGTGCAGATGTTTATCAACACCAGC |
| 971 | IL15_Fc_RLI-CO18 | ATGGAAACGGATACCCTCCTCCTCTGGGTCCTTCTGCTCTGGGTCCCCGGCAGCACCGGCGA<br>GCCCAAGTCCTGCGACAAAACCCATACCTGCCCCCCGTGCCCCGCCCCCGAGCTCCTCGGCG<br>GCCCCAGCGTCTTCCTCTTCCCACCCAAGCCGAAGGATACGCTCATGATAAGCCGCACCCCC<br>GAGGTCACCTGCGTCGTTGTCGCCGTAAGCCACGAGGACCCCGAGGTCAAGTTCAACTGGTA<br>CGTAGACGGCGTCGAGGTCCACAACGCCAAGACCAAACCCAGAGAGGAGCAGTACAATAGCA<br>CCTACCGGGTCGTGAGCGTCCTGACCGTGCTCCACCAGGACTGGCTCAACGGGAAAGAGTAT<br>AAGTGCAAGGTTAGCAACAAGGCCCTGCCCGCACCCATCGAGAAGACCATTAGCAAGGCCAA<br>GGGGCAGCCCAGGGAGCCGCAGGTGTATACCCTCCCGCCCTCCCGCGATGAGCTCACCAAGA<br>ACCAGGTGAGCCTGACCTGCCTGGTGAAGGGCTTCTACCCCAGCGACATCGCCGTCGAGTGG<br>GAGAGCAACGGGCAGCCCGAGAACAACTACAAGACCACCCCACCCGTGCTGGATAGCGACGG<br>GAGCTTTTTCTCTACAGCAAGCTGACCGTGGACAAGAGCAGGTGGCAGCAGGGGAACGTGT<br>TTAGCTGCAGCGTCATGCACGAAGCCCTGCACAACCATTATACGCAGAAGTCCCTGAGCCTG<br>TCCCCCGGCAAGATCACCTGCCCGCCCCCCATGTCGGTCGAGCACGCCGACATCTGGGTGAA<br>AAGCTATAGCCTGTACAGCCGCGAGAGGTACATCTGCAATTCCGGCTTCAAACGGAAGGCCG<br>GGACCTCCAGCCTGACCGAGTGCGTGCTTAACAAGGCCACTAACGTGGCCCATTGGACCACC<br>CCCAGCCTCAAGTGCATCAGGGACCCCGCCCTGGTGCACCAGAGGCCCGCCCCTCCGAGCGG<br>AGGCTCCGGAGGGGGCGGTAGCGGCGGTGGGAGCGGTGGGGGAGGTAGCCTGCAGAATTGGG<br>TGAACGTGATCAGCGACCTCAAAAAGATAGAGGACCTGATCCAGAGCATGCACATCGATGCC<br>ACCCTGTACACGGAGTCCGACGTGCACCCCAGCTGCAAGGTGACGGCCATGAAGTGCTTCCT<br>GCTGGAACTGCAGGTCATCAGCCTGGAGAGCGGCGACGCCAGCATCCACGATACCGTGGAAA<br>ATCTGATCATCCTGGCGAACAACAGTCTGTCAAGCAACGGCAACGTGACCGAGAGCGGGTGT<br>AAGGAATGCGAGGAGCTCGAAGAGAAGAATATCAAGGAGTTCCTGCAGAGCTTTGTGCATAT<br>CGTGCAGATGTTCATAAACACCAGC |
| 972 | IL15_Fc_RLI-CO19 | ATGGAAACCGACACGCTCCTCCTCTGGGTCCTCTTGCTCTGGGTCCCGGGCTCCACCGGGGA<br>GCCCAAGAGCTGCGACAAGACCCACACGTGCCCGCCCTGTCCGGCTCCAGAGCTCCTCGGCG<br>GCCCCAGCGTCTTCCTCTTCCCGCCCAAGCCCAAGGACACCCTCATGATCTCCCGGACCCCC<br>GAGGTCACCTGCGTCGTCGTAGCCGTCAGCCACGAGGATCCCGAGGTCAAGTTCAACTGGTA<br>CGTCGACGGCGTCGAGGTACACAACGCCAAGACCAAGCCCCGCGAGGAGCAGTACAATAGTA<br>CCTACAGGGTAGTGAGCGTCCTGACCGTCCTCCATCAAGACTGGCTGAACGGCAAGGAGTAT<br>AAATGCAAGGTCAGCAATAAGGCCCTGCCCGCCCCCATCGAGAAGACCATCTCCAAGGCCAA<br>GGGGCAGCCACGAGAGCCCCAGGTGTACACCCTGCCTCCCTCTAGGGACGAGCTCACAAAGA<br>ACCAAGTTAGCTTGACGTGCCTGGTGAAGGGGTTCTACCCCTCCGACATCGCCGTGGAGTGG<br>GAGAGCAACGGCCAACCGGAGAACAATTATAAGACCACCCCGCCCGTGCTGGACAGCGATGG<br>GAGCTTCTTTCTGTATTCAAAGCTGACCGTCGACAAGAGCAGGTGGCAGCAGGGTAACGTGT<br>TCAGCTGCAGTGTGATGCACGAGGCCCTGCACAACCACTACACCCAGAAAAGCCTGAGCCTG<br>AGCCCTGGCAAGATCACCTGTCCCCCGCCCATGAGCGTGGAGCACGCCGACATCTGGGTGAA<br>AAGCTACAGCCTGTACTCCAGGGAGAGGTATATCTGCAACAGCGGCTTCAAGAGGAAGGCCG<br>GAACATCAAGCCTGACCGAGTGCGTGCTGAACAAGGCCACCAACGTGGCCCACTGGACGACT<br>CCCTCCCTGAAATGCATCAGGGACCCCGCCCTAGTGCACCAAAGGCCCGCCCCGCCCTCGGG<br>AGGTAGTGGGGGCGGTGGGAGCGGGGGCGGGAGTGGCGGGGGCGGCTCGCTGCAGAACTGGG<br>TGAATGTTATCTCCGATCTGAAAAAGATCGAGGACCTCATCCAGAGCATGCACATCGACGCC<br>ACCCTCTACACTGAGAGCGATGTGCATCCCAGCTGCAAGGTGACCGCCATGAAGTGTTTCCT<br>GCTGGAGCTGCAAGTAATCAGCCTGGAGTCCGGCGACGCCAGCATCCACGACACCGTGGAGA<br>ATCTGATAATCCTGGCGAATAACAGCCTGAGTTCCAACGGGAACGTCACCGAAAGCGGCTGC<br>AAGGAGTGCGAGGAGCTGGAAGAGAAGAACATCAAGGAGTTCCTGCAGTCCTTTGTGCACAT<br>CGTGCAGATGTTCATCAACACCTCC |
| 973 | IL15_Fc_RLI-CO20 | ATGGAGACGGACACCCTCCTCCTCTGGGTACTCCTCCTCTGGGTCCCCGGCAGCACCGGGGA<br>GCCCAAGTCCTGCGACAAGACCCATACCTGCCCTCCCTGCCCGGCTCCCGAGCTCCTAGGGG<br>GTCCCTCCGTCTTCCTTTTTCCCCCGAAGCCTAAGGATACCCTCATGATTAGCCGCACGCCC<br>GAGGTCACGTGCGTTGTCGTCGCCGTAAGCCACGAAGACCCCGAGGTCAAGTTCAACTGGTA<br>CGTGGACGGGGTGGAGGTCCACAACGCGAAGACCAAGCCCCGGGAGGAGCAGTACAACTCCA<br>CCTACAGGGTGGTGAGTGTGCTGACGGTGCTGCACCAGGACTGGCTCAATGGGAAGGAGTAC |

TABLE 11-continued

Additional sequence optimized nucleic acid encoding IL15 polypeptides

| SEQ ID NO | Name | Sequence |
|---|---|---|
| | | AAGTGCAAGGTGAGCAACAAAGCGCTGCCCGCCCCGATCGAAAAGACCATCTCCAAGGCGAA<br>GGGCCAGCCCAGGGAGCCCCAGGTGTACACCCTGCCCCCCTCCCGGGACGAGCTGACCAAAA<br>ACCAGGTCAGCCTGACCTGCCTCGTCAAGGGGTTTTACCCCAGCGACATCGCAGTGGAGTGG<br>GAAAGCAACGGCCAGCCCGAAAACAACTATAAGACCACCCCTCCCGTGCTGGACTCCGACGG<br>CAGCTTTTTCCTCTACTCTAAGCTCACCGTGGACAAAAGCAGGTGGCAGCAGGGGAACGTCT<br>TCAGCTGCTCCGTCATGCACGAGGCCCTCCACAACCACTACACCCAGAAAAGCCTGTCCCTC<br>TCCCCCGGGAAGATCACGTGCCCTCCCCCCATGAGCGTGGAACATGCCGACATCTGGGTGAA<br>GTCCTACAGCCTGTACAGCCGGGAAAGGTACATCTGCAACAGCGGCTTCAAGAGGAAGGCCG<br>GAACGTCCAGCCTGACGGAGTGCGTCCTGAATAAGGCCACCAACGTGGCCCATTGGACCACC<br>CCCAGCCTCAAATGTATAAGGGACCCCGCCCTTGTGCACCAAAGGCCCGCCCCGCCCTCCGG<br>CGGCTCGGGCGGCGGCGGAAGCGGAGGCGGTAGCGGCGGGGGCGGGAGCCTTCAGAACTGGG<br>TCAACGTGATCAGCGACCTGAAAAAGATCGAGGACCTGATCCAGAGCATGCACATCGACGCC<br>ACTCTGTACACCGAAAGCGATGTGCACCCCTCCTGCAAGGTGACCGCTATGAAGTGTTTTCT<br>GCTCGAGCTGCAGGTGATCTCCCTGGAGAGCGGCGACGCCAGCATCCACGACACCGTGGAGA<br>ACCTGATAATCCTGGCCAACAACAGCCTCAGCAGCAACGGGAACGTCACCGAGAGCGGCTGC<br>AAGGAGTGCGAAGAACTGGAGGAGAAAAACATCAAAGAGTTCCTGCAGAGCTTCGTGCACAT<br>CGTGCAGATGTTTATCAACACCAGC |
| 974 | IL15_Fc_RLI-CO21 | ATGGAGACTGACACCCTCCTCCTCTGGGTTCTTCTTTTGTGGGTCCCCGGTTCAACCGGGGA<br>GCCAAAGTCCTGCGATAAAACGCACACGTGCCCGCCCTGCCCCGCCCCGGAGCTCCTCGGCG<br>GGCCCTCGGTCTTCCTCTTCCCGCCCAAGCCGAAGGACACCCTCATGATCAGCCGGACCCCC<br>GAGGTCACCTGTGTCGTCGTGGCAGTTAGCCACGAGGACCCCGAAGTCAAGTTCAACTGGTA<br>CGTGGACGGCGTCGAGGTTCACAACGCCAAGACCAAGCCCAGGGAGGAGCAATACAACAGCA<br>CCTACAGGGTCGTCTCCGTGCTGACCGTGCTGCACCAGGACTGGCTGAACGGAAAAGAGTAT<br>AAGTGCAAGGTGAGCAACAAGGCCCTGCCAGCCCCGATCGAGAAGACCATAAGCAAGGCCAA<br>GGGCCAGCCCAGGGAGCCCCAGGTGTATACGCTCCCTCCCAGCCGGGATGAGCTGACCAAAA<br>ACCAGGTGTCCCTGACCTGCCTGGTGAAGGGCTTCTACCCCAGCGACATCGCCGTGGAATGG<br>GAGTCCAACGGACAGCCGGAGAACAACTACAAGACCACACCGCCCGTGCTGGACAGCGACGG<br>ATCATTCTTCCTGTACAGCAAGCTGACCGTGGACAAGAGCAGGTGGCAGCAGGGCAACGTGT<br>TCAGCTGCTCCGTGATGCACGAGGCGCTGCACAATCACTACACACAGAAGTCCCTGTCCCTC<br>AGCCCGGGCAAGATAACGTGCCCACCCCCCATGAGCGTGGAGCACGCCGATATCTGGGTGAA<br>GTCCTACAGCCTGTATAGCAGGGAGAGGTACATCTGCAACAGCGGCTTCAAGCGTAAGGCCG<br>GGACCTCCAGCCTCACCGAGTGCGTGCTGAACAAGGCCACCAACGTCGCCCACTGGACGACG<br>CCGTCCCTGAAATGTATAAGGGACCCGGCCCTCGTGCACCAAAGGCCCGCCCCACCTAGCGG<br>CGGGTCCGGGGGAGGGGGCAGCGGCGGGGGTTCAGGCGGGGGCGGCAGCCTGCAAAATTGGG<br>TAAACGTGATCTCCGACCTCAAGAAAATCGAGGATCTGATCCAGAGCATGCACATCGACGCC<br>ACCCTGTACACGGAGAGCGACGTACACCCCAGCTGCAAGGTGACCGCCATGAAGTGCTTCCT<br>GCTCGAGCTTCAAGTGATCAGCCTGGAGAGCGGCGACGCCAGCATCCACGACACCGTGGAGA<br>ACCTGATCATACTGGCCAATAACAGCCTGAGCAGCAACGGGAACGTGACCGAGAGCGGGTGC<br>AAGGAGTGCGAGGAGCTGGAGGAGAAGAACATCAAAGAGTTTCTGCAGTCCTTCGTGCACAT<br>CGTGCAGATGTTCATAAACACAAGC |
| 975 | IL15_Fc_RLI-CO22 | ATGGAAACCGATACCCTCCTCCTCTGGGTCCTCTTGCTCTGGGTCCCCGGCAGCACCGGGGA<br>GCCAAAGAGCTGCGACAAGACCCACACCTGCCCACCCTGCCCCGCCCCCGAGCTCCTCGGGG<br>GTCCTAGCGTCTTTCTCTTTCCCCCCAAACCCAAGGATACCCTCATGATCAGCAGGACCCCC<br>GAGGTCACGTGCGTCGTCGTCGCCGTCAGCCACGAAGACCCCGAGGTCAAGTTCAACTGGTA<br>CGTAGACGGAGTCGAGGTCCACAACGCGAAGACCAAACCCCGCGAGGAGCAGTACAACAGCA<br>CCTACCGTGTGGTGAGCGTGCTGACCGTGCTTCACCAGGATTGGCTCAATGGCAAGGAGTAT<br>AAGTGCAAGGTCAGCAACAAGGCCCTGCCCGCGCCCATCGAGAAGACCATCAGCAAGGCCAA<br>GGGGCAACCCAGGGAACCCCAGGTGTACACCCTGCCACCCAGCAGGGACGAGCTGACCAAGA<br>ACCAGGTGAGCCTGACCTGCTTAGTGAAAGGTTTCTACCCCAGCGACATCGCCGTGGAGTGG<br>GAGTCCAACGGGCAGCCCGAGAACAACTACAAAACCACCCCGCCGGTGCTGGACAGCGATGG<br>CAGCTTCTTCCTGTATAGCAAACTGACCGTGGACAAGAGCCGGTGGCAGCAGGGCAACGTCT<br>TCTCCTGCAGTGTGATGCACGAGGCCCTGCACAACCACTACACGCAGAAAAGCCTGTCCCTT<br>AGCCCCGGCAAGATCACCTGCCCGCCCCCCATGAGCGTGGAGCATGCCGACATATGGGTGAA<br>GTCCTACAGCCTCTACAGCCGGGAGAGGTATATCTGCAACAGCGGCTTTAAGAGGAAGGCGG<br>GGACCAGCTCCCTGACCGAATGCGTGCTGAACAAGGCCACCAACGTGGCGCACTGGACAACT<br>CCCAGCCTGAAGTGCATCAGGGACCCCGCCCTCGTGCACCAAAGGCCCGCCCCTCCCAGCGG<br>GGGTAGCGGGGGCGGGGGAAGCGGGGGCGGCAGCGGTGGTGGCGGAAGCCTTCAGAACTGGG<br>TGAACGTGATCTCCGATCTGAAAAAGATTGAAGATCTGATCCAGAGCATGCACATCGACGCA<br>ACCCTCTACACCGAGTCCGACGTCCATCCCTCCTGTAAGGTGACCGCGATGAAATGCTTTCT<br>GCTGGAGCTCCAGGTCATCTCGCTCGAGTCAGGCGACGCCAGCATCCACGATACCGTGGAAA<br>ATCTGATCATCCTGGCCAACAACAGCCTGAGCTCGAACGGGAATGTGACCGAGTCCGGGTGT<br>AAGGAGTGTGAGGAGCTGGAGGAGAAGAACATCAAGGAGTTCCTCCAGAGCTTCGTGCACAT<br>CGTGCAGATGTTCATCAACACCTCG |
| 976 | IL15_Fc_RLI-CO23 | ATGGAGACAGACACCCTCCTCCTCTGGGTCCTCCTCCTCTGGGTCCCCGGCAGCACCGGCGA<br>GCCGAAAAGCTGCGACAAGACCCACACGTGCCCGCCCTGCCCGGCCCCCGAGCTCCTCGGAG<br>GACCCAGCGTGTTCCTCTTCCCGCCCAAGCCCAAGGACACCCTCATGATCAGCCGCACCCCC<br>GAGGTCACCTGCGTTGTCGTAGCCGTCTCCCACGAGGACCCCGAGGTCAAGTTTAATTGGTA<br>CGTCGACGGCGTCGAAGTCCATAACGCCAAGACGAAGCCCAGGGAGGAGCAGTATAACAGCA<br>CGTATAGGGTGGTGAGCGTCCTGACCGTGCTGCACCAGGACTGGCTGAACGGCAAAGAGTAC<br>AAGTGCAAGGTATCCAACAAAGCCCTGCCTGCCCCCATCGAAAAGACGATCTCCAAGGCGAA<br>GGGCCAGCCCCGAGAGCCCCAGGTGTACACGCTGCCCCCGTCCAGGGACGAGCTCACCAAAA |

TABLE 11-continued

Additional sequence optimized nucleic acid encoding IL15 polypeptides

| SEQ ID NO | Name | Sequence |
|---|---|---|
| | | ACCAGGTGAGCCTCACTTGCCTCGTGAAGGGGTTCTACCCCAGCGACATCGCCGTCGAGTGG<br>GAGTCCAATGGGCAGCCCGAGAACAACTACAAGACCACCCCACCCGTCCTGGACTCCGACGG<br>CTCATTCTTCCTGTATTCCAAGCTGACCGTGGACAAGTCCAGGTGGCAGCAAGGCAACGTCT<br>TCAGCTGCAGCGTCATGCACGAGGCCCTGCACAATCACTACACCCAGAAGTCACTGAGCCTG<br>TCCCCGGGGAAGATCACTTGTCCCCCGCCCATGTCCGTGGAGCACGCCGATATCTGGGTGAA<br>AAGCTACAGCCTGTACTCCCGCGAGAGGTACATCTGCAACTCCGGGTTCAAGCGGAAGGCCG<br>GCACCTCCAGCCTGACCGAGTGCGTGCTGAACAAGGCCACCAACGTGGCCCACTGGACCACC<br>CCGAGCCTGAAATGTATAAGGGATCCCGCGCTCGTGCACCAGAGGCCGGCCCCTCCTTCGGG<br>GGGCAGCGGGGGTGGCGGCTCAGGCGGCGGGTCCGGGGGTGGCGGGAGCCTGCAAAACTGGG<br>TGAACGTGATAAGCGACCTGAAGAAGATCGAGGACCTCATCCAGTCGATGCACATCGACGCC<br>ACCCTGTACACCGAGAGCGATGTGCACCCCAGCTGCAAGGTGACCGCCATGAAATGCTTCCT<br>CCTGGAGCTGCAGGTGATCTCCCTGGAGAGCGGCGACGCCTCCATCCACGACACGGTGGAGA<br>ACCTGATCATCCTGGCCAACAATTCGCTCTCCAGCAACGGCAACGTGACCGAGAGCGGGTGC<br>AAGGAGTGCGAGGAGCTGGAGGAGAAAAACATTAAGGAGTTCCTGCAATCCTTCGTGCATAT<br>AGTCCAGATGTTCATTAACACCAGC |
| 977 | IL15_Fc_RLI-CO24 | ATGGAGACGGACACCCTCCTCCTCTGGGTCCTCCTCCTCTGGGTCCCCGGGAGCACGGGCGA<br>GCCCAAGAGCTGCGACAAGACCCACACCTGCCCGCCCTGCCCCGCCCCCGAGCTCCTCGGCG<br>GCCCATCCGTCTTCCTCTTCCCGCCCAAGCCCAAGGACACCCTCATGATCAGCAGGACCCCC<br>GAGGTCACCTGCGTCGTCGTTGCCGTCAGCCACGAGGACCCGGAGGTCAAATTCAACTGGTA<br>CGTTGACGGGGTGGAGGTCCACAACGCCAAGACCAAGCCCCGCGAGGAGCAGTACAATTCTA<br>CATACCGGGTGGTGTCCGTGCTCACCGTCCTGCACCAGGATTGGCTGAACGGAAAAGAATAC<br>AAGTGCAAAGTGAGCAACAAGGCGCTGCCCGCCCCCATCGAGAAGACCATCTCCAAGGCCAA<br>GGGCCAGCCCAGGGAACCACAGGTGTACACCCTGCCCCCCAGTAGGGACGAGCTCACCAAGA<br>ACCAGGTCAGCCTGACCTGCCTGGTGAAGGGATTCTACCCCTCCGACATAGCCGTCGAGTGG<br>GAGTCCAACGGGCAGCCGGAGAATAACTACAAGACCACCCCGCCCGTGCTCGATAGCGACGG<br>CTCCTTCTTCCTGTACAGCAAGCTGACAGTGGACAAGAGCAGGTGGCAGCAGGGCAATGTGT<br>TCTCCTGTTCCGTGATGCACGAGGCCCTCCACAACCACTACACCCAGAAGTCCCTGTCCCTG<br>AGCCCCGGCAAGATCACTTGCCCACCCCCCATGAGCGTCGAGCACGCCGACATATGGGTGAA<br>AAGCTACAGCCTGTACTCCCGGGAGAGGTACATCTGTAACTCGGGGTTCAAAAGGAAGGCGG<br>GCACCTCCTCCCTGACCGAGTGTGTTCTGAACAAGGCCACCAACGTGGCCCACTGGACCACC<br>CCCTCTCTGAAGTGTATCAGGGACCCGGCCCTCGTCCATCAGCGTCCCGCCCCTCCCTCCGG<br>AGGCAGCGGCGGAGGGGGATCAGGGGGCGGCAGCGGCGGTGGGGGGAGCCTGCAGAACTGGG<br>TGAACGTCATCAGCGACCTGAAGAAGATCGAGGATCTGATACAGAGCATGCACATCGACGCC<br>ACCCTGTACACGGAAAGCGACGTGCACCCCTCCTGTAAGGTGACCGCCATGAAGTGCTTCCT<br>CCTTGAGCTCCAGGTGATCAGCCTGGAGAGCGGCGACGCCAGCATCCACGACACCGTGGAGA<br>ACCTGATCATCCTGGCCAACAATTCACTGAGCTCTAACGGCAATGTCACCGAGTCGGGCTGC<br>AAGGAGTGCGAGGAGCTCGAGGAGAAGAACATCAAGGAGTTCCTGCAGTCCTTCGTGCACAT<br>CGTACAGATGTTCATCAATACCAGC |
| 978 | IL15_Fc_RLI-CO25 | ATGGAGACAGACACCCTCCTACTCTGGGTCCTCCTCCTCTGGGTCCCCGGCAGCACCGGGGA<br>ACCCAAAAGCTGCGACAAGACACATACCTGTCCTCCGTGCCCCGCCCCCGAGCTCCTCGGCG<br>GGCCCTCCGTCTTCCTCTTCCCGCCCAAGCCCAAGGATACGCTCATGATCAGCCGGACTCCC<br>GAGGTCACGTGTGTTGTCGTCGCCGTTAGCCACGAGGACCCCGAAGTCAAGTTCAACTGGTA<br>CGTCGACGGCGTCGAGGTCCACAACGCCAAGACCAAGCCCAGGGAGGAGCAGTACAACAGCA<br>CCTACAGGGTGGTTTCGGTGCTGACCGTGCTGCACCAGGATTGGCTGAACGGCAAGGAGTAC<br>AAGTGCAAGGTGAGCAACAAGGCCCTGCCCGCCCCCATCGAGAAGACCATCAGCAAAGCCAA<br>GGGGCAACCAAGGGAGCCCCAGGTCTACACCCTCCCGCCCAGCCGCGACGAGCTGACTAAGA<br>ACCAGGTGAGCCTGACCTGCCTGGTGAAGGGCTTTTACCCCAGCGACATCGCGGTGGAATGG<br>GAGAGCAACGGCCAGCCCGAGAACAACTATAAGACCACCCCGCCCGTGCTGGACAGCGACGG<br>AAGCTTCTTCCTCTACAGCAAGCTGACCGTGGACAAGAGCCGGTGGCAGCAGGGCAATGTGT<br>TCAGCTGCTCAGTGATGCACGAGGCCCTGCACAATCACTACACCCAGAAGTCGCTGAGCCTG<br>AGCCCGGGAAAGATCACATGCCCGCCCCCCATGAGCGTGGAACACGCAGACATCTGGGTGAA<br>AAGCTACTCCCTGTACAGCAGGGAAAGGTACATCTGCAACTCCGGCTTCAAGAGGAAGGCCG<br>GCACCAGCTCCCTGACCGAGTGCGTGCTGAATAAGGCCACCAATGTGGCCCATTGGACGACG<br>CCCAGCCTCAAATGTATCCGAGATCCCGCTTTGGTGCACCAGAGGCCCGCCCCGCCGTCCGG<br>CGGCTCCGGGGGCGGCGGAAGCGGGGGTGGAAGCGGCGGCGGCGGGTCCCTTCAGAACTGGG<br>TGAATGTGATCTCCGACCTCAAGAAGATCGAGGACCTGATCCAGAGCATGCACATCGACGCC<br>ACGCTCTACACCGAATCCGACGTGCACCCCAGCTGCAAGGTTACCGCCATGAAGTGCTTCCT<br>CCTGGAGCTGCAGGTGATCAGTCTGGAGAGCGGCGATGCCAGCATCCACGATACCGTGGAAA<br>ACCTTATCATCCTGGCCAACAACTCCCTGAGCTCCAACGGGAATGTGACCGAGAGCGGGTGC<br>AAGGAGTGCGAGGAACTCGAGGAGAAGAACATCAAGGAATTTCTGCAAAGCTTCGTGCACAT<br>AGTGCAGATGTTCATCAACACGTCC |

Modified Nucleotide Sequences Encoding IL15 Polypeptides:

In some embodiments, the IL15 polynucleotide (e.g., a RNA, e.g., an mRNA) comprises a chemically modified nucleobase, e.g., 5-methoxyuracil. In some embodiments, the mRNA is a uracil-modified sequence comprising an ORF encoding an IL15 polypeptide, IL15Rα polypeptide, or both IL15 and IL15Rα polypeptides, wherein the mRNA comprises a chemically modified nucleobase, e.g., 5-methoxyuracil.

In certain aspects of the disclosure, when the 5-methoxyuracil base is connected to a ribose sugar, as it is in polynucleotides, the resulting modified nucleoside or nucleotide is referred to as 5-methoxyuridine. In some embodiments, uracil in the IL15 polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the IL15 polynucleotide is at least 95% 5-methoxyuracil. In another embodiment, uracil in the IL15 polynucleotide is 100% 5-methoxyuracil.

In embodiments where uracil in the Il15 polynucleotide is at least 95% 5-methoxyuracil, overall uracil content can be adjusted such that an mRNA provides suitable protein expression levels while inducing little to no immune response. In some embodiments, the uracil content of the ORF (% $U_{TM}$) is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140%. In other embodiments, the uracil content of the ORF is between about 117% and about 134% or between 118% and 132% of the % $U_{TM}$. In some embodiments, the % $U_{TM}$ is about 115%, about 120%, about 125%, about 130%, about 135%, about 140%, about 145%, or about 150%. In this context, the term "uracil" can refer to 5-methoxyuracil and/or naturally occurring uracil.

In some embodiments, the uracil content in the ORF of the mRNA encoding an IL15Rα polypeptide, a IL15 polypeptide, or both IL15Rα and IL15 polypeptides of the disclosure is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 20% and about 30% of the total nucleobase content in the ORF. In one embodiment, the uracil content in the ORF of the mRNA encoding an IL15Rα polypeptide, a IL15 polypeptide, or both IL15Rα and IL15 polypeptides is less than about 20% of the total nucleobase content in the open reading frame. In this context, the term "uracil" can refer to 5-methoxyuracil and/or naturally occurring uracil.

In further embodiments, the ORF of the mRNA encoding an IL15Rα polypeptide, a IL15 polypeptide, or both IL15Rα and IL15 polypeptides having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF. In some embodiments, the G, the C, or the G/C content in the ORF is less than about 100%, less than about 90%, less than about 85%, or less than about 80% of the theoretical maximum G, C, or G/C content of the corresponding wild-type nucleotide sequence encoding the IL15Rα polypeptide, IL15 polypeptide, or both IL15Rα and IL15 polypeptides (% $G_{TMX}$; % $C_{TMX}$, or % $G/C_{TMX}$). In other embodiments, the G, the C, or the G/C content in the ORF is between about 70% and about 80%, between about 71% and about 79%, between about 71% and about 78%, or between about 71% and about 77% of the % $G_{TMX}$, % $C_{TMX}$, or % $G/C_{TMX}$. In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding an IL15Rα polypeptide, a IL15 polypeptide, or both IL15Rα and L 15 polypeptides of the disclosure comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the IL15Rα polypeptide, L 15 polypeptide, or both IL15Rα and IL15 polypeptides. In some embodiments, the ORF of the mRNA encoding an IL15Rα polypeptide, a L 15 polypeptide, or both IL15Rα and L 15 polypeptides of the disclosure contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the IL15Rα polypeptide, IL15 polypeptide, or both IL15Rα and L 15 polypeptides. In a particular embodiment, the ORF of the mRNA encoding the IL15Rα polypeptide, IL15 polypeptide, or both IL15Rα and IL15 polypeptides of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the IL15Rα polypeptide, IL15 polypeptide, or both IL15Rα and IL15 polypeptides contains no non-phenylalanine uracil pairs and/or triplets.

In further embodiments, the ORF of the mRNA encoding an IL15Rα polypeptide, a IL15 polypeptide, or both IL15Rα and IL15 polypeptides of the disclosure comprises 5-methoxyuracil and has an adjusted uracil content containing less uracil-rich clusters than the corresponding wild-type nucleotide sequence encoding the IL15Rα polypeptide, a IL15 polypeptide, or both IL15Rα and IL15 polypeptides. In some embodiments, the ORF of the mRNA encoding the IL15Rα polypeptide, 15 polypeptide, or both IL15Rα and IL15 polypeptides of the disclosure contains uracil-rich clusters that are shorter in length than corresponding uracil-rich clusters in the corresponding wild-type nucleotide sequence encoding the IL15Rα polypeptide, L 15 polypeptide, or both IL15Rα and L 15 polypeptides.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the IL15Rα polypeptide, IL15 polypeptide, or both IL15Rα and IL15 polypeptides-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above. In some embodiments, at least one codon in the ORF of the mRNA encoding the IL15Rα polypeptide, L 15 polypeptide, or both IL15Rα and L 15 polypeptides is substituted with an alternative codon having a codon frequency lower than the codon frequency of the substituted codon in the synonymous codon set.

In some embodiments, the adjusted uracil content, IL15Rα polypeptide, IL15 polypeptide, or both IL15Rα and L 15 polypeptides-encoding ORF of the 5-methoxyuracil-comprising mRNA exhibits expression levels of IL15 and/or IL15Rα when administered to a mammalian cell that are higher than expression levels of IL15 and/or IL15Rα from the corresponding wild-type mRNA. In other embodiments, the expression levels of IL15 and/or IL15Rα when administered to a mammalian cell are increased relative to a corresponding mRNA containing at least 95% 5-methoxyuracil and having a uracil content of about 160%, about 170%, about 180%, about 190%, or about 200% of the theoretical minimum.

In yet other embodiments, the expression levels of IL15 and/or IL15Rα when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, IL15 and/or IL15Rα is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the TL 5 and/or IL15Rα polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, IL15Rα polypeptide, IL15 polypeptide, or both IL15Rα and IL15 polypeptides-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the IL15 mRNA exhibits increased stability including resistance to nucleases, thermal stability, and/or increased stabilization of secondary structure. In some embodiments, increased stability exhibited by the IL15 mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the IL15 mRNA of the present disclosure induces a detectably lower immune response (e.g., innate or acquired) relative to the immune response induced by a corresponding wild-type mRNA under the same conditions. In other embodiments, the mRNA of the present disclosure induces a detectably lower immune response (e.g., innate or acquired) relative to the immune response induced by an mRNA that encodes for an IL15 polypeptide, IL15Rα polypeptide, or both IL15 and IL15Rα polypeptides but does not comprise 5-methoxyuracil under the same conditions, or relative to the immune response induced by an mRNA that encodes for an IL15Rα polypeptide, IL15 polypeptide, or both IL15Rα and IL15 polypeptides and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of the mRNA of the disclosure into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes an IL15Rα polypeptide, IL15 polypeptide, or both IL15Rα and IL15 polypeptides but does not comprise 5-methoxyuracil, or to an mRNA that encodes an IL15Rα polypeptide, IL15 polypeptide, or both IL15Rα and IL15 polypeptides and that comprises 5-methoxyuracil but that does not have adjusted uracil content. In some embodiments, the interferon is IFN-β. In some embodiments, cell death frequency cased by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for an IL15Rα polypeptide, IL15 polypeptide, or both IL15Rα and IL15 polypeptides but does not comprise 5-methoxyuracil, or an mRNA that encodes for an IL15Rα polypeptide, IL15 polypeptide, or both IL15Rα and IL15 polypeptides and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the IL15 polynucleotide is an mRNA that comprises an ORF that encodes an IL15Rα polypeptide, IL15 polypeptide, or both IL15Rα and IL15 polypeptides, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the IL15Rα polypeptide, IL15 polypeptide, or both IL15Rα and IL15 polypeptides is less than about 30% of the total nucleobase content in the ORF. In some embodiments, the ORF that encodes the IL15Rα polypeptide, L 15 polypeptide, or both IL15Rα and IL15 polypeptides is further modified to increase G/C content of the ORF (absolute or relative) by at least about 40%, as compared to the corresponding wild-type ORF. In yet other embodiments, the ORF encoding the IL15Rα polypeptide, IL15 polypeptide, or both IL15Rα and IL15 polypeptides contains less than 20 non-phenylalanine uracil pairs and/or triplets.

In some embodiments, at least one codon in the ORF of the mRNA encoding the IL15Rα polypeptide, IL15 polypeptide, or both IL15Rα and IL15 polypeptides is further substituted with an alternative codon having a codon frequency lower than the codon frequency of the substituted codon in the synonymous codon set. In some embodiments, the expression of the IL15Rα polypeptide, IL15 polypeptide, or both IL15Rα and IL15 polypeptides encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the IL15Rα polypeptide, IL15 polypeptide, or both IL15Rα and IL15 polypeptides from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

Polynucleotide Comprising an mRNA Encoding an IL15 and/or IL15Rα Polypeptide:

In certain embodiments, an 15 polynucleotide of the present disclosure, for example a polynucleotide comprising an mRNA nucleotide sequence encoding an IL15 polypeptide, IL15Rα polypeptide, or both IL15 and IL15Rα polypeptides, comprises from 5' to 3' end:

(i) a 5' UTR, such as the sequences provided below, comprising a 5' cap provided below;

(ii) an open reading frame encoding an IL15 polypeptide, IL15Rα polypeptide, or both IL15 and IL15Rα polypeptides, e.g., a sequence optimized nucleic acid sequence encoding IL15 and/or IL15Rα disclosed herein;

(iii) at least one stop codon;

(iv) a 3' UTR, such as the sequences provided below; and (v) a poly-A tail provided below.

In some embodiments, the IL15 polynucleotide further comprises a miRNA binding site, e.g, a miRNA binding site that binds to miRNA-122. In some embodiments, the 3'UTR comprises the miRNA binding site.

In some embodiments, an L 15 polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild-type L 15 and/or IL15Rα polypeptide.

Compositions and Formulations for Use Comprising IL15 Polynucleotides:

Certain aspects of the present disclosure are directed to compositions or formulations comprising any of the Il15 polynucleotides disclosed above.

In some embodiments, the composition or formulation comprises:

(i) an IL15 polynucleotide (e.g., a RNA, e.g., an mRNA) comprising a sequence-optimized nucleotide sequence (e.g., an ORF) encoding an IL15 polypeptide, IL15Rα polypeptide, or both IL15 and IL15Rα polypeptides (e.g., the wild-type sequence, functional fragment, or variant thereof), wherein the IL15 polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the Il15 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the IL15 polypeptide, IL15Rα polypeptide, or both IL15 and IL15Rα polypeptides (% $U_{TM}$ or % $T_{TM}$), is between about 100% and about 150%.

In some embodiments, the IL15 polynucleotides, compositions or formulations above are used to treat and/or prevent cell proliferation-related diseases, disorders or conditions, e.g., cancer.

F. Interleukin-23 (IL23)

In some embodiments, the combination therapies disclosed herein comprise one or more IL23 polynucleotides (e.g., mRNAs), i.e., polynucleotides comprising one or more ORFs encoding an IL23 polypeptide.

Interleukin-23 (IL23) is a pro-inflammatory cytokine that plays an important role in innate and adaptive immunity. Croxford A L et al., *Eur. J. Immunol.* 42:2263-2273 (2012). It functions primarily as a 60 kDa heterodimeric protein consisting of disulfide-linked p19 (IL23A) and p40 (IL23B) subunits. IL23 is structurally and functionally similar to the pro-inflammatory cytokine IL12. IL23 contains the same p40 subunit as IL12, but includes the p19 subunit ("p19") rather than IL12's p35. Oppman B et al., *Immunity* 13(5): 715-725 (2000).

The precursor form of p19 (NP_057668; NM_016584; Q9NPF7; also referred to as IL23A and IL23 subunit alpha) is 189 amino acids in length, while its mature form is 170 amino acids long. The precursor form of the p40 subunit (NM_002187; P29460; also referred to as IL12B, natural killer cell stimulatory factor 2, and cytotoxic lymphocyte maturation factor 2) is 328 amino acids in length, while its mature form is 306 amino acids long.

Many different immune cells, including dendritic cells and macrophages, produce IL23 upon antigenic stimuli. Vignali D A A and Kuchroo V K, *Nat. Immunol.* 13(8):722-728 (2014). One difference between IL12 and IL23 is that IL12 is associated with the development and activity of Th1 T cell populations, while IL23 is associated with the development and activity of Th17 T cell populations. Id.

There has also been interest in the role of IL23 in anti-tumor immunity, as initial studies demonstrated it could play a role similar to that of IL12. Croxford A L et al., *Eur. J. Immunol.* 42:2263-2273 (2012). Results in such inquiries, however, have provided mixed results, with some studies indicating a potential pro-tumorigenic function for IL23. Id. Therefore, there is a need for an improved therapeutic approach to using IL23 to treat tumors.

IL23 is composed of a bundle of four alpha helices. It is a heterodimeric cytokine encoded by two separate genes, IL23A (p19) and IL12B (p40). The active heterodimer is formed following protein synthesis. Therefore, in some embodiments, the IL23 polypeptide disclosed herein comprises a single polypeptide chain comprising the IL12B and IL23A fused directly or by a linker. In other embodiments, the IL23 polypeptide comprises two polypeptides, the first polypeptide comprising IL12B and the second polypeptide comprising IL23A.

In certain embodiments, the present disclosure provides an IL23A polypeptide and an IL12B polypeptide, wherein the IL23A and IL12B polypeptides are on the same chain or different chains. In some embodiments, the IL23A or IL12B polypeptide is a variant, a peptide or a polypeptide containing a substitution, and insertion and/or an addition, a deletion and/or a covalent modification with respect to a wild-type IL23A or IL12B sequence.

In some embodiments, sequence tags or amino acids, can be added to the sequences encoded by the IL23 polynucleotides disclosed herein (e.g., at the N-terminal or C-terminal ends), e.g., for localization. In some embodiments, amino acid residues located at the carboxy, amino terminal, or internal regions of an IL23 polypeptide of the disclosure can optionally be deleted providing for fragments.

In some embodiments, the IL23A and/or IL12B polypeptide encoded by the IL23 polynucleotide (e.g., a RNA, e.g., a mRNA) comprises a substitutional variant of an IL23A and/or IL12B sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

In other embodiments, the IL23A and/or IL12B polypeptide encoded by the IL23 polynucleotide (e.g., a RNA, e.g., a mRNA) comprises a linker fusing the IL23A and IL12B polypeptides. Non-limiting examples of linkers are disclosed elsewhere herein.

As recognized by those skilled in the art, IL12B and/or IL23A protein fragments, functional protein domains, variants, and homologous proteins (orthologs) are also considered to be within the scope of the disclosure. Nonlimiting examples of polypeptides encoded by the IL23 polynucleotides of the present disclosure are shown in TABLE 12 and FIGS. 115A to 116C.

TABLE 12

Sequences of IL23 polypeptides and IL23 polynucleotides

| SEQ ID NO | Description | Sequence | Comments |
|---|---|---|---|
| 979 | IL12B, Interleukin-12 subunit beta, wt. Protein sequence. | MCHQQLVISWFSLVFLASPLVAIWELKKDVYVVELDWYPDAPGEMVVLTCDTPEED<br>GITWTLDQSSEVLGSGKTLTIQVKEFGDAGQYTCHKGGEVLSHSLLLLHKKEDGIW<br>STDILKDQKEPKNKTFLRCEAKNYSGRFTCWWLTTISTDLTFSVKSSRGSSDPQGV<br>TCGAATLSAERVRGDNKEYEYSVECQEDSACPAAEESLPIEVMVDAVHKLKYENYT<br>SSFFIRDIIKPDPPKNLQLKPLKNSRQVEVSWEYPDTWSTPHSYFSLTFCVQVQGK<br>SKREKKDRVFTDKTSATVIC RKNASISVRAQDRYYSSSWSEWASVPCS | Signal peptide is underlined. |
| 980 | IL12B, Interleukin-12 subunit beta, wt. Nucleic acid sequence. | ATGTGTCACCAGCAGTTGGTCATCTCTTGGTTTTCCCTGGTTTTTCTGGCATCTCC<br>CCTCGTGGCCATATGGGAACTGAAGAAAGATGTTTATGTCGTAGAATTGGATTGGT<br>ATCCGGATGCCCCTGGAGAAATGGTGGTCCTCACCTGTGACACCCCTGAAGAAGAT<br>GGTATCACCTGGACCTTGGACCAGAGCAGTGAGGTCTTAGGCTCTGGCAAAACCCT<br>GACCATCCAAGTCAAAGAGTTTGGAGATGCTGGCCAGTACACCTGTCACAAAGGAG<br>GCGAGGTTCTAAGCCATTCGCTCCTGCTGCTTCACAAAAAGGAAGATGGAATTTGG<br>TCCACTGATATTTTAAAGGACCAGAAAGAACCCAAAAATAAGACCTTTCTAAGATG<br>CGAGGCCAAGAATTATTCTGGACGTTTCACCTGCTGGTGGCTGACGACAATCAGTA<br>CTGATTTGACATTCAGTGTCAAAAGCAGCAGAGGCTCTTCTGACCCCCAAGGGGTG<br>ACGTGCGGAGCTGCTACACTCTCTGCAGAGAGAGTCAGAGGGGACAACAAGGAGTA<br>TGAGTACTCAGTGGAGTGCCAGGAGGACAGTGCCTGCCCAGCTGCTGAGGAGAGTC<br>TGCCCATTGAGGTCATGGTGGATGCCGTTCACAAGCTCAAGTATGAAAACTACACC<br>AGCAGCTTCTTCATCAGGGACATCATCAAACCTGACCCACCCAAGAACTTGCAGCT<br>GAAGCCATTAAAGAATTCTCGGCAGGTGGAGGTCAGCTGGGAGTACCCTGACACCT<br>GGAGTACTCCACATTCCTACTTCTCCCTGACATTCTGCGTTCAGGTCCAGGGCAAG<br>AGCAAGAGAGAAAAGAAAGATAGAGTCTTCACGGACAAGACCTCAGCCACGGTCAT<br>CTGCCGCAAAAATGCCAGCATTAGCGTGCGGGCCCAGGACCGCTACTATAGCTCAT<br>CTTGGAGCGAATGGGCATCTGTGCCCTGCAGT | Underlined nucleobases indicate region encoding the signal peptide (1-66) |
| 981 | IL23A, Interleukin-23 subunit alpha, wt. Protein sequence. | MLGSRAVMLLLLLPWTAQGRAVPGGSSPAWTQCQQLSQKLCTLAWSAHPLVGHMDL<br>REEGDEETTNDVPHIQCGDGCDPQGLRDNSQFCLQRIHQGLIFYEKLLGSDIFTGE<br>PSLLPDSPVGQLHASLLGLSQLDQpEGHHWETQQIPSLSPSQPWQRLLLRFKILRS<br>LQAFVAVAARVFAHGAATLSP | Signal peptide is underlined. |
| 982 | IL23A, Interleukin-23 subunit alpha, wt. Nucleic acid sequence. | ATGCTGGGGAGCAGAGCTGTAATGCTGCTGTTGCTGCTGCCCTGGACAGCTCAGGG<br>CAGAGCTGTGCCTGGGGGCAGCAGCCCTGCCTGGACTCAGTGCCAGCAGCTTTCAC<br>AGAAGCTCTGCACACTGGCCTGGAGTGCACATCCACTAGTGGGACACATGGATCTA<br>AGAGAAGAGGGAGATGAAGAGACTACAAATGATGTTCCCCATATCCAGTGTGGAGA<br>TGGCTGTGACCCCCAAGGACTCAGGGACAACAGTCAGTTCTGCTTGCAAAGGATCC<br>ACCAGGGTCTGATTTTTTATGAGAAGCTGCTAGGATCGGATATTTTCACAGGGGAG<br>CCTTCTCTGCTCCCTGATAGCCCTGTGGGCCAGCTTCATGCCTCCCTACTGGGCCT<br>CAGCCAACTCCTGCAGCCTGAGGGTCACCACTGGGAGACTCAGCAGATTCCAAGCC<br>TCAGTCCCAGCCAGCCATGGCAGCGTCTCCTTCTCCGCTTCAAAATCCTTCGCAGC<br>CTCCAGGCCTTTGTGGCTGTAGCCGCCCGGGTCTTTGCCCATGGAGCAGCAACCCT<br>GAGTCCC | Underlined nucleobases indicate region encoding the signal peptide (1-66) |

TABLE 12 -continued

Sequences of IL23 polypeptides and IL23 polynucleotides

| SEQ ID NO | Description | Sequence | Comments |
|---|---|---|---|
| 983 | Human IL12B-Linker-IL23A Fusion Protein Protein sequence | *MCHQQLVISWFSLVFLASPLVA*IWELKKDVYVVELDWYPDAPGEMVVLTCDTPEED<br>GITWTLDQSSEVLGSGKTLTIQVKEFGDAGQYTCHKGGEVLSHSLLLLHKKEDGIW<br>STDILKDQKEPKNKTFLRCEAKNYSGRFTCWWLTTISTDLTFSVKSSRGSSDPQGV<br>TCGAATLSAERVRGDNKEYEYSVECQEDSACPAAEESLPIEVMVDAVHKLKYENYT<br>SSFFIRDIIKPDPPKNLQLKPLKNSRQVEVSWEYPDTWSTPHSYFSDTFCVQVQGK<br>SKREKKDRVFTDKTSATVICRKNASISVRAQDRYYSSSWSEWASVPCS**GGGGGGS**R<br>AVPGGSSPAWTQCQQLSQKLCTLAWSAHPLVGHMDLREEGDEETTNDVPHIQCGDG<br>CDPQGLRDNSQFCLQRIHQGLIFYEKLLGSDIFTGEPSLLPDSPVGQLHASLLGLS<br>QLLQPEGHHWETQQIPSLSPSQPWQRLLLRFKILRSLQAFVAVAARVFAHGAATLS<br>P | Signal peptide (1-22), italicized; IL12B mature chain (23-328), underlined; FS linker (329-335), bold; IL23A mature chain (336-505), dotted underline |
| 984 | Human IL12B-Linker-IL23A Fusion Protein. Nucleic acid sequence. | ATGTGTCACCAGCAGTTGGTCATCTCTTGGTTTTCCCTGGTTTTTCTGGCATCTCC<br>CCTCGTGGCCATATGGGAACTGAAGAAAGATGTTTATGTCGTAGAATTGGATTGGT<br>ATCCGGATGCCCCTGGAGAAATGGTGGTCCTCACCTGTGACACCCCTGAAGAAGAT<br>GGTATCACCTGGACCTTGGACCAGAGCAGTGAGGTCTTAGGCTCTGGCAAAACCCT<br>GACCATCCAAGTCAAAGAGTTTGGAGATGCTGGCCAGTACACCTGTCACAAAGGAG<br>GCGAGGTTCTAAGCCATTCGCTCCTGCTGCTTCACAAAAAGGAAGATGGAATTTGG<br>TCCACTGATATTTTAAAGGACCAGAAAGAACCCAAAAATAAGACCTTTCTAAGATG<br>CGAGGCCAAGAATTATTCTGGACGTTTCACCTGCTGGTGGCTGACGACAATCAGTA<br>CTGATTTGACATTCAGTGTCAAAAGCAGCAGAGGCTCTTCTGACCCCCAAGGGGTG<br>ACGTGCGGAGCTGCTACACTCTCTGCAGAGAGAGTCAGAGGGGACAACAAGGAGTA<br>TGAGTACTCAGTGGAGTGCCAGGAGGACAGTGCCTGCCCAGCTGCTGAGGAGAGTC<br>TGCCCATTGAGGTCATGGTGGATGCCGTTCACAAGCTCAAGTATGAAAACTACACC<br>AGCAGCTTCTTCATCAGGGACATCATCAAACCTGACCCACCCAAGAACTTGCAGCT<br>GAAGCCATTAAAGAATTCTCGGCAGGTGGAGGTCAGCTGGGAGTACCCTGACACCT<br>GGAGTACTCCACATTCCTACTTCTCCCTGACATTCTGCGTTCAGGTCCAGGGCAAG<br>AGCAAGAGAGAAAAGAAAGATAGAGTCTTCACGGACAAGACCTCAGCCACGGTCAT<br>CTGCCGCAAAAATGCCAGCATTAGCGTGCGGGCCCAGGACCGCTACTATAGCTCAT<br>CTTGGAGCGAATGGGCATCTGTGCCCTGCAGTGGCGGCGGCGGCGGCGGAAGCAGA<br>GCTGTGCCTGGGGGCAGCAGCCCTGCCTGGACTCAGTGCCAGCAGCTTTCACAGAA<br>GCTCTGCACACTGGCCTGGAGTGCACATCCACTAGTGGGACACATGGATCTAAGAG<br>AAGAGGGAGATGAAGAGACTACAAATGATGTTCCCCATATCCAGTGTGGAGATGGC<br>TGTGACCCCCAAGGACTCAGGGACAACAGTCAGTTCTGCTTGCAAAGGATCCACCA<br>GGGTCTGATTTTTTATGAGAAGCTGCTAGGATCGGATATTTTCACAGGGGAGCCTT<br>CTCTGCTCCCTGATAGCCCTGTGGGCCAGCTTCATGCCTCCCTACTGGGCCTCAGC<br>CAACTCCTGCAGCCTGAGGGTCACCACTGGGAGACTCAGCAGATTCCAAGCCTCAG<br>TCCCAGCCAGCCATGGCAGCGTCTCCTTCTCCGCTTCAAAATCCTTCGCAGCCTCC<br>AGGCCTTTGTGGCTGTAGCCGCCCGGGTCTTTGCCCATGGAGCAGCAACCCTGAGT<br>CCC | Underlined nucleobases indicate region encoding the signal peptide (1-57) |

IL23 Polynucleotides and Open Reading Frames (ORFs):

In some embodiments, the present disclosure provides IL23 polynucleotides (e.g., a RNA, e.g., a mRNA) that comprise a nucleotide sequence (e.g., an ORF) encoding one or more IL12B and/or IL23A polypeptides. In some embodiments, the IL23 polynucleotide (e.g., a RNA, e.g., a mRNA) encodes a single IL23 polypeptide chain comprising an IL12B polypeptide and a IL23A polypeptide, which are fused directly or by a linker, wherein the IL12B polypeptide is selected from:

(i) the full-length IL12B polypeptide (e.g., having the same or essentially the same length as wild-type IL12B);

(ii) a functional fragment of the IL12B polypeptide (e.g., a truncated (e.g., deletion of carboxy, amino terminal, or internal regions) sequence shorter than an IL12B wild-type; but still retaining IL12B activity);

(iii) a variant thereof (e.g., full length or truncated IL12B polypeptide in which one or more amino acids have been replaced, e.g., variants that retain all or most of the IL12B activity of the polypeptide with respect to the wild-type IL12B); or (iv) a fusion protein comprising (i) a full-length 12B wild-type, a functional fragment or a variant thereof, and (ii) a heterologous protein; and/or wherein the IL23A is selected from:

(i) the full-length IL23A polypeptide (e.g., having the same or essentially the same length as wild-type IL23A);

(ii) a functional fragment of the IL23A polypeptide (e.g., a truncated (e.g., deletion of carboxy, amino terminal, or internal regions) sequence shorter than a IL23A wild-type; but still retaining IL23A activity);

(iii) a variant thereof (e.g., full length or truncated IL23A polypeptide in which one or more amino acids have been replaced, e.g., variants that retain all or most of the IL23A activity of the polypeptide with respect to the wild-type IL23A); or (iv) a fusion protein comprising (i) a full-length IL23A wild-type, a functional fragment or a variant thereof, and (ii) a heterologous protein.

In other embodiments, the IL23 polynucleotide (e.g., a RNA, e.g., a mRNA) encodes two polypeptide chains, the first chain comprising an IL12B polypeptide and the second chain comprising a IL23A polypeptide, wherein the IL12B polypeptide is selected from:

(i) the full-length IL12B polypeptide (e.g., having the same or essentially the same length as wild-type IL12B);

(ii) a functional fragment of the IL12B polypeptide (e.g., a truncated (e.g., deletion of carboxy, amino terminal, or internal regions) sequence shorter than an IL12B wild-type; but still retaining IL12B activity);

(iii) a variant thereof (e.g., full length or truncated IL12B polypeptide in which one or more amino acids have been replaced, e.g., variants that retain all or most of the IL12B activity of the polypeptide with respect to the wild-type IL12B); or (iv) a fusion protein comprising (i) a full-length 12B wild-type, a functional fragment or a variant thereof, and (ii) a heterologous protein; and/or wherein the IL23A is selected from:

(i) the full-length IL23A polypeptide (e.g., having the same or essentially the same length as wild-type IL23A);

(ii) a functional fragment of the IL23A polypeptide (e.g., a truncated (e.g., deletion of carboxy, amino terminal, or internal regions) sequence shorter than a IL23A wild-type; but still retaining IL23A activity);

(iii) a variant thereof (e.g., full length or truncated IL23A polypeptide in which one or more amino acids have been replaced, e.g., variants that retain all or most of the IL23A activity of the polypeptide with respect to the wild-type IL23A); or (iv) a fusion protein comprising (i) a full-length IL23A wild-type, a functional fragment or a variant thereof, and (ii) a heterologous protein.

In certain embodiments, the IL23 polynucleotide (e.g., a RNA, e.g., a mRNA) encodes a mammalian IL23 polypeptide, such as human IL23 polypeptide, a functional fragment or a variant thereof.

In some embodiments, the IL23 polynucleotide (e.g., a RNA, e.g., a mRNA) increases IL12B, IL23A, and/or IL23 protein expression levels and/or activity in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to IL12B, IL23A, and/or IL23 protein expression levels and/or activity in the cells prior to the administration of the IL23 polynucleotide. IL12B, IL23A, and/or IL23 protein expression levels and/or activity can be measured according to methods known in the art. In some embodiments, the IL23 polynucleotide is introduced to the cells in vitro. In some embodiments, the IL23 polynucleotide is introduced to the cells in vivo.

In some embodiments, the IL23 polynucleotide (e.g., a RNA, e.g., a mRNA) comprises a nucleotide sequence (e.g., an ORF) that encodes a wild-type human IL12B polypeptide (SEQ ID NO: 979), a wild-type human IL23A polypeptide (SEQ ID NO: 981), or a wild-type human single-chain IL23 polypeptide (SEQ ID NO: 983).

In some embodiments, the IL23 polynucleotide (e.g., a RNA, e.g., a mRNA) comprises a sequence optimized nucleic acid sequence, wherein the open reading frame (ORF) of the sequence optimized nucleic sequence is derived from a wild-type IL12B or a wild-type IL23A sequence.

In some embodiments, the IL23 polynucleotide (e.g., a RNA, e.g., a mRNA) comprises a nucleotide sequence encoding an IL12B polypeptide and/or an IL23A polypeptide having the full length sequence of human IL12B and/or IL23A polypeptide IL23 (i.e., including the initiator methionine). In mature human IL12B and/or IL23A, the initiator methionine and/or signal peptide can be removed to yield a "mature IL12B" and/or "mature IL23A" comprising amino acid residues of SEQ ID NO: 979 and SEQ ID NO: 981, respectively. The teachings of the present disclosure directed to the full sequence of human IL12B and/or IL23A are also applicable to the mature form of human IL12B and/or IL23A lacking the initiator methionine and/or signal peptide. Thus, in some embodiments, the IL23 polynucleotide (e.g., a RNA, e.g., a mRNA) comprises a nucleotide sequence (e.g., ORF) encoding IL12B and/or IL23A having the mature sequence of human IL12B and/or IL23A. In some embodiments, the IL23 polynucleotide (e.g., a RNA, e.g., a mRNA) comprising a nucleotide sequence (e.g., ORF) encoding IL12B and/or IL23A is sequence optimized.

In some embodiments, the IL23 polynucleotide (e.g., a RNA, e.g., a mRNA) comprises a nucleotide sequence (e.g., an ORF) encoding a mutant IL12B and/or IL23A polypeptide. In some embodiments, the IL23 polynucleotide (e.g., a RNA, e.g., a mRNA) comprises an ORF encoding an IL12B and/or IL23A polypeptide that comprises at least one point mutation in the IL12B and/or IL23A sequence and retains IL12B and/or IL23A activity. In some embodiments, the mutant IL12B and/or IL23A polypeptide has an IL12B and/or IL23A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL12B and/or IL23A activity of the corresponding wild-type IL12B and/or IL23A (i.e., the same IL12B and/or IL23A isoform but without the mutation(s)). In some embodiments, the IL23 polynucleotide (e.g., a RNA, e.g., a mRNA) comprising an ORF encoding a mutant IL12B and/or IL23A polypeptide is sequence optimized.

In some embodiments, the IL23 polynucleotide (e.g., a RNA, e.g., a mRNA) comprises a nucleotide sequence (e.g., an ORF) that encodes an IL12B and/or IL23A polypeptide with mutations that do not alter IL12B and/or IL23A activity. Such mutant IL12B and/or IL23A polypeptides can be referred to as function-neutral. In some embodiments, the IL23 polynucleotide comprises an ORF that encodes a mutant IL12B and/or IL23A polypeptide comprising one or more function-neutral point mutations.

In some embodiments, the mutant IL12B and/or IL23A polypeptide has higher IL12B and/or IL23A activity than the corresponding wild-type IL12B and/or IL23A. In some embodiments, the mutant IL12B and/or IL23A polypeptide has an IL12B and/or IL23A activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type IL12B and/or IL23A (i.e., the same IL12B and/or IL23A isoform but without the mutation(s)).

In some embodiments, the IL23 polynucleotide (e.g., a RNA, e.g., a mRNA) comprises a nucleotide sequence (e.g., an ORF) encoding a functional IL12B and/or IL23A fragment, e.g., where one or more fragments correspond to a polypeptide subsequence of a wild type IL12B and/or IL23A polypeptide and retain IL12B and/or IL23A activity. In some embodiments, the IL12B and/or IL23A fragment has an IL12B and/or IL23A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL12B and/or IL23A activity of the corresponding full length IL12B and/or IL23A. In some embodiments, the IL23 polynucleotide (e.g., a RNA, e.g., a mRNA) comprising an ORF encoding a functional IL12B and/or IL23A fragment is sequence optimized.

In some embodiments, the IL23 polynucleotide (e.g., a RNA, e.g., a mRNA) comprises a nucleotide sequence (e.g., an ORF) encoding an IL12B and/or IL23A fragment that has higher IL12B and/or IL23A enzymatic activity than the corresponding full length IL23. Thus, in some embodiments the IL12B and/or IL23A fragment has an IL12B and/or IL23A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the IL12B and/or IL23A activity of the corresponding full length IL12B and/or IL23A polypeptide.

In some embodiments, the IL 23 polynucleotide (e.g., a RNA, e.g., a mRNA) comprises a nucleotide sequence (e.g., an ORF) encoding an IL12B and/or IL23A fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type isoform 1, 2, 3, or 4 of IL12B and/or IL23A.

In some embodiments, the ORF encoding a IL23A polypeptide has:

(i) at least 91%, at least 92%, at least 93%, at least 94%, at least 95%, at least 96%, at least 97%, at least 98%, at least 99%, or 100% sequence identity to nucleotides 1006 to 1515 of IL23-CO05, IL23-CO18, IL23-CO07, IL23-CO15, IL23-CO20, or IL23-CO17;

(ii) at least 90%, at least 91%, at least 92%, at least 93%, at least 94%, at least 95%, at least 96%, at least 97%, at least 98%, at least 99%, or 100% sequence identity to nucleotides 1006 to 1515 of IL23-CO02, IL23-CO0 6, IL23-CO10, IL23-CO23, IL23-CO16, or IL23-CO21;

(iii) at least 89%, at least 90%, at least 91%, at least 92%, at least 93%, at least 94%, at least 95%, at least 96%, at least 97%, at least 98%, at least 99%, or 100% sequence identity to nucleotides 1006 to 1515 of IL23-CO01, IL23-CO24, IL23-CO13, or IL23-CO14;

(iv) at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006 to 1515 of IL23-CO3, IL23-CO11, IL23-CO12, IL23-CO04, IL23-CO25, or IL23-CO22; or (v) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006 to 1515 of IL23-CO09, IL23-CO19, or IL23-CO08;

In some embodiments, the ORF encoding an IL12B polypeptide has:

(i) at least 91%, at least 92%, at least 93%, at least 94%, at least 95%, at least 96%, at least 97%, at least 98%, at least 99%, or 100% sequence identity to nucleotides 67 to 984 of IL23-CO04, IL23-CO05, IL23-CO10, IL23-CO12, IL23-CO18, IL23-CO19, IL23-CO22, IL23-CO24, or IL23-CO25;

(ii) at least 90%, at least 91%, at least 92%, at least 93%, at least 94%, at least 95%, at least 96%, at least 97%, at least 98%, at least 99%, or 100% sequence identity to nucleotides 67 to 984 of IL23-CO01, IL23-CO02, IL23-CO20, IL23-CO21, or IL23-CO23;

(iii) at least 89%, at least 90%, at least 91%, at least 92%, at least 93%, at least 94%, at least 95%, at least 96%, at least 97%, at least 98%, at least 99%, or 100% sequence identity to nucleotides 67 to 984 of IL23-CO3, IL23-CO06, IL23-CO08, IL23-CO09, IL23-CO11, IL23-CO14, IL23-CO16, or IL23-CO17; or (iv) at least 88%, at least 89%, at least 90%, at least 91%, at least 92%, at least 93%, at least 94%, at least 95%, at least 96%, at least 97%, at least 98%, at least 99%, or 100% sequence identity to nucleotides 67 to 984 of IL23-CO07, IL23-CO13, or IL23-CO15.

In some embodiments, the IL23 polynucleotide (e.g., a RNA, e.g., a mRNA) comprises a nucleotide sequence (e.g., an ORF) encoding an IL12B and/or IL23A polypeptide (e.g., the wild-type sequence, functional fragment, or variant thereof), wherein the % $U_{TM}$ or % $T_{TM}$ of the nucleotide sequence is between about 100% and about 190% or any one of the ranges disclosed herein and wherein the nucleotide sequence has at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 985-1009. See TABLE 13.

In some embodiments, the IL23 polynucleotide (e.g., a RNA, e.g., a mRNA) comprises a nucleotide sequence (e.g., an ORF) encoding an IL12B and/or IL23A polypeptide (e.g., the wild-type sequence, functional fragment, or variant thereof), wherein the % $U_{TM}$ or % $T_{TM}$ of the nucleotide sequence is between about 100% and about 190% or any one of the ranges disclosed herein and wherein the nucleotide sequence has 70% to 100%, 75% to 100%, 80% to 100%, 85% to 100%, 70% to 95%, 80% to 95%, 70% to 85%, 75% to 90%, 80% to 95%, 70% to 75%, 75% to 80%, 80% to 85%, 85% to 90%, 90% to 95%, or 95% to 100%, sequence identity to a sequence selected from the group consisting of SEQ ID NOs: 985-1009. See TABLE 13.

In some embodiments, the IL23 polynucleotide (e.g., a RNA, e.g., a mRNA) comprises a nucleotide sequence (e.g., an ORF) encoding an IL12B and/or IL23A polypeptide (e.g., the wild-type sequence, functional fragment, or variant thereof), wherein the % $U_{TM}$ or % $T_{TM}$ of the nucleotide sequence is between about 100% and about 190% or any one of the ranges disclosed herein and wherein the nucleotide sequence encodes an amino acid sequence having at least 75%, at least 76%, at least 77%, at least 78%, at least 79%, least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the sequence of SEQ ID NOs: 979, 981, or 983.

In some embodiments, the IL23 polynucleotide (e.g., a RNA, e.g., a mRNA) comprises from about 400 to about 100,000 nucleotides (e.g., from 400 to 1,000, from 400 to 1,100, from 400 to 1,200, from 400 to 1,300, from 400 to 1,400, from 400 to 1,500, from 500 to 1,100, from 500 to 1,100, from 500 to 1,200, from 500 to 1,300, from 500 to 1,400, from 500 to 1,500, from 567 to 1,200, from 567 to 1,400, from 567 to 1,600, from 567 to 1,800, from 567 to 2,000, from 567 to 3,000, from 567 to 5,000, from 567 to 7,000, from 567 to 10,000, from 567 to 25,000, from 567 to 50,000, from 567 to 70,000, or from 567 to 100,000).

In some embodiments, the IL23 polynucleotide (e.g., a RNA, e.g., a mRNA) comprises a nucleotide sequence (e.g., an ORF) encoding an IL12B and/or IL23A polypeptide (e.g., the wild-type sequence, functional fragment, or variant thereof), wherein the length of the nucleotide sequence (e.g., an ORF) is at least 400 nucleotides in length (e.g., at least or greater than about 400, 500, 600, 700, 80, 900, 1,000, 1,050, 1,083, 1,100, 1,200, 1,300, 1,400, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IL23 polynucleotide (e.g., a RNA, e.g., a mRNA) comprises a nucleotide sequence (e.g., an ORF) encoding an IL12B and/or IL23A polypeptide (e.g., the wild-type sequence, functional fragment, or variant thereof) further comprises at least one nucleic acid sequence that is noncoding, e.g., a miRNA binding site.

In some embodiments, the IL23 polynucleotide (e.g., a RNA, e.g., a mRNA) comprises a nucleotide sequence (e.g., an ORF) encoding an IL12B and/or IL23A polypeptide is single stranded or double stranded.

In some embodiments, the 1123 polynucleotide comprising a nucleotide sequence (e.g., an ORF) encoding an IL12B and/or IL23A polypeptide (e.g., the wild-type sequence, functional fragment, or variant thereof) is DNA or RNA. In some embodiments, the IL23 polynucleotide is RNA. In some embodiments, the polynucleotide of the disclosure is, or functions as, a messenger RNA (mRNA). In some embodiments, the mRNA comprises a nucleotide sequence (e.g., an ORF) that encodes at least one IL12B and/or IL23A polypeptide, and is capable of being translated to produce the encoded IL12B and/or IL23A polypeptide in vitro, in vivo, in situ or ex vivo.

In some embodiments, the IL23 polynucleotide (e.g., a RNA, e.g., a mRNA) comprises a sequence-optimized nucleotide sequence (e.g., an ORF) encoding an IL12B and/or IL23A polypeptide (e.g., the wild-type sequence, functional fragment, or variant thereof), wherein the polynucleotide comprises at least one chemically modified nucleobase, e.g., 5-methoxyuracil. In some embodiments, the polynucleotide further comprises a miRNA binding site, e.g., a miRNA binding site that binds to miR-122. In some embodiments, the polynucleotide disclosed herein is formulated with a delivery agent, e.g., a compound having Formula (I), e.g., any of Compounds 1-147.

The IL23 polynucleotide (e.g., a RNA, e.g., a mRNA) can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the IL23 polynucleotide (e.g., a RNA, e.g., a mRNA) comprises a nucleotide sequence (e.g., an ORF) that encodes a signal peptide operably linked a nucleotide sequence that encodes an IL12B and/or IL23A polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the IL23 polypeptide, respectively. Addition of these sequences results in trafficking the encoded IL23 polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the IL23 polynucleotide comprises a nucleotide sequence encoding an IL12B and/or IL23A polypeptide, wherein the nucleotide sequence further comprises a 5' nucleic acid sequence encoding a native signal peptide. In another embodiment, the polynucleotide of the disclosure comprises a nucleotide sequence encoding an IL12B and/or IL23A polypeptide, wherein the nucleotide sequence lacks the nucleic acid sequence encoding a native signal peptide. In some embodiments, the IL23 polynucleotide comprises a nucleotide sequence encoding an IL12B and/or IL23A polypeptide, wherein the nucleotide sequence further comprises a 5' nucleic acid sequence encoding a heterologous signal peptide.

Chimeric IL23 Polypeptides:

In some embodiments, the IL23 polynucleotide (e.g., a RNA, e.g., a mRNA) can comprise more than one nucleic acid sequence (e.g., an ORF) encoding a polypeptide of interest. In some embodiments, the IL23 polynucleotide comprises a single ORF encoding an IL12B and/or IL23A polypeptide, a functional fragment, or a variant thereof. However, in some embodiments, the IL23 polynucleotide can comprise more than one ORF, for example, a first ORF encoding an IL12B polypeptide (a first polypeptide of interest), a functional fragment, or a variant thereof, a second ORF encoding a IL23A polypeptide (a second polypeptide of interest), a functional fragment, or a variant thereof, and a third ORF expressing a third polypeptide of interest (e.g., a polypeptide heterologous to IL12B and/of IL23A). In one embodiment, the third polypeptide of interest can be fused to the IL12B polypeptide directly or by a linker. In another embodiment, the third polypeptide of interest can be fused to the IL23A polypeptide directly or by a linker. In other embodiments, the third polypeptide of interest can be fused to both the IL12B polypeptide and the IL23A polypeptide directly or by a linker.

In further embodiments, the IL23 polynucleotide can comprise more than three ORFs, for example, a first ORF encoding an IL12B polypeptide (a first polypeptide of interest), a functional fragment, or a variant thereof, a second ORF encoding a IL23A polypeptide (a second polypeptide of interest), a functional fragment, or a variant thereof, a third ORF expressing a third polypeptide of interest, and a fourth ORF expressing a fourth polypeptide of interest. In other embodiments, the third polypeptide of interest is fused to the IL23A polypeptide directly or by a linker, and the fourth polypeptide of interest is fused to the IL12B polypeptide directly or by a linker.

In some embodiments, two or more polypeptides of interest can be genetically fused, i.e., two or more polypeptides can be encoded by the same ORF. In some embodiments, the IL23 polynucleotide can comprise a nucleic acid sequence encoding a linker (e.g., a $G_4S$ peptide linker or another linker known in the art) between two or more polypeptides of interest.

In some embodiments, the IL23 polynucleotide (e.g., a RNA, e.g., a mRNA) can comprise two, three, four, or more ORFs, each expressing a polypeptide of interest.

In some embodiments, the IL23 polynucleotide (e.g., a RNA, e.g., a mRNA) can comprise a first nucleic acid sequence (e.g., a first ORF) encoding an IL12B polypeptide, IL23A polypeptide, both IL12B and IL23A polypeptides and a second nucleic acid sequence (e.g., a second ORF) encoding a second polypeptide of interest.

Linkers in IL23 Polypeptides:

In some embodiments, the IL12B and/or IL23A in an IL23 polypeptide can be fused directly or by a linker. In other embodiments, the IL12B and/or IL23A can be fused directly to by a linker to a heterologous polypeptide. The linkers suitable for fusing the IL12B to IL23A or the IL12B and/or IL23A to a heterologous polypeptide can be a polypeptide (or peptide) moiety or a non-polypeptide moiety. In some embodiments, the linker is a peptide linker, including from one amino acid to about 200 amino acids. In some embodiments, the linker comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, or at least 40 amino acids.

In some embodiments, the linker can be GS (Gly/Ser) linkers, for example, comprising $(G_nS)_m$, wherein n is an integer from 1 to 20 and m is an integer from 1 to 20. In some embodiments, the GS linker can comprise $(GGGGS)_o$(SEQ ID NO: 1010), wherein o is an integer from 1 to 5. In some embodiments, the GS linker can comprise GGSGGGGSGG (SEQ ID NO: 1011), GGSGGGGG (SEQ ID NO: 1012), or GSGSGSGS (SEQ ID NO: 1013). In a particular embodiment, the linker is $G_6S$ (GGGGGGS) (SEQ ID NO: 1014).

In some embodiments, the linker can be a Gly-rich linker, for example, comprising $(Gly)_p$, wherein p is an integer from 1 to 40. In some embodiments, a Gly-rich linker can comprise GGGGG (SEQ ID NO:1015), GGGGGG (SEQ ID NO:1016), GGGGGGG (SEQ ID NO:1017) or GGGGGGGG (SEQ ID NO:1018).

In some embodiments, the linker can comprise $(EAAAK)_q$ (SEQ ID NO:1019), wherein q is an integer from 1 to 5. In one embodiment, the linker can comprise $(EAAAK)_3$, i.e., EAAAKEAAAKEAAAK (SEQ ID NO:1020).

Further exemplary linkers include, but not limited to, GGGGSLVPRGSGGGGS (SEQ ID NO:1021), GSGSGS (SEQ ID NO:1022), GGGGSLVPRGSGGGG (SEQ ID NO:1023), GGSGGHMGSGG (SEQ ID NO:1024), GGSGGSGGSGG (SEQ ID NO:1025), GGSGG (SEQ ID NO:1026), GSGSGSGS (SEQ ID NO:1027), GGGSEGGGSEGGGSEGGG (SEQ ID NO:1028), AAGAATAA (SEQ ID NO:1029), GGSSG (SEQ ID NO:1030), GSGGGTGGGSG (SEQ ID NO:1031), GSGSGSGSGGSG (SEQ ID NO:1032), GSGGSGSGGSGGSG (SEQ ID NO:1033), and GSGGSGGSGGSGGS (SEQ ID NO:1034).

Nucleotides encoding the linkers disclosed herein can be constructed to fuse the ORF or ORFs of an IL23 polynucleotide disclosed herein.

Sequence-Optimized Nucleotide Sequences Encoding IL12B Polypeptide, IL23A Polypeptide, or a Single-Chain IL23 Polypeptide:

In some embodiments, the IL23 polynucleotide (e.g., a RNA, e.g., a mRNA) is sequence optimized. In some embodiments, the 1123 polynucleotide (e.g., a RNA, e.g., a mRNA) comprises a nucleotide sequence (e.g., an ORF) encoding an IL12B and/or IL23A polypeptide, a nucleotide sequence (e.g, an ORF) encoding another polypeptide of interest, a 5'-UTR, a 3'-UTR, a miRNA, a nucleotide sequence encoding a linker, or any combination thereof) that is sequence optimized.

A sequence-optimized nucleotide sequence, e.g., an codon-optimized mRNA sequence encoding an IL12B and/or IL23A polypeptide, is a sequence comprising at least one synonymous nucleobase substitution with respect to a reference sequence (e.g., a wild type nucleotide sequence encoding an IL12B and/or IL23A polypeptide).

In some embodiments, the IL23 polynucleotide comprises a sequence-optimized nucleotide sequence encoding an IL12B and/or IL23A polypeptide disclosed herein. In some embodiments, the IL23 polynucleotide comprises an open reading frame (ORF) encoding an IL12B and/or IL23A polypeptide, wherein the ORF has been sequence optimized.

In some embodiments, the IL23 polynucleotide comprises a sequence-optimized nucleotide sequence encoding a single-chain IL23 polypeptide disclosed herein. In some embodiments, the IL23 polynucleotide comprises an open reading frame (ORF) encoding a single-chain IL23 polypeptide, wherein the ORF has been sequence optimized.

Exemplary sequence-optimized nucleotide sequences encoding human IL12B and/or IL23A polypeptide are shown in TABLE 13. In some embodiments, the sequence optimized IL12B and/or IL23A sequences in TABLE 13, fragments, and variants thereof are used to practice the methods disclosed herein. In some embodiments, the sequence optimized IL12B and/or IL23A sequences in TABLE 13, fragments and variants thereof are combined with or alternatives to the wild-type sequence disclosed in TABLE 12.

TABLE 13

Sequence optimized sequences for human IL23 single-chain polypeptide

| SEQ ID NO | Name | Sequence |
|---|---|---|
| 985 | IL23-C001 | ATGTGCCACCAGCAGCTCGTCATCAGCTGGTTCAGCCTCGTCTTCCTCGCCTCCCCGCTCGTCG<br>CCATCTGGGAGCTCAAGAAAGACGTGTACGTCGTAGAGCTCGACTGGTACCCCGACGCCCCCGG<br>GGAGATGGTCGTCCTCACCTGCGATACCCCCGAGGAGGACGGCATCACCTGGACCCTCGACCAG<br>AGCAGCGAGGTTTTGGGGTCAGGCAAGACCCTCACGATCCAGGTAAAGGAGTTCGGCGACGCGG<br>GCCAGTACACCTGCCACAAGGGGGGAGAGGTTCTCTCCCACTCCCTGCTGCTGCTGCACAAGAA<br>GGAGGACGGCATCTGGTCCACCGATATCCTGAAGGACCAGAAAGAGCCCAAGAACAAGACCTTT<br>CTGAGGTGCGAGGCCAAGAACTACAGCGGCAGGTTCACCTGTTGGTGGCTGACCACTATCAGCA<br>CCGACCTGACCTTCTCGGTGAAAAGCTCGAGGGGCAGCAGCGACCCCCAGGGGGTCACGTGCGG<br>CGCCGCGACACTCTCCGCCGAGAGGGTGAGGGGCGACAATAAAGAGTACGAGTACAGCGTGGAG<br>TGCCAGGAGGACTCCGCCTGTCCGGCCGCGGAGGAGAGCCTGCCCATAGAGGTGATGGTGGACG<br>CCGTGCACAAGCTGAAGTACGAAAACTACACCAGCAGCTTCTTCATTCGGGACATCATCAAGCC |

TABLE 13-continued

Sequence optimized sequences for human IL23 single-chain polypeptide

| SEQ ID NO | Name | Sequence |
|---|---|---|
| | | CGACCCGCCCAAGAACCTGCAGCTGAAACCCCTGAAGAACAGCCGGCAGGTGGAGGTGAGCTGG |
| | | GAGTACCCCGACACCTGGAGCACCCCCCACAGCTACTTCTCCCTGACATTCTGCGTCCAGGTGC |
| | | AGGGGAAGTCAAAAAGGGAGAAGAAAGACCGGGTGTTCACCGACAAGACCAGCGCCACCGTGAT |
| | | ATGCAGGAAGAACGCCAGCATAAGCGTGAGGGCCCAGGATAGGTATTACAGCTCCAGCTGGAGC |
| | | GAATGGGCCTCCGTCCCCTGCTCAGGCGGCGGCGGCGGAAGCAGGGCGGTGCCCGGAGGCA |
| | | GCTCTCCCGCGTGGACCCAGTGTCAGCAGCTGTCCCAGAAGCTGTGCACCCTGGCCTGGAGCGC |
| | | TCACCCCCTGGTCGGGCACATGGACCTGCGCGAAGAGGGGGACGAGGAGACTACCAATGATGTG |
| | | CCCCACATCCAGTGCGGCGACGGCTGCGACCCCCAGGGGCTTCGGGACAACTCCCAATTTTGTC |
| | | TTCAGAGGATCCACCAGGGGCTCATATTCTACGAGAAACTGCTGGGGAGCGACATATTCACCGG |
| | | AGAACCCAGCCTGCTGCCAGACAGCCCCGTGGGCCAGCTGCATGCTAGCCTGCTGGGGCTGAGC |
| | | CAGCTGCTGCAGCCGGAGGGGCACCACTGGGAGACGCAGCAGATCCCCAGCCTGTCGCCCAGCC |
| | | AGCCCTGGCAGAGGCTTCTGCTGCGCTTCAAGATCCTGCGAAGCCTGCAGGCCTTCGTGGCGGT |
| | | GGCCGCGAGGGTGTTCGCGCACGGCGCCGCCACCCTGAGCCCG |
| 986 | IL23-CO02 | ATGTGCCATCAGCAGTTGGTAATCAGCTGGTTCTCCCTTGTCTTCCTCGCCAGCCCGCTCGTCG |
| | | CCATCTGGGAGCTCAAGAAGGACGTGTACGTTGTCGAGCTCGATTGGTACCCCGACGCCCCCGG |
| | | CGAGATGGTCGTCCTCACTTGCGACACCCCCGAGGAGGACGGGATCACCTGGACGCTTGACCAG |
| | | TCCTCCGAGGTCCTCGGGAGCGGCAAGACCCTCACCATCCAGGTCAAGGAGTTCGGGGACGCGG |
| | | GGCAATACACCTGCCACAAAGGGGGCGAGGTTCTCAGCCACAGCCTGCTGCTGCTGCATAAGAA |
| | | GGAGGACGGCATCTGGTCCACGGACATCCTGAAGGACCAGAAAGAGCCCAAGAACAAGACTTTC |
| | | CTCAGGTGCGAGGCCAAGAACTACAGCGGCCGGTTTACCTGCTGGTGGCTGACCACCATCTCAA |
| | | CCGACCTCACCTTCAGCGTGAAAAGCAGCCGGGGCTCATCCGACCCCCAGGGCGTGACCTGCGG |
| | | CGCCGCCACCCTGAGCGCCGAAAGGGTGCGGGGCGACAACAAAGAGTACGAGTACAGCGTCGAG |
| | | TGCCAGGAAGACTCCGCCTGTCCCGCCGCCGAAGAGAGCCTGCCCATCGAGGTGATGGTGGACG |
| | | CGGTCCACAAGCTGAAGTACGAGAACTACACCTCGAGCTTCTTCATTCGGGATATCATCAAGCC |
| | | CGATCCCCCTAAGAACCTGCAGCTGAAGCCCCTGAAGAACAGCCGCCAGGTGGAGGTGTCCTGG |
| | | GAGTACCCGGACACATGGTCCACGCCCCACTCCTATTTCAGCCTGACCTTCTGCGTGCAGGTGC |
| | | AGGGAAAGAGCAAGAGGGAGAAAAAGGACAGGGTGTTCACCGACAAGACCAGCGCCACCGTGAT |
| | | CTGCCGGAAGAACGCCTCGATCAGCGTGCGCGCCCAGGACCGGTACTACTCCTCCAGCTGGAGC |
| | | GAGTGGGCCAGCGTGCCGTGCTCAGGGGGCGGCGGGGGCGGGAGCAGGGCCGTTCCAGGCGGTA |
| | | GCTCACCAGCGTGGACCCAGTGCCAGCAGCTGTCCCAGAAGCTGTGCACCCTGGCCTGGAGCGC |
| | | CCACCCCCTGGTCGGGCACATGGACCTGAGGGAGGAGGGCGACGAGGAGACTACCAACGACGTG |
| | | CCCCACATTCAGTGCGGCGACGGGTGCGACCCCCAGGGCTTGCGTGACAACTCCCAGTTCTGCC |
| | | TGCAGAGGATCCACCAGGGCCTGATCTTTTACGAGAAGCTGCTGGGCTCCGACATCTTCACCGG |
| | | GGAGCCCTCACTGCTGCCGGACAGCCCCGTCGGCCAGCTGCACGCCAGCCTCCTCGGTCTGAGC |
| | | CAACTGCTGCAGCCAGAGGGGCACCACTGGGAGACTCAGCAGATCCCCAGCCTGAGCCCCTCCC |
| | | AGCCCTGGCAGCGGCTGCTCCTGCGCTTCAAGATCCTGAGGAGCCTGCAGGCCTTCGTGGCCGT |
| | | GGCTGCCCGCGTGTTCGCGCACGGGGCCGCCACCCTGTCCCCC |
| 987 | IL23-CO03 | ATGTGCCACCAGCAGCTCGTTATAAGCTGGTTCAGCCTCGTCTTCCTCGCCTCCCCGTTGGTCG |
| | | CCATCTGGGAGCTCAAGAAAGACGTATACGTCGTCGAGTTGGACTGGTACCCCGACGCCCCCGG |
| | | CGAGATGGTCGTCCTCACGTGTGACACACCCGAAGAGGACGGCATCACGTGGACGCTCGACCAG |
| | | TCGAGCGAGGTCCTCGGCTCCGGCAAGACCCTCACCATCCAGGTCAAGGAGTTCGGCGACGCAG |
| | | GCCAGTATACCTGCCACAAGGGCGGGGAGGTCCTTAGCCACAGCCTGCTGCTGCTGCACAAGAA |
| | | GGAGGACGGGATCTGGTCCACCGACATTCTGAAGGACCAGAAGGAGCCTAAAAACAAGACCTTC |
| | | CTCCGGTGCGAGGCCAAGAATTACTCCGGGAGGTTCACCTGCTGGTGGTTGACCACCATCAGCA |
| | | CCGACCTGACCTTCTCCGTCAAGAGCTCAAGGGGCAGCTCCGACCCCCAGGGCGTGACCTGCGG |
| | | GGCCGCCACCCTGTCTGCGGAGAGGGTGCGCGGGGACAACAAAGAGTACGAGTACAGCGTGGAG |
| | | TGCCAGGAGGACTCCGCCTGTCCCGCCGCCGAAGAGAGCCTGCCCATCGAGGTGATGGTGGACG |
| | | CCGTGCATAAGCTGAAGTACGAAAATTACACCAGCAGCTTTTTCATAAGGGATATAATCAAGCC |
| | | CGATCCGCCCAAGAACCTCCAGCTGAAGCCGCTGAAGAACAGCAGGCAGGTGGAGGTCAGTTGG |
| | | GAGTATCCAGATACCTGGTCCACCCCCCACAGCTACTTCAGCCTGACCTTCTGCGTGCAGGTGC |
| | | AGGGCAAAAGCAAGAGGGAAAAGAAGGACAGGGTGTTCACCGACAAGACCAGCGCGACGGTCAT |
| | | CTGTAGGAAGAATGCCTCCATCAGCGTCCGCGCGCAGGACCGGTACTACAGCAGCAGCTGGTCA |
| | | GAGTGGGCCAGCGTGCCCTGCAGTGGCGGCGGAGGGGGAGGGAGTCGGGCCGTGCCGGGGGGCA |
| | | GTAGCCCCGCCTGGACACAGTGCCAGCAGCTGTCCCAAAAGCTGTGTACGCTGGCCTGGTCCGC |
| | | ACACCCCCTCGTGGGGCATATGGACCTGAGGGAGGAGGGGGACGAGGAGACTACCAACGATGTG |
| | | CCCCACATACAGTGCGGGGATGGCTGCGACCCGCAGGGCCTTCGCGACAATAGCCAGTTCTGCC |
| | | TGCAACGCATCCACCAGGGCCTGATCTTCTACGAGAAGCTGCTGGGATCGGACATCTTCACCGG |
| | | GGAGCCCAGCCTGCTGCCGGACTCCCCCGTGGGGCAACTGCACGCCAGCCTGCTGGGCCTGTCA |
| | | CAACTGCTCCAGCCCGAGGGGCACCATTGGGAGACTCAACAGATCCCCAGCCTGAGCCCCAGCC |
| | | AGCCCTGGCAGAGGCTCCTGCTGAGGTTCAAAATCCTGCGTAGCCTGCAGGCCTTCGTGGCCGT |
| | | GGCCGCCAGGGTCTTCGCCCACGGCGCCGCCACCCTGTCCCCA |
| 988 | IL23-CO04 | ATGTGCCACCAGCAGCTCGTAATCAGCTGGTTTTCCCTAGTCTTCCTCGCCAGCCCGCTAGTCG |
| | | CCATTTGGGAGCTCAAGAAGGACGTCTACGTAGTCGAGCTCGATTGGTATCCCGACGCTCCGGG |
| | | CGAGATGGTCGTGCTCACTTGTGACACTCCCGAGGAGGACGGCATCACCTGGACTCTCGATCAG |
| | | AGCTCCGAAGTCCTTGGGAGCGGCAAGACCCTTACCATCCAGGTCAAGGAGTTCGGCGACGCCG |
| | | GCCAGTACACCTGCCACAAAGGGGGCGAGGTCCTCAGCCACAGCCTGCTGCTGCTCCATAAGAA |
| | | GGAGGACGGCATCTGGTCCACCGACATCCTGAAGGACCAGAAGGAACCCAAGAACAAGACCTTC |
| | | CTGAGGTGCGAAGCCAAGAACTACAGCGGCCGGTTCACCTGCTGGTGGCTGACCACCATCTCTA |
| | | CGGACCTGACCTTCTCCGTGAAAAGCAGCAGGGGCTCCTCCGACCCGCAGGGCGTGACCTGCGG |
| | | CGCCGCCACCCTCAGCGCCGAGAGGGTGAGGGGCGACAACAAAGAGTACGAGTACAGCGTGGAA |
| | | TGCCAGGAGGACAGCGCCTGCCCCGCCGCCGAGGAGAGCCTGCCGATCGAGGTGATGGTGGACG |
| | | CCGTGCACAAGCTGAAGTACGAAAACTACACCTCCTCCTTCTTCATCAGGGACATCATCAAACC |

TABLE 13-continued

Sequence optimized sequences for human IL23 single-chain polypeptide

| SEQ ID NO | Name | Sequence |
|---|---|---|
| | | CGACCCGCCCAAGAACCTGCAACTCAAGCCCCTGAAGAACTCCAGGCAGGTGGAGGTGTCATGG |
| | | GAGTACCCCGACACCTGGAGCACCCCCCACAGCTACTTCAGCCTCACGTTTTGCGTGCAGGTAC |
| | | AGGGCAAAAGCAAGAGGGAGAAGAAGGATAGGGTGTTCACCGATAAAACCTCCGCCACCGTGAT |
| | | CTGCAGAAAGAACGCCAGCATAAGCGTGCGGGCCCAGGACAGGTACTACAGCTCCAGCTGGAGC |
| | | GAGTGGGCCAGCGTGCCCTGCAGCGGGGGCGGAGGGGGTGGGTCCCGCGCCGTGCCAGGTGGGA |
| | | GCAGCCCCGCTTGGACTCAGTGCCAGCAGCTGAGCCAAAAGCTGTGCACCCTCGCGTGGTCCGC |
| | | CCACCCGCTGGTGGGCCATATGGATCTGAGGGAGGAGGGGGACGAAGAGACTACCAACGACGTC |
| | | CCCCACATCCAATGCGGTGATGGGTGCGACCCCCAGGGCCTGCGGGACAACTCCCAGTTCTGCC |
| | | TTCAGAGGATCCACCAGGGCTTGATCTTTTACGAGAAACTGCTGGGAAGCGACATCTTCACCGG |
| | | CGAACCCAGCCTGCTGCCCGACTCCCCCGTGGGGCAGCTGCACGCGAGCCTGCTGGGGCTGAGC |
| | | CAGCTGCTGCAGCCCGAGGGCCACCATTGGGAGACTCAGCAGATCCCCAGCCTGAGTCCCAGCC |
| | | AGCCGTGGCAGCGGCTGCTGCTGCGATTCAAGATCCTGAGGTCGCTACAGGCCTTTGTGGCCGT |
| | | GGCGGCCAGGGTGTTCGCCCATGGCGCAGCCACCCTCTCCCCC |
| 989 | IL23-CO05 | ATGTGCCACCAGCAATTGGTCATCTCCTGGTTCAGCCTCGTCTTCCTCGCGAGCCCCCTCGTAG |
| | | CCATCTGGGAGCTAAAGAAGGACGTCTACGTCGTCGAGCTCGACTGGTACCCCGACGCCCCCGG |
| | | GGAGATGGTCGTCCTCACCTGCGACACCCCGGAGGAGGACGGCATCACGTGGACCCTCGACCAA |
| | | TCGTCCGAGGTTCTCGGGTCCGGCAAGACCCTCACCATCCAAGTCAAGGAGTTCGGCGACGCGG |
| | | GCCAGTACACCTGCCACAAGGGCGGGGAGGTCCTCAGCCACTCGCTCCTGCTGCTCCACAAGAA |
| | | AGAGGACGGCATCTGGAGCACGGACATCCTGAAGGACCAGAAGGAGCCCAAGAACAAGACCTTC |
| | | CTGCGCTGCGAGGCCAAGAACTACAGCGGGAGGTTCACCTGCTGGTGGCTCACCACAATCAGCA |
| | | CCGACCTCACCTTCAGCGTGAAAAGCAGCCGCGGCAGCAGCGATCCACAGGGGGTGACCTGCGG |
| | | CGCCGCCACCCTGAGCGCCGAGAGGGTGCGGGGAGACAACAAGGAGTACGAGTACAGCGTGGAG |
| | | TGCCAGGAGGACAGCGCCTGTCCGGCGGCCGAGGAGAGCCTGCCCATCGAGGTGATGGTGGACG |
| | | CCGTCCACAAGCTGAAGTACGAAAACTACACTTCCAGCTTCTTCATCCGGGATATCATCAAGCC |
| | | CGACCCGCCCAAAAACCTGCAGCTGAAGCCGCTGAAGAACAGCCGCCAGGTGGAGGTCAGCTGG |
| | | GAGTACCCCGACACCTGGAGCACCCCCCATAGCTACTTCTCCCTGACCTTCTGCGTGCAGGTGC |
| | | AGGGGAAGTCCAAGAGGGAGAAGAAGGACAGGGTGTTCACCGACAAAACCAGCGCCACGGTGAT |
| | | CTGCCGAAAGAACGCCAGCATCAGCGTGAGGGCCCAGGACCGCTACTATTCCTCCAGCTGGTCC |
| | | GAATGGGCGAGCGTGCCCTGCAGTGGCGGAGGAGGAGGCGGCAGCAGGGCCGTGCCCGGCGGCT |
| | | CCAGCCCCGCATGGACTCAGTGCCAGCAGCTGAGCCAGAAACTGTGCACGCTGGCCTGGAGCGC |
| | | CCATCCCCTGGTCGGGCATATGGACCTGAGGGAGGAGGGCGACGAAGAGACGACTAACGATGTG |
| | | CCCCACATCCAGTGCGGGGACGGTTGCGACCCCCAGGGCCTGCGGGACAACAGCCAGTTTTGCC |
| | | TCCAGCGGATCCACCAGGGCCTGATTTTTTACGAAAAGCTGCTGGGCAGCGACATCTTCACCGG |
| | | CGAGCCCAGCCTGCTGCCCGACAGCCCAGTGGGCCAACTGCACGCCTCCCTGCTCGGCCTGAGC |
| | | CAGCTGCTGCAGCCCGAGGGCCATCACTGGGAGACGCAGCAGATCCCCTCCCTGAGCCCCTCCC |
| | | AGCCCTGGCAGAGGCTCCTGCTGCGCTTCAAGATCCTGAGGAGCCTGCAGGCCTTCGTCGCCGT |
| | | GGCCGCCCGGGTGTTCGCCCACGGGGCCGCCACACTGAGCCCG |
| 990 | IL23-CO06 | ATGTGTCATCAGCAGCTCGTCATCAGCTGGTTCAGCCTTGTCTTCCTCGCGAGTCCCCTCGTAG |
| | | CCATCTGGGAACTCAAGAAGGACGTCTACGTCGTCGAGCTCGACTGGTACCCCGACGCCCCCGG |
| | | GGAGATGGTTGTCCTCACCTGCGACACGCCCGAGGAGGACGGCATCACGTGGACCCTCGACCAA |
| | | AGCTCCGAGGTCCTCGGGAGCGGCAAGACCCTCACAATCCAGGTCAAGGAGTTCGGCGACGCCG |
| | | GGCAGTACACGTGCCACAAGGGGGGCGAAGTCCTCAGCCACTCCCTGCTGCTGCTCCATAAGAA |
| | | GGAGGACGGGATATGGAGCACCGACATCCTAAAGGATCAGAAGGAGCCCAAAAACAAGACCTTC |
| | | CTCAGGTGTGAGGCCAAGAACTACAGCGGCCGTTTCACCTGCTGGTGGCTGACCACCATATCTA |
| | | CCGACCTGACCTTCAGCGTGAAAAGCAGCAGGGGCTCGAGCGACCCCCAGGGCGTGACGTGCGG |
| | | CGCCGCGACGCTGAGCGCCGAGCGCGTGCGGGGCGACAACAAGGAGTATGAATACTCCGTGGAA |
| | | TGCCAGGAGGATAGCGCCTGCCCGGCCGCGGAGGAGTCCCTCCCCATCGAGGTGATGGTGGACG |
| | | CCGTCCACAAGCTGAAGTATGAGAATTACACCAGCAGCTTCTTCATCCGCGACATCATCAAGCC |
| | | GGACCCACCCAAGAATCTGCAGCTGAAACCGCTCAAGAACTCCAGGCAGGTGGAGGTGTCCTGG |
| | | GAGTATCCCGACACATGGTCCACGCCCCACAGCTACTTCTCCCTGACGTTCTGTGTACAAGTGC |
| | | AGGGCAAGTCCAAAAGGGAGAAAAAGGACAGGGTGTTCACCGACAAGACCTCCGCCACCGTGAT |
| | | CTGCAGGAAGAACGCCAGCATCAGCGTTCGCGCCCAGGACCGCTACTACTCCAGCTCATGGAGT |
| | | GAATGGGCCTCCGTCCCCTGCAGCGGAGGCGGAGGCGGCGGAAGCCGAGCCGTGCCCGGCGGGT |
| | | CCAGTCCCGCCTGGACCCAGTGCCAGCAACTGAGCCAAAAGCTGTGCACCCTGGCGTGGTCCGC |
| | | CCACCCCCTGGTGGGCCACATGGACCTGCGGGAGGAGGGTGACGAGGAGACGACCAACGACGTG |
| | | CCTCACATCCAGTGCGGTGACGGCTGTGACCCCCAGGGCCTGAGGGACAACAGCCAGTTCTGCC |
| | | TGCAGAGGATCCACCAAGGGCTGATCTTCTACGAGAAATTGCTGGGCAGCGACATCTTCACCGG |
| | | GGAACCCAGCCTGCTGCCCGACTCGCCCGTGGGCCAGCTGCATGCGTCCCTCCTGGGCCTGTCC |
| | | CAGCTGCTACAGCCCGAGGGCCATCATTGGGAGACGCAGCAGATCCCCTCCCTGAGCCCGAGCC |
| | | AACCCTGGCAGAGGCTGCTGCTCCGGTTCAAGATCCTGCGGTCCCTGCAGGCCTTCGTCGCCGT |
| | | GGCCGCCCGCGTGTTCGCCCACGGGGCCGCCACCCTGAGCCCC |
| 991 | IL23-CO07 | ATGTGCCACCAGCAGCTCGTAATCAGCTGGTTCTCGCTTGTATTCCTCGCCAGCCCCCTCGTTG |
| | | CCATCTGGGAGCTCAAGAAGGACGTATACGTCGTAGAGCTCGACTGGTATCCCGACGCCCCCGG |
| | | GGAGATGGTGGTCCTCACCTGTGACACCCCCGAGGAGGACGGCATCACCTGGACCCTCGACCAA |
| | | AGCTCCGAGGTCCTCGGGTCCGGCAAGACCCTCACCATCCAGGTCAAGGAATTCGGAGACGCCG |
| | | GCCAGTACACCTGCCACAAAGGCGGCGAGGTACTCTCCCATTCCCTGCTCCTGCTGCATAAGAA |
| | | GGAGGACGGGATCTGGAGCACCGATATTCTGAAGGATCAGAAGGAGCCCAAGAATAAGACCTTC |
| | | CTGAGGTGCGAGGCCAAGAACTACTCAGGCCGCTTCACCTGCTGGTGGCTCACCACGATCAGCA |
| | | CCGACCTCACCTTCAGCGTGAAATCCAGCAGGGGTAGCTCGGATCCTCAGGGCGTGACATGCGG |
| | | GGCCGCCACCCTGAGCGCCGAGAGGGTGCGGGGCGACAACAAGGAGTACGAATACAGCGTGGAG |
| | | TGCCAGGAGGACTCCGCGTGCCCCGCCGCGGAAGAGAGCCTGCCCATCGAGGTAATGGTGGACG |
| | | CCGTGCACAAGCTCAAGTACGAGAATTACACCAGCTCTTTCTTCATCCGGGATATCATCAAGCC |

TABLE 13-continued

Sequence optimized sequences for human IL23 single-chain polypeptide

| SEQ ID NO | Name | Sequence |
|---|---|---|
| | | CGACCCTCCCAAGAACCTGCAGCTGAAACCCCTGAAGAACAGCCGTCAGGTAGAGGTGAGCTGG |
| | | GAGTACCCCGATACGTGGAGCACCCCCCATAGCTACTTTTCCCTGACCTTTTGTGTGCAGGTGC |
| | | AGGGCAAGTCCAAGAGGGAGAAGAAGGACAGGGTGTTCACCGACAAGACGTCCGCCACCGTGAT |
| | | CTGCAGGAAGAATGCCTCCATCTCCGTGAGGGCCCAGGACCGCTACTACAGCAGCTCCTGGTCC |
| | | GAGTGGGCCTCTGTCCCCTGCTCCGGCGGGGGCGGAGGCGGCAGCAGAGCCGTGCCCGGCGGCA |
| | | GCAGCCCCGCATGGACCCAATGCCAACAGCTGAGCCAAAAACTGTGCACGCTCGCATGGAGCGC |
| | | CCACCCGCTGGTGGGGCACATGGACCTGAGGGAGGAAGGCGATGAGGAGACGACAAACGACGTG |
| | | CCCCACATCCAGTGCGGCGATGGCTGCGACCCGCAGGGCCTGCGCGACAACAGCCAGTTCTGTC |
| | | TGCAGCGTATCCACCAGGGCCTCATATTCTATGAGAAGCTGCTGGGCTCCGACATCTTCACCGG |
| | | CGAGCCCAGCCTGCTGCCCGACTCCCCCGTGGGACAGCTCCACGCCAGTCTGCTGGGCCTGAGC |
| | | CAGCTGCTGCAGCCCGAGGGCCACCACTGGGAGACTCAGCAGATCCCGAGCCTGAGCCCCAGCC |
| | | AGCCATGGCAAAGGCTGCTGCTCAGGTTCAAGATCCTGAGGAGCCTGCAGGCCTTCGTGGCCGT |
| | | GGCCGCCAGGGTCTTTGCCCACGGGGCCGCCACCCTCTCCCCG |
| 992 | IL23-CO08 | ATGTGCCACCAGCAGTTGGTCATCTCGTGGTTCAGCCTCGTCTTTCTTGCCTCCCCCTTGGTCG |
| | | CCATCTGGGAGCTCAAGAAAGACGTCTACGTTGTCGAGCTCGATTGGTATCCCGACGCGCCGGG |
| | | CGAAATGGTCGTCCTTACGTGCGACACGCCAGAAGAGGACGGTATCACGTGGACCCTCGATCAG |
| | | TCCTCGGAGGTCCTCGGCAGCGGCAAGACCCTCACCATCCAGGTCAAGGAGTTCGGGGACGCCG |
| | | GCCAGTACACCTGCCACAAGGGCGGGGAAGTACTCAGCCATTCCCTGCTGCTGCTGCACAAGAA |
| | | GGAGGACGGGATCTGGTCCACCGACATCCTGAAGGACCAGAAGGAACCCAAGAACAAGACCTTT |
| | | CTGCGCTGTGAGGCAAAGAACTACTCTGGGCGGTTCACCTGTTGGTGGCTGACCACCATCAGTA |
| | | CCGACCTGACCTTCTCTGTGAAAAGCAGCAGGGGCAGCAGCGACCCCCAAGGCGTGACCTGCGG |
| | | CGCCGCCACTCTGTCCGCCGAGCGCGTAAGGGGGGACAACAAAGAGTACGAATATAGCGTGGAA |
| | | TGCCAGGAGGACAGCGCCTGCCCCGCCGCGGAGGAGAGCCTGCCCATCGAAGTGATGGTGGACG |
| | | CGGTCCACAAGCTCAAGTACGAAAACTACACCAGCTCCTTCTTCATCAGGGACATCATTAAGCC |
| | | GGACCCCCCGAAGAACCTGCAGCTGAAGCCGCTGAAAAACAGCCGTCAGGTCGAGGTGAGCTGG |
| | | GAGTACCCCGACACCTGGTCCACCCCGCACTCCTATTTCAGCCTGACTTTCTGCGTGCAGGTCC |
| | | AGGGCAAGAGCAAGCGGGAGAAGAAGGACCGGGTGTTCACCGATAAGACCAGCGCCACCGTCAT |
| | | CTGCCGAAAGAACGCCTCCATCAGCGTGAGGGCCCAGGACAGGTACTACAGCAGCAGCTGGAGC |
| | | GAGTGGGCCTCTGTGCCCTGCAGCGGGGGAGGCGGGGGCGGCAGCAGAGCGGTGCCGGGGGGTA |
| | | GCTCTCCCGCCTGGACCCAGTGTCAACAGCTCAGCCAGAAGCTGTGCACCCTGGCCTGGTCCGC |
| | | CCACCCGCTGGTGGGCCACATGGACCTGAGGGAGGAAGGCGATGAGGAAACCACGAACGATGTG |
| | | CCGCACATCCAGTGCGGCGACGGGTGCGACCCGCAGGGCTTGCGTGATAATAGCCAGTTCTGCC |
| | | TCCAGCGGATCCACCAGGGACTGATCTTCTACGAGAAACTGTTGGGCTCGGACATCTTTACCGG |
| | | CGAGCCCAGCCTCCTGCCCGACAGCCCCGTGGGTCAGCTGCACGCGAGCCTGCTGGGCCTCAGC |
| | | CAGCTCCTGCAGCCCGAAGGGCACCACTGGGAAACCCAGCAAATTCCAAGCCTGAGCCCCTCGC |
| | | AGCCCTGGCAGCGGCTGCTGCTGCGGTTCAAGATCCTCAGGTCCCTGCAGGCCTTCGTGGCGGT |
| | | GGCTGCCCGGGTCTTCGCCCACGGCGCGGCAACGCTGAGCCCC |
| 993 | IL23-CO09 | ATGTGTCACCAGCAGCTCGTCATAAGCTGGTTCTCACTCGTCTTCTTGGCCAGCCCACTAGTCG |
| | | CCATCTGGGAGCTCAAAAAGGACGTCTACGTGGTTGAGCTAGACTGGTACCCCGACGCCCCCGG |
| | | GGAGATGGTTGTCCTCACCTGCGATACGCCCGAAGAGGACGGCATCACCTGGACCCTCGACCAG |
| | | TCCAGCGAGGTCCTCGGGTCCGGCAAAACCCTCACCATCCAGGTCAAGGAGTTCGGGGACGCCG |
| | | GCCAGTACACCTGTCACAAGGGAGGCGAGGTCCTATCCCATAGCCTCCTGCTGCTGCATAAGAA |
| | | GGAGGATGGTATCTGGAGCACCGACATCCTGAAGGACCAAAAGGAGCCGAAGAACAAGACGTTC |
| | | CTCCGGTGCGAGGCCAAGAACTACAGCGGGCGATTCACGTGCTGGTGGCTCACCACCATCTCCA |
| | | CCGACCTGACCTTCTCCGTGAAAAGCAGCCGCGGCTCCAGCGACCCCCAGGGGGTGACCTGCGG |
| | | CGCCGCCACCCTGTCCGCTGAGCGCGTGCGGGGCGACAACAAGGAGTACGAATACAGCGTGGAG |
| | | TGCCAGGAGGACTCCGCCTGCCCCGCCGCCGAGGAGAGCCTGCCCATTGAGGTGATGGTGGACG |
| | | CTGTGCATAAACTGAAGTACGAGAACTACACCTCCAGTTTCTTCATCAGGGACATCATCAAGCC |
| | | TGACCCGCCCAAGAACCTCCAGCTGAAGCCCTTGAAGAACTCGAGGCAGGTGGAAGTCTCGTGG |
| | | GAATACCCCGACACCTGGAGCACGCCCCACAGCTACTTCTCCCTGACCTTCTGCGTGCAGGTGC |
| | | AGGGCAAAAGCAAGAGGGAGAAGAAGGACAGGGTGTTCACCGACAAGACAAGCGCGACCGTGAT |
| | | CTGCAGGAAGAACGCCAGCATATCCGTGCGCGCCCAAGACCGCTACTACAGCAGCTCGTGGTCG |
| | | GAGTGGGCAAGCGTGCCATGCTCAGGCGGCGGCGGCGGGGGCTCCAGGGCCGTGCCCGGGGGCA |
| | | GCAGCCCCGCTTGGACCCAATGTCAGCAGCTGTCCCAGAAGCTGTGCACTCTGGCCTGGAGCGC |
| | | CCACCCCCTGGTGGGTCATATGGACCTGCGGGAGGAGGGCGATGAAGAGACGACCAACGACGTG |
| | | CCCCATATCCAGTGCGGGGACGGGTGTGACCCCCAGGGCCTGAGGGACAACTCGCAGTTTTGCC |
| | | TGCAGAGGATCCACCAGGGCCTGATCTTTTATGAAAAACTACTGGGGAGCGACATCTTCACCGG |
| | | CGAGCCCTCCCTCCTGCCCGACTCCCCCGTGGGGCAACTGCATGCCAGCCTGCTGGGCCTGAGC |
| | | CAGCTGCTGCAGCCGGAGGGGCATCACTGGGAGACGCAGCAGATCCCCTCGTTGTCCCCCTCCC |
| | | AGCCCTGGCAGAGGCTGCTCCTCAGGTTTAAGATCCTGCGGAGCCTGCAGGCCTTCGTGGCCGT |
| | | GGCAGCCCGGGTGTTCGCCCACGGGGCGGCCACCCTCTCGCCC |
| 994 | IL23-CO10 | ATGTGTCACCAGCAGCTCGTCATCAGCTGGTTCTCCCTCGTATTTCTCGCCAGCCCCCTCGTCG |
| | | CCATCTGGGAGCTCAAGAAGGACGTGTACGTTGTAGAGCTCGACTGGTATCCCGACGCCCCCGG |
| | | CGAGATGGTGGTGCTCACCTGCGACACCCCCGAGGAAGACGGCATAACCTGGACCCTCGACCAG |
| | | TCCTCCGAGGTACTAGGGTCGGGTAAAACCCTCACCATCCAGGTCAAGGAATTCGGCGACGCCG |
| | | GGCAGTACACCTGCCACAAGGGCGGCGAGGTCCTCTCGCACAGCCTGCTTCTGCTCCACAAGAA |
| | | GGAAGACGGCATCTGGAGCACGGACATCCTGAAGGACCAGAAGGAGCCGAAGAACAAAACGTTC |
| | | CTGAGGTGCGAGGCTAAGAACTACAGCGGCCGGTTCACCTGCTGGTGGCTGACGACCATCAGCA |
| | | CGGACCTCACCTTCAGCGTGAAAAGCAGCAGGGGGAGCAGCGATCCCCAGGGGGTGACGTGCGG |
| | | CGCCGCCACCCTGAGCGCCGAGCGCGTGCGGGGCGATAACAAAGAGTACGAGTACAGCGTGGAA |
| | | TGTCAGGAGGACAGCGCCTGCCCCGCCGCCGAAGAGAGCCTCCCCATAGAGGTGATGGTGGACG |
| | | CCGTCCACAAGCTGAAGTACGAAAACTACACTAGCTCCTTTTTCATCAGGGACATAATCAAGCC |

TABLE 13-continued

Sequence optimized sequences for human IL23 single-chain polypeptide

| SEQ ID NO | Name | Sequence |
|---|---|---|
| | | CGACCCACCCAAGAACCTGCAGCTGAAGCCCCTCAAGAACAGCAGGCAGGTGGAGGTGTCCTGG<br>GAGTACCCCGACACTTGGAGCACCCCCCACAGCTACTTTAGCCTGACCTTCTGCGTGCAGGTGC<br>AGGGAAAGTCCAAGCGAGAGAAGAAGGACAGGGTGTTCACCGACAAGACCTCCGCCACCGTAAT<br>CTGCCGGAAGAACGCCAGCATCTCCGTGAGGGCCCAGGATAGGTACTACAGCTCCAGCTGGAGC<br>GAGTGGGCCTCCGTGCCCTGTAGCGGAGGCGGCGGCGGGGGCTCCAGGGCTGTGCCCGGCGGCT<br>CATCCCCCGCCTGGACACAGTGCCAGCAGCTGAGCCAAAAGCTGTGCACACTGGCGTGGAGCGC<br>CCACCCGCTCGTGGGCCACATGGACCTGCGGGAGGAAGGGGACGAGGAGACAACGAACGACGTC<br>CCTCACATCCAATGCGGTGATGGCTGTGATCCGCAGGGCCTCAGGGACAACAGCCAGTTCTGTC<br>TGCAGAGGATCCACCAGGGCCTCATCTTCTACGAGAAGCTGCTGGGCAGCGACATCTTCACCGG<br>GGAGCCCAGCCTGCTGCCCGACAGCCCGGTGGGCCAACTGCACGCCAGCCTGCTGGGGCTCAGC<br>CAGCTGCTGCAGCCGGAGGGACACCACTGGGAAACCCAGCAGATCCCGTCCCTGAGCCCCAGCC<br>AGCCCTGGCAGCGCCTGCTCCTGAGGTTCAAGATCCTGCGCTCCCTGCAGGCCTTCGTTGCCGT<br>GGCGGCTCGCGTGTTTGCCCACGGGGCCGCCACCCTGAGCCCC |
| 995 | IL23-CO11 | ATGTGCCACCAGCAGCTCGTTATCAGCTGGTTCAGTCTCGTCTTCCTCGCCTCCCCCCTCGTCG<br>CCATCTGGGAACTAAAGAAGGACGTCTACGTCGTAGAGCTCGACTGGTACCCCGACGCCCCCGG<br>CGAGATGGTCGTCCTCACCTGCGACACTCCAGAGGAGGACGGAATCACCTGGACCCTCGACCAG<br>AGCAGCGAGGTCCTCGGCAGCGGCAAGACCCTCACCATCCAGGTCAAAGAATTCGGCGACGCCG<br>GCCAGTACACCTGCCATAAGGGGGGAGAGGTACTCAGCCACAGCCTGCTGCTACTCCACAAGAA<br>GGAGGACGGCATCTGGTCCACCGACATCCTGAAGGACCAGAAGGAACCCAAGAACAAGACTTTC<br>CTGAGGTGCGAGGCCAAGAATTATAGCGGCAGGTTCACCTGCTGGTGGCTGACCACCATCAGCA<br>CCGACCTGACCTTCTCCGTGAAATCCAGCAGGGGGAGCTCCGACCCACAGGGCGTCACGTGCGG<br>CGCCGCCACGCTGTCCGCCGAGCGAGTGCGCGGCGACAACAAGGAGTACGAGTACTCCGTCGAG<br>TGCCAGGAGGACAGCGCGTGCCCCGCCGCCGAAGAGTCGCTGCCCATAGAGGTGATGGTGGATG<br>CCGTCCACAAGCTGAAGTATGAAAACTACACCTCCAGCTTCTTCATCCGCGACATCATCAAGCC<br>CGACCCTCCCAAGAACCTGCAGCTGAAACCGTTAAAGAACTCCAGGCAGGTGGAGGTCAGCTGG<br>GAGTACCCCGACACCTGGTCCACCCCGCACAGCTACTTCAGCCTCACCTTCTGCGTGCAGGTGC<br>AAGGCAAAAGCAAGCGGGAGAAGAAAGACCGGGTCTTCACCGATAAGACCTCAGCCACCGTGAT<br>CTGCCGCAAGAATGCCTCCATTTCAGTGCGGGCGCAGGACCGCTACTATTCCAGCTCCTGGAGC<br>GAGTGGGCCAGCGTCCCTTGCTCCGGCGGGGGAGGAGGCGGCTCGAGGGCCGTGCCCGGAGGAT<br>CGAGCCCCGCCTGGACTCAGTGCCAGCAGCTGTCCCAGAAACTGTGCACCCTGGCCTGGTCCGC<br>CCACCCCCTGGTGGGCCACATGGACCTGCGCGAGGAGGGGGACGAGGAGACGACCAACGACGTG<br>CCCCACATCCAGTGCGGGGACGGGTGCGACCCCCAGGGGCTCAGAGACAACTCCCAGTTCTGTC<br>TGCAGCGGATCCATCAAGGGCTGATCTTCTACGAGAAGCTGCTGGGGTCAGACATCTTTACCGG<br>CGAGCCCAGTCTTCTGCCCGACAGCCCCGTGGGGCAGCTCCATGCCAGCCTGCTGGGGCTGAGC<br>CAGCTGCTGCAGCCCGAGGGCCACCACTGGGAGACTCAACAGATCCCCAGCCTGTCGCCCTCCC<br>AGCCCTGGCAGAGGCTGCTGCTGCGGTTCAAAATCCTCAGGAGCCTGCAGGCCTTCGTCGCCGT<br>GGCCGCCAGAGTGTTCGCGCACGGCGCCGCGACGCTCTCGCCC |
| 996 | IL23-CO12 | ATGTGCCATCAGCAGCTCGTCATCAGCTGGTTCAGCCTCGTCTTCTTGGCCAGCCCCCTCGTCG<br>CCATCTGGGAGCTCAAGAAAGACGTGTACGTCGTCGAGCTGGACTGGTACCCCGACGCCCCCGG<br>CGAGATGGTCGTCCTAACCTGCGACACCCCCGAGGAGGACGGCATCACGTGGACCCTCGACCAG<br>AGCAGCGAGGTCCTCGGCAGCGGAAAAACCCTAACCATACAGGTTAAGGAGTTCGGCGACGCCG<br>GCCAGTACACCTGCCACAAGGGGGGCGAGGTCCTATCCCACAGCCTGCTGCTGCTGCACAAAAA<br>AGAGGACGGCATCTGGAGCACCGATATCCTGAAAGACCAGAAGGAACCCAAAAATAAGACCTTC<br>CTGAGGTGCGAGGCAAAGAATTACAGCGGCAGGTTCACCTGCTGGTGGCTGACCACCATCTCCA<br>CGGACCTGACCTTCAGCGTGAAAAGCTCGAGGGGCAGCAGCGACCCGCAGGGCGTGACCTGTGG<br>CGCGGCCACCCTGAGCGCCGAGCGCGTGAGGGGCGACAACAAGGAGTACGAATACTCCGTGGAG<br>TGCCAGGAGGATTCGGCCTGCCCCGCCGCCGAGGAGTCCCTCCCCATCGAGGTGATGGTGGACG<br>CCGTGCACAAGCTGAAGTATGAGAACTACACCTCAAGCTTCTTCATCAGGGACATCATCAAGCC<br>CGACCCGCCCAAAAACCTCCAACTGAAGCCCCTGAAGAACAGCCGGCAGGTGGAGGTGTCCTGG<br>GAGTACCCCGATACCTGGTCCACCCCGCACTCCTACTTCAGCCTGACGTTCTGCGTGCAGGTGC<br>AGGGCAAGTCCAAGCGAGAGAAAAAGGACCGCGTGTTCACCGACAAGACCAGCGCCACCGTGAT<br>CTGTCGCAAAAACGCCTCCATCAGCGTGCGCGCCCAGGACCGGTACTACAGCAGCAGTTGGAGC<br>GAGTGGGCCAGCGTGCCATGTAGCGGGGGCGGCGGGGGCGGCTCCAGGGCCGTGCCCGGGGGAT<br>CGTCGCCAGCCTGGACCCAGTGCCAGCAACTCAGCCAAAAGCTGTGCACCCTCGCCTGGAGCGC<br>GCACCCCCTGGTCGGACACATGGATCTGAGGGAAGAGGGCGATGAGGAGACAACCAACGACGTG<br>CCCCACATCCAGTGTGGGGACGGCTGCGATCCCCAGGGCCTGCGAGATAACAGCCAGTTCTGTC<br>TCCAGCGAATCCATCAGGGGCTGATCTTCTACGAGAAACTGTTGGGCTCCGACATCTTCACCGG<br>CGAGCCCAGCCTGCTGCCCGACAGCCCCGTAGGGCAGCTCCACGCCTCCCTGCTGGGGCTGTCG<br>CAGCTGCTGCAGCCCGAGGGGCACCACTGGGAAACGCAGCAGATCCCCAGCCTCAGCCCCAGCC<br>AACCCTGGCAGAGGCTGCTGCTGAGGTTCAAGATCCTGCGTTCCCTGCAGGCCTTCGTGGCGGT<br>GGCCGCCAGGGTCTTCGCACACGGCGCCGCAACCCTGTCCCCG |
| 997 | IL23-CO13 | ATGTGCCATCAGCAACTCGTCATCTCCTGGTTCTCCCTAGTCTTCCTCGCCAGCCCCCTCGTAG<br>CCATCTGGGAGCTCAAGAAAGACGTATACGTCGTAGAGCTCGACTGGTACCCGGACGCCCCCGG<br>GGAGATGGTCGTACTCACCTGTGACACCCCGGAGGAAGACGGGATCACGTGGACCCTCGACCAA<br>TCCTCCGAGGTCCTTGGGAGCGGCAAAACGCTCACCATCCAAGTCAAGGAGTTCGGCGACGCCG<br>GACAGTATACCTGCCACAAAGGGGGAGAGGTCCTTAGCCACAGCCTCCTCCTGCTGCACAAGAA<br>GGAGGATGGCATCTGGTCCACCGACATACTGAAGGACCAGAAAGAGCCCAAGAACAAAACGTTC<br>CTGCGGTGCGAGGCCAAGAATTACAGCGGACGGTTCACCTGCTGGTGGCTGACGACTATCAGCA<br>CCGATCTGACCTTCAGCGTGAAGTCCAGCAGGGGCTCCAGCGACCCACAGGGGGTGACCTGCGG<br>CGCCGCCACACTCAGCGCCGAGAGGGTGCGGGGTGACAATAAAGAGTACGAGTATAGCGTGGAG<br>TGCCAGGAGGACTCCGCGTGTCCCGCCGCCGAGGAGTCCCTGCCGATCGAGGTGATGGTGGACG<br>CCGTGCACAAGCTCAAGTACGAGAACTATACCTCCAGCTTTTTCATCAGGGACATCATCAAGCC |

TABLE 13-continued

Sequence optimized sequences for human IL23 single-chain polypeptide

| SEQ ID NO | Name | Sequence |
|---|---|---|
| | | CGACCCACCCAAAAATCTCCAGCTGAAGCCCCTGAAGAACAGCCGCCAGGTGGAGGTGAGCTGG<br>GAGTACCCGGACACGTGGTCCACCCCACACAGCTACTTCTCCCTGACCTTTTGCGTGCAAGTGC<br>AGGGCAAGAGCAAGAGGGAGAAGAAGGACAGGGTGTTCACTGATAAGACCAGCGCCACCGTGAT<br>CTGCAGAAAGAACGCCAGCATCTCCGTGAGGGCCCAAGACCGGTACTATTCCAGCTCCTGGTCC<br>GAATGGGCCTCCGTGCCCTGTAGTGGCGGTGGCGGTGGGGGGAGTAGGGCGGTGCCCGGCGGCA<br>GCAGCCCCGCATGGACCCAGTGCCAGCAGCTGTCCCAGAAACTGTGTACCCTGGCCTGGTCCGC<br>CCATCCCCTGGTCGGCCACATGGACCTGCGCGAGGAGGGCGACGAGGAGACAACAAATGACGTT<br>CCCCACATCCAGTGCGGCGACGGCTGCGACCCACAGGGCCTGAGGGACAACAGCCAGTTCTGCC<br>TGCAGCGCATCCACCAGGGCCTCATCTTCTACGAGAAGCTGCTGGGCTCGGACATCTTCACCGG<br>GGAGCCCAGCCTTCTGCCCGACTCCCCTGTGGGCCAGCTGCATGCCAGCCTGCTGGGCCTGTCG<br>CAGCTCTTGCAGCCCGAGGGCCACCACTGGGAGACGCAACAAATCCCTAGCCTGAGCCCCTCCC<br>AGCCCTGGCAGAGGCTGCTGCTCCGCTTCAAAATCCTGAGATCCCTCCAGGCCTTCGTCGCCGT<br>CGCCGCCCGGGTGTTTGCCCACGGCGCGGCCACCCTGTCCCCC |
| 998 | IL23-CO14 | ATGTGCCACCAGCAGCTCGTCATCAGCTGGTTCTCCCTCGTCTTCCTTGCCTCCCCACTTGTCG<br>CCATCTGGGAGCTCAAAAAGGACGTCTACGTCGTCGAGCTCGACTGGTACCCCGACGCCCCCGG<br>GGAGATGGTCGTCCTCACCTGCGACACCCCGGAGGAAGACGGCATTACCTGGACCCTCGACCAG<br>AGCAGCGAAGTCCTCGGGTCCGGAAAAACCCTCACCATCCAGGTCAAGGAGTTCGGCGACGCCG<br>GGCAGTACACGTGCCACAAAGGGGGAGAGGTTCTCAGCCACTCCCTCCTGCTGCTGCACAAGAA<br>GGAGGACGGAATCTGGTCCACCGACATCCTCAAGGACCAGAAGGAGCCCAAAAACAAGACCTTC<br>CTCAGGTGCGAGGCCAAGAACTACTCCGGCCGGTTTACCTGCTGGTGGCTGACCACCATCAGCA<br>CCGACCTCACCTTTAGCGTCAAGTCCTCCCGGGGCAGCAGCGACCCACAGGGCGTGACCTGTGG<br>CGCCGCGACCCTGAGCGCCGAGCGCGTGAGGGGCGACAATAAGGAGTACGAGTACAGCGTGGAG<br>TGTCAGGAGGACAGCGCCTGCCCCGCCGCGGAGGAGAGCCTGCCCATCGAGGTGATGGTAGACG<br>CCGTGCACAAGCTGAAGTATGAGAATTACACCTCCAGCTTCTTCATCCGCGACATAATCAAGCC<br>GGACCCTCCCAAGAACCTGCAGCTGAAGCCGCTGAAGAACAGCAGGCAGGTAGAGGTGAGCTGG<br>GAGTACCCCGATACATGGTCCACGCCCCATAGCTACTTCTCCCTGACCTTCTGCGTGCAGGTGC<br>AAGGCAAGAGCAAGCGGGAGAAGAAAGACCGGGTGTTCACCGACAAGACCAGCGCCACCGTGAT<br>CTGCCGAAAGAACGCCAGCATAAGTGTGCGGGCCCAGGACAGGTACTACTCCTCGTCCTGGTCC<br>GAGTGGGCCTCAGTGCCCTGTTCGGGCGGTGGGGGCGGCGGGTCCCGCGCCGTGCCAGGAGGGA<br>GCAGCCCAGCTTGGACCCAATGCCAGCAACTGTCCCAGAAGCTGTGTACCCTGGCCTGGAGCGC<br>CCACCCACTGGTGGGGCACATGGACCTCAGGGAGGAGGGCGATGAGGAGACTACCAACGATGTG<br>CCCCACATCCAGTGCGGCGACGGCTGCGACCCCCAGGGCCTGAGGGACAATTCCCAGTTCTGCC<br>TGCAGCGGATCCATCAGGGCCTCATCTTCTACGAGAAACTGCTCGGCTCCGATATCTTTACCGG<br>GGAGCCCTCCCTGCTGCCGGACAGCCCGGTGGGCCAACTGCACGCCAGCCTGCTGGGCCTGTCC<br>CAGCTGCTGCAGCCCGAGGGCCACCACTGGGAGACGCAACAGATCCCAAGCTTGTCCCCATCAC<br>AGCCCTGGCAAAGGCTGCTGCTGAGGTTTAAGATCCTGAGGAGCCTGCAGGCCTTCGTGGCCGT<br>GGCCGCCAGGGTGTTCGCCCATGGCGCCGCCACCCTGTCCCCC |
| 999 | IL23-CO15 | ATGTGCCACCAGCAGCTCGTCATTAGCTGGTTTAGCCTCGTCTTCCTCGCCAGCCCACTCGTCG<br>CCATCTGGGAGCTCAAGAAGGACGTCTACGTCGTCGAGCTCGACTGGTACCCCGACGCCCCGGG<br>CGAAATGGTCGTCCTCACCTGTGATACCCCCGAGGAGGACGGCATCACCTGGACCCTCGACCAG<br>TCCAGCGAAGTCCTCGGCAGCGGGAAGACCCTTACCATCCAGGTCAAGGAGTTCGGCGACGCCG<br>GGCAGTACACCTGCCATAAGGGCGGCGAGGTCCTCTCCCATAGCCTCCTGCTGCTCCACAAGAA<br>GGAGGATGGAATTTGGAGCACCGACATCCTGAAGGATCAGAAGGAACCCAAGAACAAGACCTTC<br>CTGCGGTGTGAGGCCAAGAACTACTCGGGCAGGTTCACGTGCTGGTGGCTGACCACAATCAGCA<br>CCGATCTCACCTTTAGCGTGAAGTCGAGCAGGGGCAGCAGCGACCCCCAGGGCGTGACCTGTGG<br>CGCGGCAACCCTGTCCGCCGAACGCGTGAGGGGGGATAACAAGGAGTATGAGTACTCTGTGGAG<br>TGCCAGGAGGACTCCGCCTGCCCCGCCGCCGAGGAGAGCCTGCCCATCGAGGTGATGGTGGACG<br>CCGTGCACAAGCTGAAATACGAAAACTACACGAGCTCGTTCTTCATCAGGGACATCATCAAACC<br>CGACCCCCCTAAGAACCTGCAGCTCAAGCCCCTCAAGAACAGCAGGCAAGTTGAGGTGTCCTGG<br>GAGTACCCCGACACATGGAGCACCCCCCATAGCTACTTCTCGCTGACGTTCTGCGTGCAGGTGC<br>AGGGCAAGTCCAAGCGGGAGAAGAAGGATCGAGTCTTTACCGACAAGACCAGCGCCACCGTCAT<br>CTGCCGGAAGAACGCCAGCATCAGCGTTAGGGCGCAGGATAGATACTATTCCTCCAGCTGGTCC<br>GAATGGGCCAGCGTGCCCTGTAGTGGCGGCGGGGGCGGCGGCAGCAGGGCTGTGCCCGGTGGGA<br>GCAGCCCCGCCTGGACGCAGTGCCAGCAACTGTCCCAGAAACTGTGCACCCTGGCGTGGAGCGC<br>CCACCCCCTGGTCGGCCATATGGACCTGCGGGAGGAGGGCGACGAGGAGACGACCAACGACGTG<br>CCCCACATCCAGTGTGGGGACGGCTGCGACCCCCAGGGGCTAAGGGACAACAGCCAGTTCTGCC<br>TGCAGAGGATCCACCAGGGCCTCATCTTCTATGAAAAGCTCCTGGGGAGCGACATCTTCACCGG<br>CGAGCCCTCCCTGCTGCCCGACAGCCCAGTGGGGCAGCTGCACGCCTCCCTGCTGGGCCTGAGC<br>CAGCTGCTGCAGCCCGAGGGGCATCACTGGGAAACCCAGCAGATCCCCAGCCTCAGCCCCAGCC<br>AGCCCTGGCAGCGCCTGCTGCTCCGGTTCAAGATCCTGCGGTCCCTCCAGGCCTTTGTGGCCGT<br>GGCCGCGAGGGTGTTCGCCCACGGTGCCGCCACCCTGAGCCCG |
| 1000 | IL23-CO16 | ATGTGCCATCAACAGCTAGTCATCAGCTGGTTCTCCCTAGTATTCCTCGCCAGCCCCCTCGTCG<br>CCATCTGGGAACTCAAGAAGGACGTCTACGTCGTCGAGCTCGACTGGTACCCGGACGCCCCCGG<br>GGAGATGGTCGTTCTCACCTGCGACACCCCCGAGGAGGACGGCATCACCTGGACCTTAGACCAG<br>AGCTCGGAGGTCCTCGGCAGCGGGAAAACCCTCACCATCCAGGTCAAAGAGTTCGGCGACGCCG<br>GGCAGTACACGTGCCACAAGGGCGGGGAGGTCCTCAGCCACAGCCTCCTGCTGCTGCATAAGAA<br>GGAGGACGGCATCTGGTCCACCGACATCCTCAAGGATCAAAAGGAGCCCAAAAATAAGACCTTC<br>CTGAGGTGCGAGGCCAAGAATTATAGCGGCAGGTTCACCTGCTGGTGGCTCACGACCATCAGCA<br>CCGACCTGACCTTCTCCGTCAAAAGCTCCCGGGGGAGCAGCGATCCCCAGGGCGTTACCTGCGG<br>CGCCGCCACCCTGAGCGCCGAGAGGGTCAGAGGGGATAACAAGGAGTATGAGTACTCCGTCGAA<br>TGTCAGGAGGACAGCGCCTGTCCCGCCGCCGAAGAGTCACTTCCCATTGAAGTGATGGTCGACG<br>CCGTCCACAAACTGAAGTACGAGAACTACACGTCCAGCTTCTTCATCAGGGACATCATCAAGCC |

TABLE 13-continued

Sequence optimized sequences for human IL23 single-chain polypeptide

| SEQ ID NO | Name | Sequence |
|---|---|---|
| | | GGACCCGCCCAAGAACCTGCAGCTGAAGCCCCTTAAGAATAGCCGACAGGTGGAGGTGAGCTGG |
| | | GAGTATCCCGACACCTGGAGCACTCCTCACAGCTACTTCAGCCTCACCTTCTGCGTGCAAGTGC |
| | | AGGGGAAAAGCAAGCGGGAGAAGAAGGACAGGGTGTTCACTGATAAGACCAGCGCCACCGTTAT |
| | | CTGCCGGAAGAATGCCAGCATCAGCGTGCGCGCCCAGGACCGCTATTACTCCAGCTCCTGGTCC |
| | | GAATGGGCCAGCGTCCCCTGCAGCGGTGGCGGCGGGGGTGGTAGCAGGGCCGTGCCCGGTGGCT |
| | | CCTCACCCGCCTGGACCCAATGCCAGCAGCTCAGCCAGAAGCTTTGCACCCTGGCCTGGAGCGC |
| | | ACACCCCCTGGTGGGCCACATGGACCTGCGCGAAGAGGGGGACGAGGAAACCACCAACGACGTG |
| | | CCCCACATCCAGTGCGGGGACGGCTGTGACCCCCAGGGGCTGAGGGACAACTCCCAGTTCTGCC |
| | | TGCAGCGAATACACCAAGGCCTGATCTTCTACGAGAAGCTCCTGGGCAGCGACATCTTCACCGG |
| | | GGAACCCTCCCTGCTGCCGGACAGCCCCGTGGGCCAGCTCCACGCCAGCCTGCTGGGCCTGAGC |
| | | CAGCTGCTGCAGCCGGAGGGGCACCATTGGGAGACGCAGCAGATCCCGAGCCTGTCCCCCAGCC |
| | | AGCCGTGGCAGCGGCTGCTGCTGAGGTTCAAGATCCTCAGGAGCCTCCAGGCCTTCGTGGCCGT |
| | | AGCCGCGCGGGTGTTCGCCCACGGCGCGGCCACCCTCAGTCCT |
| 1001 | IL23-CO17 | ATGTGCCACCAGCAGCTCGTCATCAGCTGGTTCAGCCTCGTTTTCCTCGCCAGCCCGTTAGTCG |
| | | CCATCTGGGAGCTTAAGAAGGACGTTTACGTTGTCGAACTCGACTGGTACCCCGACGCCCCCGG |
| | | CGAGATGGTCGTCCTCACCTGCGATACCCCCGAGGAAGACGGCATCACGTGGACTCTCGACCAG |
| | | TCTAGCGAGGTCTTGGGGAGCGGCAAAACCCTCACCATTCAGGTAAAGGAGTTCGGCGACGCCG |
| | | GCCAGTACACCTGCCACAAGGGCGGCGAGGTCCTCAGCCACAGCCTGCTGCTGCTCCATAAGAA |
| | | AGAAGACGGTATCTGGTCCACGGACATCCTGAAGGACCAGAAGGAGCCCAAGAACAAGACCTTC |
| | | CTGAGGTGCGAGGCCAAGAACTACTCCGGCCGGTTTACCTGCTGGTGGCTTACCACCATCAGCA |
| | | CGGACCTGACCTTCTCCGTGAAGTCCTCAAGGGGCTCCAGCGACCCGCAGGGTGTGACCTGCGG |
| | | CGCGGCCACCCTCTCCGCCGAGCGTGTGCGGGGCGACAACAAGGAGTACGAGTACAGCGTTGAG |
| | | TGTCAAGAGGATTCCGCCTGCCCCGCCGCCGAAGAGAGCCTGCCGATCGAGGTGATGGTGGACG |
| | | CCGTGCACAAACTGAAGTACGAGAACTATACCAGCAGCTTCTTTATCAGGGACATCATCAAACC |
| | | GGACCCTCCCAAGAACCTGCAGCTGAAGCCCCTGAAGAACTCCCGGCAGGTGGAGGTGTCCTGG |
| | | GAGTATCCGGACACGTGGAGCACCCCCCACTCCTACTTCAGCCTGACTTTCTGCGTGCAGGTGC |
| | | AGGGCAAGAGCAAGCGGGAGAAAAAGGACAGGGTGTTCACGGACAAGACCTCCGCCACGGTAAT |
| | | CTGCCGGAAAAACGCCTCCATCAGCGTGCGGGCCCAGGACAGGTACTATAGCAGCAGCTGGTCC |
| | | GAGTGGGCCAGCGTGCCATGTTCCGGAGGGGGCGGCGGCGGCAGCCGGGCCGTGCCAGGTGGGA |
| | | GCAGTCCCGCCTGGACCCAATGCCAGCAGCTGAGCCAGAAGCTCTGCACCCTCGCCTGGAGCGC |
| | | CCACCCCCTGGTGGGCCACATGGACCTGCGCGAGGAGGGCGATGAGGAGACTACCAACGACGTG |
| | | CCCCACATCCAATGCGGGGACGGCTGTGACCCCCAGGGCCTGAGGGACAACAGCCAATTCTGCC |
| | | TGCAGCGGATCCATCAGGGTCTGATTTTCTACGAGAAGCTGCTGGGCAGCGACATCTTCACCGG |
| | | GGAGCCCAGCCTGCTGCCCGATAGCCCCGTGGGACAGCTGCACGCCAGCCTGCTGGGGCTGAGC |
| | | CAACTGCTGCAGCCCGAGGGCCATCACTGGGAGACACAGCAGATCCCCTCGCTGAGCCCCAGCC |
| | | AGCCCTGGCAGAGGCTGCTCCTCCGCTTCAAGATCCTGAGGTCGCTGCAGGCGTTCGTCGCCGT |
| | | CGCAGCGCGCGTGTTCGCCCATGGGGCCGCCACCCTGAGCCCA |
| 1002 | IL23-CO18 | ATGTGCCATCAGCAGCTCGTCATCAGCTGGTTTAGCCTCGTCTTCCTCGCCAGCCCCCTCGTCG |
| | | CGATCTGGGAGCTTAAGAAGGACGTTTACGTCGTCGAACTCGACTGGTATCCCGACGCCCCCGG |
| | | CGAAATGGTAGTCCTGACCTGCGACACCCCGGAGGAGGACGGCATCACCTGGACCCTCGACCAG |
| | | AGCAGCGAGGTACTCGGGTCCGGCAAGACACTCACGATCCAGGTAAAGGAGTTCGGGGACGCGG |
| | | GCCAGTACACTTGCCACAAGGGCGGCGAGGTTCTCTCCCATAGCCTGCTCCTCCTGCACAAGAA |
| | | GGAGGACGGAATCTGGAGCACCGACATCCTGAAGGACCAGAAGGAGCCGAAGAACAAGACCTTC |
| | | CTACGCTGCGAGGCCAAGAACTACTCCGGCCGATTCACTTGCTGGTGGCTGACCACCATCAGCA |
| | | CCGACCTGACCTTCAGCGTGAAAAGCAGCCGGGGGAGCTCCGACCCGCAGGGCGTGACCTGCGG |
| | | CGCCGCCACCCTGAGCGCGGAACGAGTGAGGGGCGACAACAAGGAGTACGAGTACAGCGTGGAG |
| | | TGCCAGGAGGACAGCGCCTGTCCCGCCGCGGAGGAGAGTCTGCCCATCGAAGTCATGGTGGACG |
| | | CCGTGCACAAACTGAAGTACGAGAATTACACCTCAAGCTTCTTCATCAGGGACATCATCAAGCC |
| | | CGACCCGCCCAAGAACCTGCAGCTGAAGCCCCTGAAGAACAGCCGCCAGGTGGAGGTGAGCTGG |
| | | GAGTACCCCGACACGTGGAGCACCCCTCACTCCTACTTCAGCCTGACGTTCTGCGTGCAGGTGC |
| | | AGGGCAAGTCCAAGCGAGAGAAGAAGGACAGGGTGTTCACCGATAAGACCTCCGCAACAGTGAT |
| | | CTGCCGGAAGAACGCCAGCATCAGCGTGAGGGCCCAGGACAGGTATTACTCCAGCTCCTGGAGC |
| | | GAGTGGGCCTCCGTCCCCTGCAGCGGTGGCGGAGGCGGGGGCAGTAGGGCCGTACCCGGCGGAT |
| | | CCAGCCCGGCCTGGACGCAGTGCCAGCAGCTGTCCCAGAAGCTGTGTACCCTGGCCTGGTCGGC |
| | | CCACCCACTGGTGGGCCACATGGACCTGAGGGAGGAGGGCGACGAGGAGACGACCAATGACGTC |
| | | CCCCACATCCAGTGCGGGGATGGCTGCGACCCCCAGGGGCTGAGGGACAATTCCCAGTTTTGCC |
| | | TCCAGAGGATCCACCAGGGCCTGATCTTCTACGAGAAGCTCCTGGGGAGCGACATCTTCACGGG |
| | | CGAGCCCAGCCTGCTGCCCGATTCCCCCGTAGGCCAGCTGCACGCCAGCCTGCTGGGCCTGAGC |
| | | CAGCTGCTCCAGCCCGAGGGCCATCACTGGGAGACACAGCAGATCCCGAGCCTGAGCCCCAGCC |
| | | AGCCCTGGCAGAGGCTCCTGCTGAGGTTTAAGATCCTGAGGAGCCTGCAGGCCTTCGTGGCCGT |
| | | GGCCGCCCGGGTGTTCGCCCACGGGGCGGCCACCCTCAGCCCC |
| 1003 | IL23-CO19 | ATGTGCCACCAGCAGCTCGTTATAAGCTGGTTCTCCCTCGTCTTCTTGGCCTCACCCCTCGTAG |
| | | CCATCTGGGAGCTCAAGAAAGACGTCTACGTAGTCGAGCTCGACTGGTATCCCGACGCCCCGGG |
| | | AGAGATGGTCGTCCTCACCTGCGATACCCCCGAGGAGGACGGGATAACCTGGACCCTCGATCAG |
| | | TCCAGCGAGGTCCTCGGCAGCGGCAAGACCCTCACCATCCAGGTAAAAGAGTTCGGCGACGCCG |
| | | GCCAGTACACCTGCCACAAGGGCGGCGAAGTTCTCTCCCACTCCCTGCTGCTGCTCCACAAGAA |
| | | GGAGGACGGCATCTGGTCCACGGACATCCTGAAGGACCAAAAGGAGCCCAAAAACAAAACCTTC |
| | | CTGAGGTGCGAAGCCAAGAATTATTCCGGCCGGTTCACCTGCTGGTGGCTCACGACCATCAGCA |
| | | CGGACCTGACGTTCAGCGTCAAGAGCAGCAGGGGCAGCAGCGACCCCCAGGGGGTGACCTGCGG |
| | | GGCCGCCACCCTGAGCGCCGAGAGGGTCAGGGGCGATAACAAGGAGTATGAGTACAGCGTCGAG |
| | | TGCCAGGAAGATAGCGCCTGCCCCGCCGCCGAGGAGAGCCTGCCCATCGAGGTGATGGTGGACG |
| | | CCGTCCACAAGCTGAAATACGAAAACTACACCAGCTCGTTCTTCATCCGGGATATCATCAAGCC |

TABLE 13-continued

Sequence optimized sequences for human IL23 single-chain polypeptide

| SEQ ID NO | Name | Sequence |
|---|---|---|
| | | CGATCCCCCCAAGAACCTCCAGCTGAAACCCCTGAAAAACTCCCGGCAGGTGGAGGTGTCGTGG<br>GAGTACCCCGACACCTGGTCCACCCCCCACTCATACTTCAGCCTGACGTTCTGTGTGCAGGTGC<br>AGGGAAAGTCCAAGCGGGAGAAGAAGGACCGCGTGTTCACGGATAAAACTAGCGCCACCGTGAT<br>CTGCAGGAAGAACGCGAGCATCAGCGTGCGGGCCCAGGATAGGTACTACTCCAGCTCCTGGAGC<br>GAGTGGGCCAGCGTGCCGTGTTCCGGGGGCGGAGGCGGAGGAAGCAGGGCCGTGCCCGGCGGCA<br>GCTCCCCCGCCTGGACACAGTGCCAACAGCTGAGCCAGAAGCTGTGCACCCTGGCGTGGTCCGC<br>CCACCCCCTGGTGGGCCACATGGACCTGAGGGAGGAGGGCGACGAGGAGACAACAAACGATGTG<br>CCGCATATCCAGTGCGGCGACGGGTGCGATCCCCAGGGGCTGCGGGACAACTCACAATTCTGCC<br>TGCAGAGGATCCATCAGGGGCTAATCTTCTATGAGAAGCTCCTGGGTAGCGACATCTTCACAGG<br>CGAGCCCTCCCTGCTGCCCGACAGCCCCGTGGGCCAACTGCACGCCTCGTTGCTGGGGCTGTCC<br>CAGCTGCTTCAGCCGGAGGGACACCATTGGGAGACGCAGCAGATCCCCTCCCTGAGCCCCAGCC<br>AGCCCTGGCAACGTCTCCTGCTGCGGTTCAAGATCCTCCGGTCGCTGCAGGCATTCGTGGCCGT<br>CGCCGCCCGGGTGTTCGCCCACGGCGCCGCCACCCTGTCGCCT |
| 1004 | IL23-CO20 | ATGTGCCACCAGCAGCTCGTAATCAGCTGGTTCTCCCTCGTCTTTCTCGCCAGCCCACTCGTCG<br>CCATTTGGGAGCTCAAGAAGGACGTGTACGTCGTCGAACTAGATTGGTACCCCGACGCCCCGGG<br>GGAGATGGTCGTCCTTACCTGCGACACCCCAGAGGAGGACGGTATCACCTGGACCCTTGACCAG<br>AGCAGCGAGGTCCTCGGGAGCGGGAAGACCCTCACCATCCAGGTCAAGGAGTTCGGCGACGCCG<br>GCCAGTACACCTGCCACAAGGGGGGCGAAGTCCTATCCCACAGCCTGCTGCTCCTGCACAAGAA<br>GGAGGATGGCATCTGGTCCACCGACATCCTGAAGGACCAGAAAGAGCCAAAAAATAAGACCTTC<br>CTGCGGTGTGAGGCCAAAAACTACAGCGGGCGGTTCACCTGCTGGTGGCTCACAACCATCAGCA<br>CCGACCTGACCTTCTCCGTCAAGAGCAGCAGGGGGAGCAGCGATCCCCAGGGGGTGACTTGTGG<br>TGCCGCCACCCTGAGCGCGGAGAGGGTGAGGGGCGACAACAAGGAATACGAGTACAGCGTGGAG<br>TGTCAGGAAGACTCCGCCTGCCCCGCCGCCGAGGAGTCCCTCCCCATCGAGGTGATGGTGGACG<br>CCGTGCACAAGCTCAAGTACGAGAACTACACGTCCAGCTTCTTCATCCGGGACATCATCAAACC<br>TGATCCCCCGAAGAACCTGCAGCTGAAGCCGCTGAAGAACAGCAGGCAAGTGGAGGTGAGCTGG<br>GAGTACCCCGACACGTGGAGCACCCCCCACAGCTACTTCAGCCTGACCTTCTGCGTCCAGGTGC<br>AGGGCAAGTCCAAGAGGGAGAAGAAGGACCGCGTGTTTACCGACAAGACAAGCGCTACCGTGAT<br>CTGCCGAAAGAACGCCTCCATCTCCGTGAGGGCCCAGGACCGGTACTATAGCAGCTCATGGTCC<br>GAGTGGGCCTCCGTGCCATGCTCCGGCGGCGGCGGCGGCGGATCTAGGGCCGTGCCCGGCGGGA<br>GTAGCCCCGCGTGGACCCAGTGCCAACAGCTCAGCCAGAAGCTCTGTACCCTGGCCTGGTCAGC<br>CCACCCCCTGGTGGGCCACATGGACCTGAGGGAAGAGGGAGACGAGGAAACCACCAACGACGTG<br>CCCCACATCCAGTGCGGCGACGGCTGCGACCCCCAGGGCCTCCGGGACAACAGCCAGTTCTGTC<br>TGCAGAGGATCCACCAGGGGCTGATCTTCTATGAAAAGCTGCTGGGCTCCGACATCTTCACCGG<br>GGAGCCCAGCCTGCTGCCCGATAGCCCCGTGGGCCAGCTGCACGCCTCCTTGCTGGGCCTGTCG<br>CAACTGCTGCAGCCCGAGGGTCACCACTGGGAGACTCAGCAGATCCCGAGCCTGTCCCCCAGCC<br>AGCCCTGGCAAAGGCTGCTGCTGAGGTTCAAGATCCTCCGGTCACTGCAGGCCTTCGTGGCCGT<br>GGCCGCCAGGGTGTTCGCCCACGGTGCCGCGACGCTGAGCCCC |
| 1005 | IL23-CO21 | ATGTGTCACCAGCAACTCGTTATCTCCTGGTTCAGCTTGGTCTTCCTCGCCAGCCCCCTCGTCG<br>CCATCTGGGAGCTCAAGAAGGACGTCTACGTCGTCGAGCTTGACTGGTACCCCGACGCCCCCGG<br>CGAGATGGTTGTCCTCACGTGCGACACCCCCGAGGAGGACGGGATCACCTGGACCTTGGACCAA<br>AGCAGCGAGGTTCTCGGCAGCGGCAAGACCCTCACCATCCAGGTCAAGGAGTTCGGAGACGCCG<br>GCCAGTATACCTGCCACAAGGGCGGGGAGGTCCTCAGCCACAGCCTGCTCCTGCTGCACAAGAA<br>AGAGGATGGGATATGGTCCACAGACATCCTGAAGGATCAGAAGGAGCCAAAGAATAAGACCTTC<br>CTCCGCTGTGAGGCCAAGAACTACTCTGGCCGCTTCACCTGCTGGTGGCTGACCACCATCTCCA<br>CCGACCTCACCTTCAGCGTCAAGAGCAGCCGGGGGAGCTCCGACCCTCAAGGAGTGACCTGCGG<br>CGCCGCCACCCTGAGCGCCGAAAGGGTGCGGGGCGACAACAAGGAGTACGAGTACAGCGTGGAG<br>TGCCAAGAGGACTCCGCGTGCCCCGCCGCCGAAGAGAGCCTGCCCATCGAGGTGATGGTGGACG<br>CCGTCCACAAGCTGAAGTACGAGAACTACACCAGCAGCTTTTTCATCCGAGATATCATCAAGCC<br>CGACCCTCCCAAGAACCTGCAGCTGAAGCCCCTGAAGAACAGCAGGCAGGTGGAGGTTTCCTGG<br>GAATACCCTGACACCTGGTCCACCCCCCACTCCTACTTCAGCCTGACGTTCTGTGTGCAGGTTC<br>AGGGTAAAAGCAAAAGGGAAAAGAAGGACAGGGTGTTCACGGACAAGACGAGCGCCACCGTGAT<br>CTGTCGAAAGAACGCTTCGATCAGCGTGAGGGCCCAAGATAGGTACTACAGCAGCAGCTGGTCC<br>GAATGGGCCTCCGTGCCCTGCAGCGGGGGCGGCGGCGGAGGAAGCCGCGCCGTGCCAGGTGGCA<br>GCTCGCCCGCCTGGACCCAATGCCAGCAACTGAGCCAGAAACTGTGTACCCTGGCCTGGTCCGC<br>CCACCCCCTGGTGGGCCATATGGACCTGAGGGAGGAGGGCGACGAGGAGACGACCAACGACGTG<br>CCGCACATCCAGTGTGGGGACGGCTGCGACCCCCAGGGCCTGCGGGACAACAGCCAGTTCTGCC<br>TGCAGAGGATCCACCAGGGGCTCATTTTCTACGAGAAGCTGTTGGGCAGCGACATATTCACGGG<br>GGAACCCTCGCTGCTCCCCGATAGCCCCGTCGGCCAGCTGCACGCCAGCCTGCTGGGGCTGAGC<br>CAGCTGCTGCAGCCGGAGGGGCACCACTGGGAGACACAGCAGATCCCGAGCCTGAGCCCGAGCC<br>AGCCCTGGCAGAGGCTGCTGCTTAGGTTCAAGATCCTGCGGTCCCTGCAGGCCTTCGTGGCCGT<br>GGCCGCCCGGGTGTTCGCCCACGGCGCCGCCACCCTGTCACCG |
| 1006 | IL23-CO22 | ATGTGCCACCAACAGCTCGTCATCTCGTGGTTCTCCCTCGTATTCCTCGCGTCCCCCCTCGTCG<br>CGATCTGGGAGCTCAAAAAAGACGTGTACGTGGTTGAGCTCGACTGGTACCCCGACGCCCCCGG<br>AGAGATGGTCGTCCTCACCTGCGACACCCCCGAGGAGGACGGCATCACCTGGACCCTCGACCAG<br>AGCAGCGAGGTCTTAGGGAGCGGCAAGACCCTCACCATCCAGGTCAAAGAGTTCGGCGACGCCG<br>GACAGTACACCTGCCACAAAGGGGGCGAGGTCCTCAGCCACAGCCTGCTGCTCCTGCATAAGAA<br>AGAGGACGGCATTTGGAGCACGGACATCCTCAAGGACCAGAAGGAGCCCAAGAATAAGACGTTC<br>CTGAGGTGCGAGGCCAAGAATTACAGCGGGAGGTTCACCTGCTGGTGGCTGACCACCATCTCCA<br>CCGACCTGACCTTCAGCGTGAAGTCGAGCAGGGGCAGCAGCGATCCCCAGGGCGTGACCTGCGG<br>GGCCGCCACCCTGAGCGCCGAGCGCGTGAGGGGAGACAACAAGGAATACGAGTACAGCGTGGAA<br>TGCCAGGAGGACAGCGCCTGCCCCGCGGCTGAGGAGAGCCTCCCGATCGAGGTTATGGTGGATG<br>CGGTGCACAAGCTGAAGTACGAGAACTACACCTCCAGCTTCTTCATCAGGGACATCATCAAGCC |

TABLE 13-continued

Sequence optimized sequences for human IL23 single-chain polypeptide

| SEQ ID NO | Name | Sequence |
|---|---|---|
| | | CGATCCGCCCAAGAATCTGCAGCTCAAGCCCCTGAAGAACTCGCGGCAGGTGGAGGTGAGCTGG |
| | | GAATACCCCGACACCTGGAGCACCCCCCACTCGTATTTCAGCTTAACCTTCTGCGTGCAGGTAC |
| | | AGGGAAAATCCAAGAGGGAGAAGAAGGACAGGGTCTTCACCGACAAGACCAGCGCCACCGTGAT |
| | | CTGCCGGAAGAATGCCAGCATTAGCGTGAGGGCGCAGGACAGGTACTACTCCAGCAGCTGGTCG |
| | | GAGTGGGCCTCAGTGCCCTGCAGCGGCGGGGGCGGCGGCGGCAGCAGGGCCGTCCCAGGCGGCT |
| | | CCAGCCCCGCATGGACTCAATGCCAGCAGCTGTCCCAGAAACTCTGTACCCTGGCGTGGTCCGC |
| | | CCATCCCCTGGTGGGCCACATGGATCTCAGGGAGGAGGGGGACGAGGAGACTACCAACGACGTG |
| | | CCCCACATCCAGTGCGGCGACGGCTGCGACCCCCAGGGCCTGAGGGATAACAGCCAGTTCTGTC |
| | | TGCAAAGGATCCACCAAGGACTGATCTTCTACGAAAAACTGCTGGGCTCCGACATCTTCACCGG |
| | | CGAGCCCAGCCTGCTGCCCGACTCACCCGTGGGCCAGCTGCATGCCAGCCTGCTCGGCCTGAGC |
| | | CAGCTGCTGCAGCCGGAGGGGCACCACTGGGAGACGCAGCAAATCCCCAGCCTCAGTCCCAGCC |
| | | AGCCATGGCAGAGGCTGCTGCTGAGGTTCAAAATCCTCAGGTCGCTGCAGGCCTTCGTGGCAGT |
| | | GGCCGCGCGGGTCTTCGCCCATGGGGCAGCGACCCTGTCCCCC |
| 1007 | IL23-CO23 | ATGTGCCACCAGCAGTTGGTCATCAGCTGGTTTAGCCTCGTCTTTCTCGCCTCCCCCCTTGTCG |
| | | CCATCTGGGAGCTCAAGAAGGACGTCTACGTTGTCGAGCTCGACTGGTACCCGGACGCCCCCGG |
| | | CGAGATGGTCGTCCTCACCTGCGACACCCCCGAGGAGGACGGCATCACCTGGACGCTCGACCAG |
| | | TCCAGCGAGGTCCTCGGGAGCGGTAAGACACTAACCATTCAGGTCAAGGAGTTCGGGGACGCCG |
| | | GCCAGTACACCTGCCACAAGGGGGGAGAGGTACTCAGCCACAGCCTGCTGCTGCTGCACAAAAA |
| | | GGAGGACGGCATCTGGAGCACCGATATCCTGAAGGACCAGAAGGAGCCCAAGAACAAGACCTTC |
| | | CTGCGGTGCGAGGCAAAGAACTACAGCGGCAGGTTCACCTGCTGGTGGCTCACAACCATTAGCA |
| | | CCGACCTGACCTTCAGCGTCAAAAGCTCCCGGGGCAGCTCCGACCCGCAGGGCGTGACCTGTGG |
| | | CGCGGCAACGCTGAGCGCCGAGCGTGTGAGGGGCGACAACAAGGAGTACGAGTACTCCGTGGAG |
| | | TGCCAGGAGGACTCCGCTTGTCCCGCCGCGGAGGAGAGCCTGCCCATCGAAGTGATGGTGGACG |
| | | CCGTGCATAAGCTGAAATACGAGAACTACACCAGCTCCTTTTTCATCCGCGACATCATCAAACC |
| | | TGACCCGCCCAAAAACCTGCAGCTGAAGCCCCTCAAGAACAGCAGGCAAGTGGAGGTCAGCTGG |
| | | GAATACCCAGACACCTGGAGCACACCCCACTCCTACTTTAGCCTGACCTTTTGTGTGCAGGTGC |
| | | AGGGCAAGTCGAAGAGGGAGAAAAAGGATCGTGTGTTCACCGACAAGACCTCCGCCACCGTGAT |
| | | CTGCCGCAAGAACGCCAGCATCAGCGTGCGGGCCCAGGACAGGTACTACAGCTCCAGCTGGTCA |
| | | GAATGGGCCAGCGTGCCCTGTAGCGGCGGCGGCGGAGGCGGCAGCCGTGCAGTTCCGGGGGGCA |
| | | GCAGCCCCGCCTGGACCCAGTGCCAGCAGCTGAGCCAGAAGCTGTGCACTCTGGCATGGTCCGC |
| | | CCACCCCCTGGTGGGCCACATGGACCTGCGAGAGGAGGGCGACGAGGAGACTACCAACGACGTG |
| | | CCCCACATCCAGTGCGGGGACGGCTGCGACCCCCAGGGGCTGCGCGACAACAGCCAGTTCTGCC |
| | | TGCAGAGGATACACCAGGGACTCATATTTTACGAGAAGCTCCTGGGGAGCGACATCTTCACCGG |
| | | CGAGCCGAGCCTCCTGCCGGACTCGCCCGTTGGCCAGCTGCATGCCAGCCTCCTGGGGCTGTCC |
| | | CAACTCCTCCAGCCCGAGGGCCACCATTGGGAAACCCAGCAGATCCCCAGCCTGAGCCCCAGCC |
| | | AGCCCTGGCAGAGGCTGCTGCTGAGGTTCAAAATCCTGCGAAGCCTCCAGGCTTTCGTGGCCGT |
| | | GGCCGCCAGGGTGTTCGCCCACGGGGCCGCCACCCTGTCCCCC |
| 1008 | IL23-CO24 | ATGTGCCATCAGCAACTCGTCATCAGCTGGTTCAGCCTCGTCTTCCTCGCCAGCCCGCTCGTCG |
| | | CCATCTGGGAGCTCAAGAAAGACGTCTACGTCGTCGAGCTCGACTGGTATCCCGACGCCCCCGG |
| | | GGAGATGGTCGTCTTAACCTGCGATACCCCCGAAGAGGACGGGATCACCTGGACCCTCGACCAA |
| | | AGCAGCGAGGTACTCGGCAGCGGCAAGACCCTCACCATCCAGGTCAAAGAGTTCGGGGACGCCG |
| | | GGCAGTACACCTGCCACAAGGGCGGGGAGGTTCTCTCCCACAGCCTGCTCCTGCTGCACAAGAA |
| | | GGAAGACGGCATCTGGTCCACCGACATCCTAAAGGACCAGAAGGAGCCCAAGAACAAGACCTTC |
| | | CTGAGGTGCGAGGCCAAGAACTACAGCGGCCGGTTCACCTGCTGGTGGCTCACGACCATCAGCA |
| | | CCGACCTCACCTTCAGCGTGAAAAGCTCGAGGGGCAGCAGCGACCCCCAGGGCGTGACCTGCGG |
| | | CGCCGCCACCCTGAGCGCGGAGAGGGTGAGGGGCGACAACAAGGAGTACGAGTACTCCGTGGAG |
| | | TGCCAGGAGGACAGCGCCTGCCCCGCCGCCGAGGAATCCCTGCCCATCGAGGTAATGGTGGACG |
| | | CCGTGCACAAGCTGAAATACGAGAACTACACCAGCTCCTTTTTCATCCGCGACATCATCAAGCC |
| | | CGACCCCCCAAAGAACCTGCAGCTGAAGCCACTGAAGAACAGCCGGCAGGTGGAGGTTTCGTGG |
| | | GAGTACCCAGACACCTGGAGCACCCCGCACAGCTACTTCAGCCTGACCTTTTGCGTCCAGGTGC |
| | | AGGGTAAGTCCAAAAGGGAGAAAAAGGACCGGGTTTTCACCGACAAGACCAGCGCCACCGTGAT |
| | | CTGCAGGAAGAACGCCAGCATCTCCGTGAGAGCCCAGGACAGGTACTATAGCTCCTCCTGGAGC |
| | | GAGTGGGCGAGCGTGCCATGCTCGGGCGGCGGCGGGGGAGGTTCGCGCGCCGTTCCCGGTGGCA |
| | | GCAGTCCGGCCTGGACCCAGTGCCAACAGCTGTCCCAGAAGCTTTGCACTCTCGCATGGTCCGC |
| | | CCACCCCCTGGTGGGCCACATGGACCTCCGGGAGGAGGGCGATGAGGAAACCACCAACGATGTG |
| | | CCCCACATCCAGTGCGGCGACGGATGCGACCCCCAGGGTCTGCGGGACAACAGCCAGTTCTGCC |
| | | TCCAGCGCATACACCAAGGCCTGATCTTCTATGAGAAGCTCCTGGGATCCGACATCTTCACCGG |
| | | CGAGCCCTCGCTCCTGCCGGACAGCCCGGTGGGCCAGCTGCACGCCTCCCTCCTGGGACTCAGC |
| | | CAGCTGCTGCAGCCCGAGGGCCACCACTGGGAGACGCAGCAGATCCCCAGCCTGAGCCCCAGCC |
| | | AGCCCTGGCAAAGGCTGCTGCTGAGGTTCAAAATCCTCAGGTCCTTGCAGGCCTTCGTGGCCGT |
| | | GGCCGCGCGAGTGTTCGCCCACGGGGCCGCCACCCTCAGCCCC |
| 1009 | IL23-CO25 | ATGTGCCACCAGCAGCTCGTCATCAGCTGGTTCTCCCTCGTCTTCCTAGCCAGCCCCTTGGTCG |
| | | CAATCTGGGAGCTTAAGAAGGACGTCTACGTTGTCGAGCTGGACTGGTACCCCGACGCCCCCGG |
| | | CGAGATGGTCGTTCTTACCTGCGACACCCCCGAGGAGGACGGGATCACCTGGACCCTCGATCAG |
| | | AGCAGCGAGGTCCTCGGCAGCGGCAAGACCTTGACCATCCAGGTCAAGGAATTCGGCGACGCCG |
| | | GCCAGTACACGTGCCACAAGGGGGGCGAGGTACTCTCGCATTCGCTGCTACTGCTCCACAAGAA |
| | | GGAGGACGGGATCTGGAGCACCGACATCCTAAAGGACCAGAAGGAGCCCAAGAACAAGACCTTC |
| | | CTGCGGTGCGAAGCCAAGAACTACAGCGGGCGGTTTACCTGCTGGTGGCTGACCACCATTAGCA |
| | | CCGACCTGACCTTCTCCGTGAAAAGCTCAAGGGGCAGCAGCGACCCCCAGGGCGTCACCTGCGG |
| | | CGCCGCCACCCTCAGCGCCGAGAGGGTGAGGGGTGATAACAAGGAGTACGAGTACTCCGTGGAA |
| | | TGCCAAGAGGACAGCGCCTGCCCCGCCGCCGAGGAATCCCTCCCCATCGAGGTCATGGTGGATG |
| | | CTGTGCACAAGCTCAAGTACGAGAACTACACCAGCAGCTTCTTCATCCGAGACATCATCAAGCC |

TABLE 13-continued

Sequence optimized sequences for human IL23 single-chain polypeptide

| SEQ ID NO | Name | Sequence |
|---|---|---|
| | | GGATCCCCCCAAGAACCTGCAGCTGAAGCCCCTGAAAAACAGCCGGCAGGTGGAGGTGAGTTGG GAGTACCCCGACACCTGGAGCACGCCCCACAGCTATTTCAGCCTGACGTTCTGCGTGCAGGTGC AGGGCAAGTCTAAGAGGGAGAAAAAAGACAGGGTGTTCACCGATAAGACCAGCGCCACCGTGAT CTGCCGTAAGAACGCCAGCATCAGCGTGAGGGCCCAGGACCGGTACTACTCCAGCTCGTGGAGC GAGTGGGCTAGCGTTCCATGCAGCGGAGGCGGCGGCGGGGGATCAAGAGCCGTGCCCGGGGGGT CCTCCCCCGCCTGGACCCAATGTCAGCAGCTGTCCCAGAAGCTGTGTACGCTGGCATGGAGCGC CCACCCCCTTGTCGGGCACATGGATCTGCGGGAGGAGGGGGACGAGGAAACCACCAACGACGTT CCCCATATCCAGTGCGGGGACGGCTGCGACCCCCAGGGCCTCCGGGACAACAGCCAATTCTGCC TGCAAAGGATCCACCAGGGCCTGATCTTCTACGAGAAGCTGCTGGGCAGCGACATCTTCACGGG CGAGCCTAGCCTGCTCCCGGACTCCCCTGTGGGCCAACTGCACGCCAGCCTGCTCGGGCTGAGC CAGTTGCTGCAGCCGGAGGGCCACCACTGGGAGACTCAACAGATCCCCTCCCTGAGCCCCAGCC AGCCCTGGCAGAGGCTGCTGCTCCGCTTTAAGATCCTGCGGAGCTTGCAGGCCTTTGTGGCAGT GGCCGCGCGCGTGTTCGCCCACGGCGCAGCCACCCTGTCACCC |

The sequence-optimized IL23 polynucleotide sequences disclosed herein are distinct from the corresponding wild type nucleotide acid sequences and from other known sequence-optimized nucleotide sequences, e.g., these sequence-optimized nucleic acids have unique compositional characteristics. See FIGS. 102A to 103E.

In some embodiments, the percentage of uracil or thymine nucleobases in a sequence-optimized IL23 polynucleotide sequence (e.g., encoding an IL12B and/or IL23A polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence.

In some embodiments, the sequence-optimized IL23 polynucleotide sequence has a lower uracil or thymine content than the uracil or thymine content in the reference wild-type sequence. In some embodiments, the uracil or thymine content in a sequence-optimized IL23 polynucleotide sequence disclosed herein is greater than the uracil or thymine content in the reference wild-type sequence and still maintain beneficial effects, e.g., increased expression and/or reduced Toll-Like Receptor (TLR) response when compared to the reference wild-type sequence.

In some embodiments, the IL23-encoding optimized sequences disclosed herein contain unique ranges of uracils or thymine (if DNA) in the sequence. The uracil or thymine content of the optimized sequences can be expressed in various ways, e.g., uracil or thymine content of optimized sequences relative to the theoretical minimum (% $U_{TM}$ or % $T_{TM}$), relative to the wild-type (% $U_{WT}$ or % $T_{WT}$), and relative to the total nucleotide content (% $U_{TL}$ or % $T_{TL}$). For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding an IL12B polypeptide disclosed herein is below 196%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, or below 129%.

In some embodiments, the % U of a uracil-modified sequence encoding an IL12B polypeptide disclosed herein is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, above 129%, or above 130%, above 135%, above 130%, above 131%, above 132%, above 133%, above 134%, above 135%, above 136%, above 137%, above 138%, above 139%, above 140%, above 141%, above 142%, above 143%, above 144%, above 145%, above 146%, above 147%, above 148%, above 149%, above 150%, or above 151%.

In some embodiments, the % $U_{TM}$ of a uracil-modified sequence encoding an IL12B polypeptide disclosed herein is between 139% and 141%, between 138% and 142%, between 137% and 143%, between 136% and 144%, between 135% and 145%, between 134% and 146%, between 133% and 147%, between 132% and 148%, between 131% and 149%, between 130% and 150%, between 129% and 151%, between 128% and 152%, or between 127% and 153%.

In some embodiments, the % U of a uracil-modified sequence encoding an IL12B polypeptide disclosed herein is between about 100% and about 190%, between about 110% and about 160%, between about 120% and about 160%, between about 125% and about 155%, between about 125% and about 160%, between about 120% and about 155%, between about 130% and about 160%, between about 130% and about 155%, between about 130% and about 150%, or between about 130% and about 165%.

In some embodiments, the % $U_{TM}$ of a uracil-modified sequence encoding an IL12B polypeptide disclosed herein is between (i) 125%, 126%, 127%, 128%, 129%, 130%, 131%, or 132% and (ii) 150%, 151%, 152%, 153%, 154%, 155%, 156%, or 157%.

In some embodiments, the % U of a uracil-modified sequence encoding an IL12B polypeptide disclosed herein is between about 128% and about 152%.

In some embodiments, the % $U_{WT}$ or % $T_{WT}$ of a uracil- or thymine-modified sequence encoding a IL23A polypeptide disclosed herein is above 50%, above 55%, above 60%, above 65%, above 70%, above 75%, or above 76%.

In some embodiments, the % $U_{WT}$ or % $T_{WT}$ of a uracil- or thymine-modified sequence encoding a IL23A polypeptide disclosed herein is less than about 95%, less than about 90%, less than about 85%, less than about 80%, less than about 79%, less than about 78%, or less than about 77%.

In some embodiments, the % $U_{WT}$ or % $T_{WT}$ of a uracil- or thymine modified sequence encoding a IL23A polypeptide disclosed herein is between 55% and 86%, between 56% and 85%, between 57% and 84%, between 58% and 83%, between 59% and 82%, between 60% and 81%, between 61% and 80%, between 62% and 79%, between 63% and 78%, between 64% and 77%, or between 65% and 77%.

In some embodiments, the % $U_{WT}$ or % $T_{WT}$ of a uracil- or thymine-modified sequence encoding a IL23A polypeptide disclosed herein is between 63% and 79%, between 64% and 78%, or between 65% and 77%.

In a particular embodiment, the % $U_{WT}$ or % $T_{WT}$ of a uracil- or thymine-modified sequence encoding a IL23A polypeptide disclosed herein is between about 65% and about 77%.

The uracil or thymine content of wild-type IL12B relative to the total nucleotide content (%) is about 21%. In some embodiments, the uracil or thymine content of a uracil- or thymine-modified sequence encoding an IL12B polypeptide relative to the total nucleotide content (%) (% $U_{TL}$ or % $T_{TL}$) is less than 21%. In some embodiments, the % $U_{TL}$ or % $T_{TL}$ is less than 21%, less than 20%, less than 19%, less that 18%, less than 17%, less than 16%, less than 15%, less than 14%, or less than 13%. In some embodiments, the % $U_{TL}$ or % $T_{TL}$ is not less than 13%, 12%, 11%, 10%, 9%, 8%, 7%, 6%, 5%, 4%, 3%, 2%, or 1%.

In some embodiments, the uracil or thymine content of a uracil- or thymine-modified sequence encoding an IL12B polypeptide disclosed herein relative to the total nucleotide content (% $U_{TL}$ or % $T_{TL}$) is between 10% and 22%, between 11% and 21%, between 12% and 20%, between 13% and 19%, between 13% and 18%, or between 13% and 17%. In some embodiments, the uracil or thymine content (% $U_{TL}$ or % $T_{TL}$) of a uracil- or thymine modified sequence encoding an IL12B polypeptide disclosed herein is less than about 30%, less than about 25%, less than about 20%, less than about 19%, less than about 18%, or less than about 17%.

In a particular embodiment, the uracil or thymine content (% $U_{TL}$ or % $T_{TL}$) of a uracil- or thymine modified sequence encoding an IL12B polypeptide disclosed herein is between about 13% and about 17%.

The uracil or thymine content of wild-type IL23A polypeptide relative to the total nucleotide content (%) is about 22%. In some embodiments, the uracil or thymine content of a uracil- or thymine-modified sequence encoding an IL23A polypeptide relative to the total nucleotide content (%) (% $U_{TL}$ or % $T_{TL}$) is less than 22%. In some embodiments, the % $U_{TL}$ or % $T_{TL}$ is less than 30%, less than 25%, less than 21%, less than 20%, less than 19%, less than 18%, less than 17%, less than 16%, or less than 15%. In some embodiments, the uracil or thymine content is not less than 16%, 15%, 14%, 13%, 12%, 11%, or 10%. In some embodiments, the % $U_{TL}$ or % $T_{TL}$ is not less than 10%, 9%, 8%, 7%, 6%, 5%, 4%, 3%, 2%, or 1%.

In some embodiments, the uracil or thymine content of a uracil- or thymine-modified sequence encoding an IL23A polypeptide disclosed herein relative to the total nucleotide content (% $U_{TL}$ or % $T_{TL}$) is between 10% and 22%, between 11% and 21%, between 12% and 20%, between 13% and 19%, between 14% and 18%, or between 14% and 17%.

In a particular embodiment, the uracil or thymine content (% $U_{TL}$ or % $T_{TL}$) of a uracil- or thymine modified sequence encoding an IL23A polypeptide disclosed herein is between about 14% and about 17%.

In some embodiments, a uracil-modified sequence encoding an IL12B polypeptide, IL23A polypeptide, or both IL12B and IL23A polypeptides disclosed herein has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide.

In some embodiments, a uracil-modified sequence encoding an IL12B and/or IL23A polypeptide disclosed herein has a reduced number of uracil triplets (UUU) with respect to the wild-type nucleic acid sequence. In some embodiments, a uracil-modified sequence encoding an IL12B polypeptide of the disclosure contains 4, 3, 2, 1, or no uracil triplets (UUU). In some embodiments, a uracil-modified sequence encoding an IL23A polypeptide of the disclosure contains 2, 1, or no uracil triplets (UUU).

In some embodiments, a uracil-modified sequence encoding an IL12B and/or IL23A polypeptide has a reduced number of uracil pairs (UU) with respect to the number of uracil pairs (UU) in the wild-type nucleic acid sequence. In some embodiments, a uracil-modified sequence encoding an IL12B and/or IL23A polypeptide of the disclosure has a number of uracil pairs (UU) corresponding to the minimum possible number of uracil pairs (UU) in the wild-type nucleic acid sequence.

In some embodiments, a uracil-modified sequence encoding an IL12B polypeptide disclosed herein has at least 1, 2, 3, 4, 5, 6, 7, 8, 9, 10, 11, 12, 13, 14, 15, 16, or 17 uracil pairs (UU) less than the number of uracil pairs (UU) in the wild-type nucleic acid sequence. In some embodiments, a uracil-modified sequence encoding an IL12B polypeptide of the disclosure has between 7 and 17 uracil pairs (UU).

In some embodiments, a uracil-modified sequence encoding a IL23A polypeptide disclosed herein has at least 1, 2, 3, or 4uracil pairs (UU) less than the number of uracil pairs (UU) in the wild-type nucleic acid sequence. In some embodiments, a uracil-modified sequence encoding a IL23A polypeptide disclosed herein has between 5 and 9 uracil pairs (UU).

In some embodiments, a uracil-modified sequence encoding an IL12B or an IL23A polypeptide disclosed herein has a % $UU_{wt}$ less than 90%, less than 85%, less than 80%, less than 75%, less than 70%, less than 65%, less than 60%, less than 65%, less than 60%, less than 55%, less than 50%, less than 40%, or less than 30%.

In some embodiments, a uracil-modified sequence encoding an IL12B polypeptide has a % $UU_{wt}$ between 24% and 75%. In a particular embodiment, a uracil-modified sequence encoding an IL12B polypeptide disclosed herein has a % $UU_{wt}$ between 29% and 71%.

In some embodiments, a uracil-modified sequence encoding a IL23A polypeptide has a % $UU_{wt}$ between 50% and 100%. In a particular embodiment, a uracil-modified sequence encoding a IL23A polypeptide disclosed herein has a % $UU_{wt}$ between 55% and 100%.

In some embodiments, a uracil-modified sequence encoding a IL23A polypeptide has a % $UU_{wt}$less than 100%, less than 90%, less than 85%, less than 80%, less than 75%, less than 70%, less than 65%, less than 60%, less than 65%, or less than 60%.

In some embodiments, the IL23 polynucleotide comprises a uracil-modified sequence encoding an IL12B polypeptide, an IL23A polypeptide, or both IL12B and IL23A polypeptides disclosed herein. In some embodiments, the uracil-modified sequence encoding an IL12B polypeptide, an IL23A polypeptide, or both IL12B and IL23A polypeptides comprises at least one chemically modified nucleobase, e.g., 5-methoxyuracil. In some embodiments, at least 95% of a nucleobase (e.g., uracil) in a uracil-modified sequence encoding an IL12B polypeptide, an IL23A polypeptide, or both IL12B and IL23A polypeptides of the disclosure are modified nucleobases. In some embodiments, at least 95% of uracil in a uracil-modified sequence encoding an IL12B polypeptide, an IL23A polypeptide, or both IL12B and IL23A polypeptides is 5-methoxyuracil. In some embodiments, the IL23 polynucleotide comprising a uracil-modified sequence further comprises a miRNA binding site, e.g., a miRNA binding site that binds to miR-122. In some embodiments, the IL23 polynucleotide comprising a uracil-modified sequence is formulated with a delivery agent, e.g., a compound having Formula (I), e.g., any of Compounds 1-147.

In some embodiments, the "guanine content of the sequence optimized ORF encoding IL12B with respect to the theoretical maximum guanine content of a nucleotide sequence encoding the IL12B polypeptide," abbreviated as % $G_{TMX}$ is at least 67%, at least 70%, at least 75%, at least about 80%, at least about 85%, at least about 90%, at least about 95%, or about 100%. In some embodiments, the % $G_{TMX}$ is between about 65% and about 80%, between about 66% and about 79%, between about 67% and about 78%, between about 68% and about 77%, or between about 69% and about 76%. In some embodiments, the % $G_{TMX}$ is between about 65% and about 85%, between about 70% and about 80%, between about 69% and about 80%, or between about 69% and about 76%.

In some embodiments, the "guanine content of the sequence optimized ORF encoding IL12B with respect to the theoretical maximum guanine content of a nucleotide sequence encoding the IL12B polypeptide," abbreviated as % $G_{TMX}$ is less than 100%, less than about 90%, less than about 85%, or less than about 80%.

In some embodiments, the "guanine content of the sequence optimized ORF encoding IL23A with respect to the theoretical maximum guanine content of a nucleotide sequence encoding the IL23A polypeptide," abbreviated as % $G_{TMX}$ is at least 67%, at least 68%, at least 69%, at least 70%, or at least 75%. In some embodiments, the % $G_{TMX}$ is between about 65% and about 80%, between about 66% and about 79%, between about 67% and about 79%, between about 68% and about 79%, or between about 69% and about 79%. In some embodiments, the % $G_{TMX}$ is between about 65% and about 85%, between about 68% and about 80%, between about 69% and about 80%, or between about 69% and about 79%.

In some embodiments, the "guanine content of the sequence optimized ORF encoding IL23A with respect to the theoretical maximum guanine content of a nucleotide sequence encoding the IL23A polypeptide," abbreviated as % $G_{TMX}$ is less than about 95%, less than about 90%, less than about 85%, less than about 80%, less than about 79%, less than about 78%, or less than about 77%.

In some embodiments, the "cytosine content of the ORF relative to the theoretical maximum cytosine content of a nucleotide sequence encoding the IL12B polypeptide," abbreviated as % $C_{TMX}$, is at least 69%, at least 70%, at least 71%, at least 72%, at least 73%, at least 74%, at least 75%, at least about 76%, or at least 77%. In some embodiments, the % $C_{TMX}$ is between about 60% and about 80%, between about 65% and about 80%, between about 70% and about 80%, or between about 71% and about 78%.

In some embodiments, the "cytosine content of the ORF relative to the theoretical maximum cytosine content of a nucleotide sequence encoding the IL23A polypeptide," abbreviated as % $C_{TMX}$, is at least 65%, at least 70%, at least about 75%. In some embodiments, the % $C_{TMX}$ is between about 60% and about 85%, about 65% and about 80%, between about 66% and about 79%, between about 67% and about 78%, or between about 67% and about 77%. In some embodiments, the % $C_{TMX}$ is less than about 95%, less than about 90%, less than about 85%, less than about 80%, less than about 79%, less than about 78%, or less than about 77%.

In some embodiments, the "guanine and cytosine content (G/C) of the ORF relative to the theoretical maximum G/C content in a nucleotide sequence encoding the IL12B polypeptide," abbreviated as % $G/C_{TMX}$ is at least about 89%, at least about 90%, at least about 95%, or about 100%. The % $G/C_{TMX}$ is between about 90% and about 100%, between about 91% and about 99%, between about 91% and about 98%, between about 91% and about 97%, or between about 91% and about 96%.

In some embodiments, the "guanine and cytosine content (G/C) of the ORF relative to the theoretical maximum G/C content in a nucleotide sequence encoding the IL12B polypeptide," abbreviated as % $G/C_{TMX}$ is less than 100%, less than 99%, less than 98%, less than 97%, or less than 96%. In some embodiments, the % $G/C_{TMX}$ is between about 80% and about 100%, between about 85% and about 99%, between about 90% and about 97%, or between about 91% and about 96%.

In some embodiments, the "guanine and cytosine content (G/C) of the ORF relative to the theoretical maximum G/C content in a nucleotide sequence encoding the IL23A polypeptide," abbreviated as % $G/C_{TMX}$ is at least about 89%, at least about 90%, at least about 95%, or about 100%. The % $G/C_{TMX}$ is between about 90% and about 100%, between about 91% and about 99%, between about 91% and about 98%, between about 91% and about 97%, or between about 91% and about 96%.

In some embodiments, the "guanine and cytosine content (G/C) of the ORF relative to the theoretical maximum G/C content in a nucleotide sequence encoding the IL23A polypeptide," abbreviated as % $G/C_{TMX}$ is less than 100%, less than 99%, less than 98%, less than 97%, or less than 96%. In some embodiments, the % $G/C_{TMX}$ is between about 80% and about 100%, between about 85% and about 99%, between about 90% and about 97%, or between about 91% and about 96%. In some embodiments, the "G/C content in the ORF encoding the IL12B polypeptide relative to the G/C content in the corresponding wild-type IL12B polynucleotide ORF," abbreviated as % $G/C_{WT}$ is at least 100%, at least 105%, at least about 110%, at least about 115%, at least about 116%, or at least about 117%.

In some embodiments, the "G/C content in the ORF encoding the IL23A polypeptide relative to the G/C content in the corresponding wild-type IL23A polynucleotide ORF," abbreviated as % $G/C_{WT}$ is 100%, at least 105%, at least at least about 110%, at least about 111%, at least about 112%, at least about 113%, at least about 114%, or at least about 115%.

In some embodiments, the average G/C content in the 3rd codon position in the ORF encoding an IL12B polypeptide is at least 20%, at least 21%, at least 22%, at least 23%, at least 24%, at least 25%, at least 26%, at least 27%, at least 28%, at least 29%, at least 30%, at least 31%, or at least 32% higher than the average G/C content in the 3rd codon position in the corresponding wild-type ORF.

In some embodiments, the average G/C content in the 3rd codon position in the ORF encoding an IL23A polypeptide is at least 20%, at least 25%, at least 26%, at least 27%, at least 28%, at least 29%, at least 30%, at least 31%, at least 32%, at least 33%, at least 34%, or at least 35% higher than the average G/C content in the 3rd codon position in the corresponding wild-type ORF.

In some embodiments, the IL23 polynucleotide comprises an open reading frame (ORF) encoding an IL12B or IL23A polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

Modified Nucleotide Sequences Encoding IL12B and/or IL23A Polypeptides:

In some embodiments, the IL23 polynucleotide (e.g., a RNA, e.g., a mRNA) comprises a chemically modified nucleobase, e.g., 5-methoxyuracil. In some embodiments, the mRNA is a uracil-modified sequence comprising an ORF encoding an IL12B polypeptide, an IL23A polypeptide, or both IL12B and IL23A polypeptides, wherein the mRNA comprises a chemically modified nucleobase, e.g., 5-methoxyuracil.

In some embodiments, when the 5-methoxyuracil base is connected to a ribose sugar, as it is in polynucleotides, the resulting modified nucleoside or nucleotide is referred to as 5-methoxyuridine. In some embodiments, uracil in the IL23 polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the IL23 polynucleotide is at least 95% 5-methoxyuracil. In another embodiment, uracil in the IL23 polynucleotide is 100% 5-methoxyuracil.

In embodiments where uracil in the IL23 polynucleotide is at least 95% 5-methoxyuracil, overall uracil content can be adjusted such that an mRNA provides suitable protein expression levels while inducing little to no immune response. In some embodiments, the uracil content of the ORF (% Um) is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140%. In other embodiments, the uracil content of the ORF is between about 117% and about 134% or between 118% and 132% of the % $U_{TM}$. In some embodiments, the % $U_{TM}$ is about 115%, about 120%, about 125%, about 130%, about 135%, about 140%, about 145%, or about 150%. In this context, the term "uracil" can refer to 5-methoxyuracil and/or naturally occurring uracil.

In some embodiments, the % $U_{TM}$ of the mRNA encoding an IL12B polypeptide, an IL23A polypeptide, or both IL12B and IL23A polypeptides disclosed herein is less than about 50%, about 40%, about 30%, or about 20% of the total nucleobase content in the ORF. In some embodiments, the uracil content in the ORF is between about 15% and about 25% of the total nucleobase content in the ORF. In other embodiments, the % $U_{TM}$ is between about 20% and about 30% of the total nucleobase content in the ORF. In one embodiment, the uracil content in the ORF of the mRNA encoding an IL12B polypeptide, an IL23A polypeptide, or both IL12B and IL23A polypeptides is less than about 20% of the total nucleobase content in the open reading frame. In this context, the term "uracil" can refer to 5-methoxyuracil and/or naturally occurring uracil.

In further embodiments, the ORF of the mRNA encoding an IL12B polypeptide, an IL23A polypeptide, or both IL12B and IL23A polypeptides having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF. In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the IL12B polypeptide, the IL23A polypeptide, or both the IL12B and IL23A polypeptides (% $G_{TMX}$; % $C_{TMX}$, or % $G/C_{TMX}$). In other embodiments, the G, the C, or the G/C content in the ORF is between about 70% and about 80%, between about 71% and about 79%, between about 71% and about 78%, or between about 71% and about 77% of the % $G_{TMX}$, % $C_{TMX}$, or % $G/C_{TMX}$. In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding an IL12B polypeptide, an IL23A polypeptide, or both IL12B and IL23A polypeptides comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the IL12B polypeptide, the IL23A polypeptide, or both the IL12B and IL23A polypeptides. In some embodiments, the ORF of the mRNA encoding an IL12B polypeptide, an IL23A polypeptide, or both IL12B and IL23A polypeptides contain no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the IL12B polypeptide, the IL23A polypeptide, or both the IL12B and IL23A polypeptides. In a particular embodiment, the ORF of the mRNA encoding the IL12B polypeptide, the IL23A polypeptide, or both the IL12B and IL23A polypeptides contain less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the IL12B polypeptide, the IL23A polypeptide, or both the IL12B and IL23A polypeptides contains no non-phenylalanine uracil pairs and/or triplets. In further embodiments, the ORF of the mRNA encoding an IL12B polypeptide, an IL23A polypeptide, or both IL12B and IL23A polypeptides comprise 5-methoxyuracil and has an adjusted uracil content containing less uracil-rich clusters than the corresponding wild-type nucleotide sequence encoding the IL12B polypeptide, the IL23A polypeptide, or both the IL12B and IL23A polypeptides. In some embodiments, the ORF of the mRNA encoding the IL12B polypeptide, the IL23A polypeptide, or both the IL12B and IL23A polypeptides contain uracil-rich clusters that are shorter in length than corresponding uracil-rich clusters in the corresponding wild-type nucleotide sequence encoding the IL12B polypeptide, the IL23A polypeptide, or both the IL12B and IL23A polypeptides.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the IL12B polypeptide, the IL23A polypeptide, or both the IL12B and IL23A polypeptides-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above. In some embodiments, at least one codon in the ORF of the mRNA encoding the IL12B polypeptide, the IL23A polypeptide, or both the IL12B and IL23A polypeptides is substituted with an alternative codon having a codon frequency lower than the codon frequency of the substituted codon in the synonymous codon set.

In some embodiments, the adjusted uracil content, IL12B polypeptide, an IL23A polypeptide, or both IL12B and IL23A polypeptides-encoding ORF of the 5-methoxyuracil-comprising mRNA exhibits expression levels of IL23 when administered to a mammalian cell that are higher than expression levels of IL23 from the corresponding wild-type mRNA. In other embodiments, the expression levels of IL23 when administered to a mammalian cell are increased relative to a corresponding mRNA containing at least 95% 5-methoxyuracil and having a uracil content of about 160%, about 170%, about 180%, about 190%, or about 200% of the theoretical minimum. In yet other embodiments, the expression levels of IL23 when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, L23 is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the IL23 polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, IL12B polypeptide, IL23A polypeptide, or both IL12B and IL23A polypeptides-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the IL23 mRNA disclosed herein induces a detectably lower immune response (e.g., innate or acquired) relative to the immune response induced by a corresponding wild-type IL23 mRNA under the same conditions. In other embodiments, the mRNA of the present disclosure induces a detectably lower immune response (e.g., innate or acquired) relative to the immune response induced by an mRNA that encodes for an IL12B polypeptide, an IL23A polypeptide, or both IL12B and IL23A polypeptides but does not comprise 5-methoxyuracil under the same conditions, or relative to the immune response induced by an mRNA that encodes for an IL12B polypeptide, an IL23A polypeptide, or both IL12B and IL23A polypeptides and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of an IL23 mRNA disclosed herein into a cell.

In some embodiments, the expression of Type-1 interferons by a mammalian cell in response to an 1123 mRNA disclosed herein is reduced by at least 10%, 20%, 30%, 40%, 50%, 60%, 70%, 80%, 90%, 95%, 99%, or greater than 99% relative to a corresponding wild-type mRNA, to an mRNA that encodes an IL12B polypeptide, an IL23A polypeptide, or both IL12B and IL23A polypeptides but does not comprise 5-methoxyuracil, or to an mRNA that encodes an IL12B polypeptide, an IL23A polypeptide, or both IL12B and IL23A polypeptides and that comprises 5-methoxyuracil but that does not have adjusted uracil content. In some embodiments, the interferon is IFN-β. In some embodiments, cell death frequency cased by administration of an IL23 mRNA disclosed herein to a mammalian cell is 10%, 25%, 50%, 75%, 85%, 90%, 95%, or over 95% less than the cell death frequency observed with a corresponding wild-type mRNA, an mRNA that encodes for an IL12B polypeptide, an IL23A polypeptide, or both IL12B and IL23A polypeptides but does not comprise 5-methoxyuracil, or an mRNA that encodes for an IL12B polypeptide, an IL23A polypeptide, or both IL12B and IL23A polypeptides and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the IL23 polynucleotide is an mRNA that comprises an ORF that encodes an IL12B polypeptide, an IL23A polypeptide, or both IL12B and IL23A polypeptides, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the IL12B polypeptide, the IL23A polypeptide, or both the IL12B and IL23A polypeptides is less than about 30% of the total nucleobase content in the ORF. In some embodiments, the ORF that encodes the IL12B polypeptide, the IL23A polypeptide, or both the IL12B and IL23A polypeptides is further modified to increase G/C content of the ORF (absolute or relative) by at least about 40%, as compared to the corresponding wild-type ORF. In yet other embodiments, the ORF encoding the IL12B polypeptide, the IL23A polypeptide, or both the IL12B and IL23A polypeptides contains less than 20 non-phenylalanine uracil pairs and/or triplets. In some embodiments, at least one codon in the ORF of the mRNA encoding the IL12B polypeptide, the IL23A polypeptide, or both the IL12B and IL23A polypeptides is further substituted with an alternative codon having a codon frequency lower than the codon frequency of the substituted codon in the synonymous codon set. In some embodiments, the expression of the IL12B polypeptide, the IL23A polypeptide, or both the IL12B and IL23A polypeptides encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the IL12B polypeptide, the IL23A polypeptide, or both the IL12B and IL23A polypeptides from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

Polynucleotide Comprising an mRNA Encoding an IL12B Polypeptide, an IL23A Polypeptide, or Both IL12B and IL23A Polypeptides:

In certain embodiments, an IL23 polynucleotide of the present disclosure, for example an IL23polynucleotide comprising an mRNA nucleotide sequence encoding an IL12B polypeptide, an IL23A polypeptide, or both IL12B and IL23A polypeptides, comprises from 5' to 3' end:

(i) a 5' UTR, such as the sequences provided below, comprising a 5' cap provided below;

(ii) an open reading frame encoding an IL12B polypeptide, an IL23A polypeptide, or both IL12B and IL23A polypeptides, e.g., a sequence optimized nucleic acid sequence encoding an IL12B polypeptide, an IL23A polypeptide, or both IL12B and IL23A polypeptides disclosed herein;

(iii) at least one stop codon;

(iv) a 3' UTR, such as the sequences provided below; and (v) a poly-A tail provided below.

In some embodiments, the IL23 polynucleotide further comprises a miRNA binding site, e.g, a miRNA binding site that binds to miRNA-122. In some embodiments, the 3'UTR comprises the miRNA binding site.

In some embodiments, an IL23 polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type IL12B and/or IL23A.

Compositions and Formulations for Use Comprising IL23 Polynucleotides:

Certain aspects of the disclosure are directed to compositions or formulations comprising an IL23 polynucleotide disclosed above.

In some embodiments, the composition or formulation comprises:

(i) an IL23 polynucleotide (e.g., a RNA, e.g., a mRNA) comprising a sequence-optimized nucleotide sequence (e.g., an ORF) encoding an IL12B polypeptide, an IL23A polypeptide, or both IL12B and IL23A polypeptides (e.g., the wild-type sequence, functional fragment, or variant thereof), wherein the IL23 polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the IL23 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the IL12B polypeptide, the IL23A polypeptide, or both the IL12B and IL23A polypeptides (% $U_{TM}$ or % $T_{TM}$), is between about 100% and about 160%.

In some embodiments, the polynucleotides, compositions or formulations above are used to treat and/or prevent proliferative diseases, disorders or conditions, e.g., cancer.

G. Interleukin-12 (IL12)

Interleukin-12 (IL12. also shown as IL12) is a pleiotropic cytokine, the actions of which create an interconnection between innate and adaptive immunity. IL12 functions primarily as a 70 kDa heterodimeric protein consisting of two disulfide-linked p35 and p40 subunits. The precursor form of the IL12 p40 subunit (NM_002187; P29460; also referred to as IL12B, natural killer cell stimulatory factor 2, cytotoxic lymphocyte maturation factor 2) is 328 amino acids in length, while its mature form is 306 amino acids long.

The precursor form of the IL12 p35 subunit (NM_000882; P29459; also referred to as IL12A, natural killer cell stimulatory factor 1, cytotoxic lymphocyte maturation factor 1) is 219 amino acids in length and the mature form is 197 amino acids long. Id. The genes for the IL12 p35 and p40 subunits reside on different chromosomes and are regulated independently of each other. Gately, M K et al., *Annu Rev Immunol.* 16: 495-521 (1998). Many different immune cells (e.g., dendritic cells, macrophages, monocytes, neutrophils, and B cells) produce IL12 upon antigenic stimuli. The active IL12 heterodimer is formed following protein synthesis. Id.

IL12 is composed of a bundle of four alpha helices. It is a heterodimeric cytokine encoded by two separate genes, IL12A (p35) and IL12B (p40). The active heterodimer (referred to as 'p70'), and a homodimer of p40 are formed following protein synthesis.

Due to its ability to activate both NK cells and cytotoxic T cells, IL12 protein has been studied as a promising anti-cancer therapeutic since 1994. See Nastala, C. L. et al., *J Immunol* 153: 1697-1706 (1994). But despite high expectations, early clinical studies did not yield satisfactory results. Lasek W. et al., *Cancer Immunol Immunother* 63: 419-435, 424 (2014). Repeated administration of IL12, in most patients, led to adaptive response and a progressive decline of IL12-induced IFN-γ levels in blood. Id. Moreover, while it was recognized that IL12-induced anti-cancer activity is largely mediated by the secondary secretion of IFNγ, the concomitant induction of IFN-γ along with other cytokines (e.g., TNF-α) or chemokines (IP-10 or MIG) by IL12 caused severe toxicity. Id.

In addition to the negative feedback and toxicity, the marginal efficacy of the IL12 therapy in clinical settings may be caused by the strong immunosuppressive environment in humans. Id. To minimize IFN-γ toxicity and improve IL12 efficacy, scientists tried different approaches, such as different dose and time protocols for IL12 therapy. See Sacco, S. et al., *Blood* 90: 4473-4479 (1997); Leonard, J. P. et al., *Blood* 90: 2541-2548 (1997); Coughlin, C. M. et al., *Cancer Res.* 57: 2460-2467 (1997); Asselin-Paturel, C. et al., *Cancer* 91: 113-122 (2001); and Saudemont, A. et al., *Leukemia* 16: 1637-1644 (2002). Nonetheless, these approaches have not significantly impacted patient survival. Kang, W. K., et al., *Human Gene Therapy* 12: 671-684 (2001).

Currently, a number of IL12 clinical trials are on-going. Though these multiple clinical trials have been on-going for nearly 20 years since the first human clinical trial of IL12 in 1996, an FDA-approved IL12 product is still not available.

Therefore, in some embodiments, the IL12 polypeptide of the present disclosure comprises a single polypeptide chain comprising the IL12B and IL12A fused directly or by a linker. In other embodiments, the IL12 polypeptide of the present disclosure comprises two polypeptides, the first polypeptide comprising IL12B and the second polypeptide comprising IL12A. In certain aspects, the disclosure provides an IL12A polypeptide and an IL12B polypeptide, wherein the IL12A and IL12B polypeptides are on the same chain or different chains.

In some embodiments, the IL12A or IL12B polypeptide of the disclosure is a variant, a peptide or a polypeptide containing a substitution, and insertion and/or an addition, a deletion and/or a covalent modification with respect to a wild-type IL12A or IL12B sequence. In some embodiments, sequence tags or amino acids, can be added to the sequences encoded by the polynucleotides of the disclosure (e.g., at the N-terminal or C-terminal ends), e.g., for localization. In some embodiments, amino acid residues located at the carboxy, amino terminal, or internal regions of a polypeptide of the disclosure can optionally be deleted providing for fragments.

In some embodiments, the IL12A and/or IL12B polypeptide encoded by the polynucleotide (e.g., a RNA, e.g., an mRNA) comprises a substitutional variant of an IL12A and/or IL12B sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

In other embodiments, the IL12A and/or IL12B polypeptide encoded the polynucleotide (e.g., a RNA, e.g., an mRNA) comprises a linker fusing the IL12A and IL12B polypeptides. Non-limiting examples of linkers are disclosed elsewhere herein.

As recognized by those skilled in the art, IL12 protein fragments, functional protein domains, variants, and homologous proteins (orthologs) are also considered to be within the scope of the IL12 polypeptides of the disclosure. Nonlimiting examples of IL12 polypeptides encoded by the polynucleotides of the disclosure are, e.g., SEQ ID NO:1035 and 1037. For example, FIG. 109A shows the amino acid sequence of human wild type IL12 (mature IL12A, and mature IL12B).

Polynucleotides and Open Reading Frames (ORFs):

In certain aspects, the disclosure provides IL12polynucleotides (e.g., a RNA, e.g., an mRNA) that comprise a nucleotide sequence (e.g., an ORF) encoding one or more IL12 polypeptides. In some embodiments, the IL12 polynucleotide (e.g., a RNA, e.g., an mRNA) of the disclosure encodes a single IL12 polypeptide chain comprising an IL12B polypeptide and an IL12A polypeptide, which are fused directly or by a linker, wherein the IL12B polypeptide is selected from:

(i) the full-length IL12B polypeptide (e.g., having the same or essentially the same length as wild-type IL12B);

(ii) a functional fragment of the full-length IL12B polypeptide (e.g., a truncated (e.g., deletion of carboxy, amino terminal, or internal regions) sequence shorter than an IL12B wild-type; but still retaining IL12B enzymatic activity);

(iii) a variant thereof (e.g., full length or truncated IL12B proteins in which one or more amino acids have been replaced, e.g., variants that retain all or most of the IL12B activity of the polypeptide with respect to the wild type IL12B polypeptide (such as, e.g., V33I, V298F, or any other natural or artificial variants known in the art); or (iv) a fusion protein comprising (i) a full length IL12B wild-type, a functional fragment or a variant thereof, and (ii) a heterologous protein;

and/or wherein the IL12A polypeptide is selected from:

(i) the full-length IL12A polypeptide (e.g., having the same or essentially the same length as wild-type IL12A);

(ii) a functional fragment of the full-length IL12A polypeptide (e.g., a truncated (e.g., deletion of carboxy, amino terminal, or internal regions) sequence shorter than an IL12A wild-type; but still retaining IL12A enzymatic activity);

(iii) a variant thereof (e.g., full length or truncated IL12A proteins in which one or more amino acids have been replaced, e.g., variants that retain all or most of the IL12A activity of the polypeptide with respect to the wtIL12A polypeptide (such as natural or artificial variants known in the art); or (iv) a fusion protein comprising (i) a full length IL12A wild-type, a functional fragment or a variant thereof, and (ii) a heterologous protein.

In other embodiments, the IL12 polynucleotide (e.g., a RNA, e.g., an mRNA) of the disclosure encodes two polypeptide chains, the first chain comprising an IL12B polypeptide and the second chain comprising an IL12A polypeptide, wherein the IL12B polypeptide is selected from:

(i) the mature IL12B polypeptide (e.g., having the same or essentially the same length as wild-type IL12B) with or without a signal peptide;

(ii) a functional fragment of any of the mature IL12B polypeptide (e.g., a truncated (e.g., deletion of carboxy, amino terminal, or internal regions) sequence shorter than an IL12B wild-type; but still retaining IL12B enzymatic activity);

(iii) a variant thereof (e.g., full length, mature, or truncated IL12B proteins in which one or more amino acids have been replaced, e.g., variants that retain all or most of the IL12B activity of the polypeptide with respect to the wild type IL12B polypeptide (such as, e.g., V33I, V298F, or any other natural or artificial variants known in the art); or (iv) a fusion protein comprising (i) a mature IL12B wild-type, a functional fragment or a variant thereof, with or without a signal peptide and (ii) a heterologous protein;

and/or, wherein the IL12A polypeptide is selected from:

(i) the mature IL12A polypeptide (e.g., having the same or essentially the same length as wild-type IL12A) with or without a signal peptide;

(ii) a functional fragment of any of the wild-type IL12A polypeptide (e.g., a truncated (e.g., deletion of carboxy, amino terminal, or internal regions) sequence shorter than an IL12A wild-type; but still retaining IL12A enzymatic activity);

(iii) a variant thereof (e.g., full length, mature, or truncated IL12A proteins in which one or more amino acids have been replaced, e.g., variants that retain all or most of the IL12A activity of the polypeptide with respect to a reference isoform (such as natural or artificial variants known in the art); or (iv) a fusion protein comprising (i) a mature IL12A wild-type, a functional fragment or a variant thereof, with or without a signal peptide and (ii) a heterologous protein.

In certain embodiments, the IL12 polynucleotide (e.g., a RNA, e.g., an mRNA) of the disclosure encodes a mammalian IL12 polypeptide, such as a human IL12 polypeptide, a functional fragment or a variant thereof.

In some embodiments, the IL12 polynucleotide (e.g., a RNA, e.g., an mRNA) of the disclosure increases IL12B and/or IL12A protein expression levels and/or detectable IL12 enzymatic activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to IL12B and/or IL12A protein expression levels and/or detectable IL12 enzymatic activity levels in the cells prior to the administration of the polynucleotide of the disclosure. IL12B and/or IL12A protein expression levels and/or IL12 enzymatic activity can be measured according to methods know in the art. In some embodiments, the polynucleotide is introduced to the cells in vitro. In some embodiments, the polynucleotide is introduced to the cells in vivo.

In some embodiments, the IL12 polynucleotide (e.g., a RNA, e.g., an mRNA) comprises a nucleotide sequence (e.g., an ORF) that encodes a wild-type human IL12B and/or IL12A, (SEQ ID NO: 1035 and SEQ ID NO: 1037).

In some embodiments, the IL12 polynucleotide (e.g., a RNA, e.g., an mRNA) of the disclosure comprises a codon optimized nucleic acid sequence, wherein the open reading frame (ORF) of the codon optimized nucleic sequence is derived from a wild-type IL12A and/or IL12B sequence.

In some embodiments, the IL12 polynucleotide (e.g., a RNA, e.g., an mRNA) comprises a nucleotide sequence encoding IL12B and/or IL12A having the full length sequence of human IL12B and/or IL12A (i.e., including the initiator methionine and the signal peptides). In mature human IL12B and/or IL12A, the initiator methionine and/or signal peptides can be removed to yield a "mature IL12B" and/or "mature IL12A" comprising amino acid residues of SEQ ID NO: 1035 and SEQ ID NO: 1037, respectively. SEQ ID NO: 1035 corresponds to amino acids 23 to 328 of SEQ ID NO: 1259, and SEQ ID NO: 1037 corresponds to amino acids 336 to 532 of SEQ ID NO: 1259.

```
>hIL12AB_001
                                        (SEQ ID NO: 1259)
MCHQQLVISWFSLVFLASPLVAIWELKKDVYVVELDWYPDAPGEMVVLTC

DTPEEDGITWTLDQSSEVLGSGKTLTIQVKEFGDAGQYTCHKGGEVLSHS

LLLLHKKEDGIWSTDILKDQKEPKNKTFLRCEAKNYSGRFTCWWLTTIST

DLTFSVKSSRGSSDPQGVTCGAATLSAERVRGDNKEYEYSVECQEDSACP

AAEESLPIEVMVDAVHKLKYENYTSSFFIRDIIKPDPPKNLQLKPLKNSR

QVEVSWEYPDTWSTPHSYFSLTFCVQVQGKSKREKKDRVFTDKTSATVIC

RKNASISVRAQDRYYSSSWSEWASVPCSGGGGGGSRNLPVATPDPGMFPC

LHHSQNLLRAVSNMLQKARQTLEFYPCTSEEIDHEDITKDKTSTVEACLP

LELTKNESCLNSRETSFITNGSCLASRKTSFMMALCLSSIYEDLKMYQVE

FKTMNAKLLMDPKRQIFLDQNMLAVIDELMQALNFNSETVPQKSSLEEPD

FYKTKIKLCILLHAFRIRAVTIDRVMSYLNAS
```

The teachings of the present disclosure directed to the full sequence of human IL12B and/or IL12A are also applicable to the mature form of human IL12B and/or IL12A lacking the initiator methionine and/or the signal peptide. Thus, in some embodiments, the IL12 polynucleotide (e.g., a RNA, e.g., an mRNA) comprises a nucleotide sequence encoding IL12B and/or IL12A having the mature sequence of human IL12B and/or IL12A. In some embodiments, the polynucleotide (e.g., a RNA, e.g., an mRNA) of the disclosure comprising a nucleotide sequence encoding IL12B and/or IL12A is sequence optimized.

In some embodiments, the IL12 polynucleotide (e.g., a RNA, e.g., an mRNA) comprises a nucleotide sequence (e.g., an ORF) encoding a mutant IL12B and/or IL12A polypeptide. In some embodiments, the IL12 polynucleotide (e.g., a RNA, e.g., an mRNA) comprises an ORF encoding an IL12B and/or IL12A polypeptide that comprises at least one point mutation in the IL12B and/or IL12A sequence and retains IL12B and/or IL12A enzymatic activity. In some embodiments, the mutant IL12B and/or IL12A polypeptide has an IL12B and/or IL12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL12B and/or IL12A activity of the corresponding wild-type IL12B and/or IL12A (i.e., the same IL12B and/or IL12A but without the mutation(s)). In some embodiments, the IL12 polynucleotide (e.g., a RNA, e.g., an mRNA) comprising an ORF encoding a mutant IL12B and/or IL12A polypeptide is sequence optimized.

In some embodiments, the IL12 polynucleotide (e.g., a RNA, e.g., an mRNA) comprises a nucleotide sequence (e.g., an ORF) that encodes an IL12B and/or IL12A polypeptide with mutations that do not alter IL12B and/or IL12A enzymatic activity. Such mutant IL12B and/or IL12A polypeptides can be referred to as function-neutral. In some embodiments, the IL12 polynucleotide comprises an ORF that encodes a mutant IL12B and/or IL12A polypeptide comprising one or more function-neutral point mutations.

In some embodiments, the mutant IL12B and/or IL12A polypeptide has higher IL12B and/or IL12A enzymatic activity than the corresponding wild-type IL12B and/or IL12A. In some embodiments, the mutant IL12B and/or IL12A polypeptide has an IL12B and/or IL12A activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type IL12B and/or IL12A (i.e., the same IL12B and/or IL12A but without the mutation(s)).

In some embodiments, the IL12 polynucleotide (e.g., a RNA, e.g., an mRNA) comprises a nucleotide sequence (e.g., an ORF) encoding a functional IL12B and/or IL12A fragment, e.g., where one or more fragments correspond to a polypeptide subsequence of a wild type IL12B and/or IL12A polypeptide and retain IL12B and/or IL12A enzymatic activity. In some embodiments, the IL12B and/or IL12A fragment has an IL12B and/or IL12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL12 activity of the corresponding full length IL12B and/or IL12A. In some embodiments, the IL12 polynucleotide (e.g., a RNA, e.g., an mRNA) comprising an ORF encoding a functional IL12B and/or IL12A fragment is sequence optimized.

In some embodiments, the IL12 polynucleotide (e.g., a RNA, e.g., an mRNA) of the disclosure comprises a nucleotide sequence (e.g., an ORF) encoding an IL12B and/or IL12A fragment that has higher IL12B and/or IL12A enzymatic activity than the corresponding full length IL12B and/or IL12A. Thus, in some embodiments the IL12B and/or IL12A fragment has an IL12B and/or IL12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the IL12B and/or IL12A activity of the corresponding full length IL12B and/or IL12A.

In some embodiments, the IL12 polynucleotide (e.g., a RNA, e.g., an mRNA) of the disclosure comprises a nucleotide sequence (e.g., an ORF) encoding an IL12B and/or IL12A fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type IL12B and/or IL12A.

In other embodiments, the IL12 polynucleotide (e.g., a RNA, e.g., an mRNA) of the disclosure comprises a nucleotide sequence (e.g., an ORF) encoding an IL12B polypeptide, which has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_007, hIL12AB_010, or hIL12AB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_018 or hIL12AB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_005, hIL12AB_013, or hIL12AB_017 or nucleotides 70-987 of hIL12AB_004;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_001 or hIL12AB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_012 or hIL12AB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_022 or hIL12AB_038;

(viii) at least 90%, at least 91%, at least 92%, at least 93%, at least 94%, at least 95%, at least 96%, at least 97%, at least 98%, at least 99%, or 100% sequence identity to nucleotides 67-984 of hIL12AB_024, hIL12AB_031, hIL12AB_032, or hIL12AB_036;

(ix) at least 91%, at least 92%, at least 93%, at least 94%, at least 95%, at least 96%, at least 97%, at least 98%, at least 99%, or 100% sequence identity to nucleotides 67-984 of hIL12AB_021, hIL12AB_023, hIL12AB_025, hIL12AB_026, hIL12AB_027, hIL12AB_029, hIL12AB_030, hIL12AB_034, hIL12AB_039, or hIL12AB_040;

(x) at least 92%, at least 93%, at least 94%, at least 95%, at least 96%, at least 97%, at least 98%, at least 99%, or 100% sequence identity to nucleotides 67-984 of hIL12AB_016, hIL12AB_035, or hIL12AB_037;

(xi) at least 93%, at least 94%, at least 95%, at least 96%, at least 97%, at least 98%, at least 99%, or 100% sequence identity to nucleotides 67-984 of hIL12AB_011, hIL12AB_028, or hIL12AB_033;

(xii) at least 94%, at least 95%, at least 96%, at least 97%, at least 98%, at least 99%, or 100% sequence identity to nucleotides 67-984 of hIL12AB_015;

(xiii) at least 95%, at least 96%, at least 97%, at least 98%, at least 99%, or 100% sequence identity to nucleotides 67-984 of hIL12AB_020; or (xiv) 100% sequence identity to nucleotides 67-984 of hIL12AB_006.

In other embodiments, the IL12 polynucleotide (e.g., a RNA, e.g., an mRNA) of the disclosure comprises a nucleotide sequence (e.g., an ORF) encoding an IL12A polypeptide, which has:

(i) at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_010;

(ii) at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_019;

(iii) at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_013;

(iv) at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_007 or hIL12AB_014;

(v) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_002, hIL12AB_008;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_012 or hIL12AB_005;

(vii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_001, or hIL12AB_009 or nucleotides 1009-1589 of hIL12AB_004;

(viii) at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_17;

(ix) at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_029 or hIL12AB_027;

(x) at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_039 or hIL12AB_040;

(xi) at least 91%, at least 92%, at least 93%, at least 94%, at least 95%, at least 96%, at least 97%, at least 98%, at least 99%, or 100% sequence identity to nucleotides 1006-1596 of hIL12AB_036, hIL12AB_034, hIL12AB_016, hIL12AB_023, hIL12AB_030, hIL12AB_031, hIL12AB_025, or hIL12AB_035;

(xii) at least 92%, at least 93%, at least 94%, at least 95%, at least 96%, at least 97%, at least 98%, at least 99%, or 100% sequence identity to hIL12AB_021, hIL12AB_024, hIL12AB_032, hIL12AB_033, hIL12AB_037, or hIL12AB_022;

(xiii) at least 93%, at least 94%, at least 95%, at least 96%, at least 97%, at least 98%, at least 99%, or 100% sequence identity to nucleotides 1006-1596 of hIL12AB_020, hIL12AB_026, or hIL12AB_038;

(xiv) at least 94%, at least 95%, at least 96%, at least 97%, at least 98%, at least 99%, or 100% sequence identity to nucleotides 1006-1596 of hIL12AB_015, hIL12AB_011, or hIL12AB_028; or (xv) 100% sequence identity to nucleotides 1006-1596 of hIL12AB_003.

In certain embodiments, the IL12 polynucleotide (e.g., a RNA, e.g., an mRNA) of the disclosure comprises a first ORF encoding IL12B and a second ORF encoding IL12A, wherein the first ORF comprises a sequence that has:

(i) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_007, hIL12AB_010, or hIL12AB_012;

(ii) at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_018 or hIL12AB_019;

(iii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_008;

(iv) at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_005, hIL12AB_013, or hIL12AB_017 or nucleotides 70-987 of hIL12AB_004;

(v) at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_001 or hIL12AB_009;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_012 or hIL12AB_005;

(vii) at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_022 or hIL12AB_038;

(viii) at least 90%, at least 91%, at least 92%, at least 93%, at least 94%, at least 95%, at least 96%, at least 97%, at least 98%, at least 99%, or 100% sequence identity to nucleotides 67-984 of hIL12AB_024, hIL12AB_031, hIL12AB_032, or hIL12AB_036;

(ix) at least 91%, at least 92%, at least 93%, at least 94%, at least 95%, at least 96%, at least 97%, at least 98%, at least 99%, or 100% sequence identity to nucleotides 67-984 of hIL12AB_021, hIL12AB_023, hIL12AB_025, hIL12AB_026, hIL12AB_027, hIL12AB_029, hIL12AB_030, hIL12AB_034, hIL12AB_039, or hIL12AB_040;

(x) at least 92%, at least 93%, at least 94%, at least 95%, at least 96%, at least 97%, at least 98%, at least 99%, or 100% sequence identity to nucleotides 67-984 of hIL12AB_016, hIL12AB_035, or hIL12AB_037;

(xi) at least 93%, at least 94%, at least 95%, at least 96%, at least 97%, at least 98%, at least 99%, or 100% sequence identity to nucleotides 67-984 of hIL12AB_011, hIL12AB_028, or hIL12AB_033;

(xii) at least 94%, at least 95%, at least 96%, at least 97%, at least 98%, at least 99%, or 100% sequence identity to nucleotides 67-984 of hIL12AB_015;

(xiii) at least 95%, at least 96%, at least 97%, at least 98%, at least 99%, or 100% sequence identity to nucleotides 67-984 of hIL12AB_020; or (xiv) 100% sequence identity to nucleotides 67-984 of hIL12AB_006 and/or wherein the second ORF comprises a sequence that has:

(i) at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_010;

(ii) at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_019;

(iii) at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_013;

(iv) at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_007 or hIL12AB_014;

(v) at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_002, hIL12AB_008;

(vi) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_012 or hIL12AB_005;

(vii) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_001, or hIL12AB_009 or nucleotides 1009-1599 of hIL12AB_004;

(viii) at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_17;

(ix) at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_029 or hIL12AB_027;

(x) at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_039 or hIL12AB_040;

(xi) at least 91%, at least 92%, at least 93%, at least 94%, at least 95%, at least 96%, at least 97%, at least 98%, at least 99%, or 100% sequence identity to nucleotides 1006-1596 of hIL12AB_036, hIL12AB_034, hIL12AB_016, hIL12AB_023, hIL12AB_030, hIL12AB_031, hIL12AB_025, or hIL12AB_035;

(xii) at least 92%, at least 93%, at least 94%, at least 95%, at least 96%, at least 97%, at least 98%, at least 99%, or 100% sequence identity to hIL12AB_021, hIL12AB_024, hIL12AB_032, hIL12AB_033, hIL12AB_037, or hIL12AB_022;

(xiii) at least 93%, at least 94%, at least 95%, at least 96%, at least 97%, at least 98%, at least 99%, or 100% sequence identity to nucleotides 1006-1596 of hIL12AB_020, hIL12AB_026, or hIL12AB_038;

(xiv) at least 94%, at least 95%, at least 96%, at least 97%, at least 98%, at least 99%, or 100% sequence identity to nucleotides 1006-1596 of hIL12AB_015, hIL12AB_011, or hIL12AB_028; or (xv) 100% sequence identity to nucleotides 1006-1596 of hIL12AB_003.

In one embodiment, the first ORF encoding the IL12B polypeptide and the second ORF encoding the IL12A polypeptide are fused directly or by a linker. In another embodiment, the first ORF encoding the IL12B polypeptide and the second ORF encoding the IL12A polypeptide are not fused to each other.

In some embodiments, the IL12 polynucleotide (e.g., a RNA, e.g., an mRNA) comprises a nucleotide sequence (e.g., an ORF) encoding an IL12B-IL12A fusion polypeptide (e.g., the wild-type sequence, functional fragment, or variant thereof), wherein the nucleotide sequence has at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 1041 to 1080. See TABLE 14.

In some embodiments, the IL12 polynucleotide (e.g., a RNA, e.g., an mRNA) comprises a nucleotide sequence (e.g., an ORF) encoding an IL12B-IL12A fusion polypeptide (e.g., the wild-type sequence, functional fragment, or variant thereof), wherein the nucleotide sequence has 70% to 100%, 75% to 100%, 80% to 100%, 85% to 100%, 70% to 95%, 80% to 95%, 70% to 85%, 75% to 90%, 80% to 95%, 70% to 75%, 75% to 80%, 80% to 85%, 85% to 90%, 90% to 95%, or 95% to 100%, sequence identity to a sequence selected from the group consisting of SEQ ID NOs: 1041 to 1080. See TABLE 14.

In some embodiments, the IL12 polynucleotide (e.g., a RNA, e.g., an mRNA) comprises from about 900 to about 100,000 nucleotides (e.g., from 900 to 1,000, from 900 to 1,100, from 900 to 1,200, from 900 to 1,300, from 900 to 1,400, from 900 to 1,500, from 1,000 to 1,100, from 1,000 to 1,100, from 1,000 to 1,200, from 1,000 to 1,300, from 1,000 to 1,400, from 1,000 to 1,500, from 1,083 to 1,200, from 1,083 to 1,400, from 1,083 to 1,600, from 1,083 to 1,800, from 1,083 to 2,000, from 1,083 to 3,000, from 1,083 to 5,000, from 1,083 to 7,000, from 1,083 to 10,000, from 1,083 to 25,000, from 1,083 to 50,000, from 1,083 to 70,000, or from 1,083 to 100,000).

In some embodiments, the IL12 polynucleotide (e.g., a RNA, e.g., an mRNA) comprises a nucleotide sequence (e.g., an ORF) encoding an IL12B-IL12A fusion polypeptide (e.g., the wild-type sequence, functional fragment, or variant thereof), wherein the length of the nucleotide sequence (e.g., an ORF) is at least 500 nucleotides in length (e.g., at least or greater than about 500, 600, 700, 80, 900, 1,000, 1,050, 1,083, 1,100, 1,200, 1,300, 1,400, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IL12 polynucleotide (e.g., a RNA, e.g., an mRNA) comprises a nucleotide sequence (e.g., an ORF) encoding an IL12B and/or IL12A polypeptide (e.g., the wild-type sequence, functional fragment, or variant thereof) further comprises at least one nucleic acid sequence that is noncoding, e.g., a miRNA binding site.

In some embodiments, the IL12 polynucleotide (e.g., a RNA, e.g., an mRNA) comprises a nucleotide sequence (e.g., an ORF) encoding an IL12B and/or IL12A polypeptide is single stranded or double stranded.

In some embodiments, the IL12 polynucleotide comprising a nucleotide sequence (e.g., an ORF) encoding an IL12B and/or IL12A polypeptide (e.g., the wild-type sequence, functional fragment, or variant thereof) is DNA or RNA. In some embodiments, the IL12 polynucleotide is RNA. In some embodiments, the IL12 polynucleotide is, or functions as, a messenger RNA (mRNA). In some embodiments, the mRNA comprises a nucleotide sequence (e.g., an ORF) that encodes at least one IL12B and/or IL12A polypeptide, and is capable of being translated to produce the encoded IL12B and/or IL12A polypeptide in vitro, in vivo, in situ or ex vivo.

In some embodiments, the IL12 polynucleotide (e.g., a RNA, e.g., an mRNA) comprises a sequence-optimized nucleotide sequence (e.g., an ORF) encoding an IL12B and/or IL12A polypeptide (e.g., the wild-type sequence, functional fragment, or variant thereof), wherein the IL12 polynucleotide comprises at least one chemically modified nucleobase, e.g., 5-methoxyuracil. In some embodiments, the IL12 polynucleotide further comprises a miRNA binding site, e.g., a miRNA binding site that binds to miR-122. In some embodiments, the IL12 polynucleotide disclosed herein is formulated with a delivery agent, e.g., a compound having Formula (I), e.g., any of Compounds 1-147.

The IL12 polynucleotides (e.g., a RNA, e.g., an mRNA) of the disclosure can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the polynucleotide (e.g., a RNA, e.g., an mRNA) comprises a nucleotide sequence (e.g., an ORF) that encodes a signal peptide operably linked a nucleotide sequence that encodes an IL12B and/or IL12A polypeptide described herein.

In some embodiments, the signal sequence or signal peptide is a polynucleotide or polypeptide, respectively, which is from about 9 to 200 nucleotides (3-70 amino acids) in length that, optionally, is incorporated at the 5' (or N-terminus) of the coding region or the polypeptide, respectively. Addition of these sequences results in trafficking the encoded polypeptide to a desired site, such as the endoplasmic reticulum or the mitochondria through one or more targeting pathways. Some signal peptides are cleaved from the protein, for example by a signal peptidase after the proteins are transported to the desired site.

In some embodiments, the IL12 polynucleotide comprises a nucleotide sequence encoding an IL12B and/or IL12A polypeptide, wherein the nucleotide sequence further comprises a 5' nucleic acid sequence encoding a native signal peptide. In another embodiment, the IL12 polynucleotide comprises a nucleotide sequence encoding an IL12B and/or IL12A polypeptide, wherein the nucleotide sequence lacks the nucleic acid sequence encoding a native signal peptide.

In some embodiments, the IL12 polynucleotide of the disclosure comprises a nucleotide sequence encoding an IL12B and/or IL12A polypeptide, wherein the nucleotide sequence further comprises a 5' nucleic acid sequence encoding a heterologous signal peptide.

IL12 Chimeric Proteins:

In some embodiments, the IL12 polynucleotide (e.g., a RNA, e.g., an mRNA) can comprise more than one nucleic acid sequence (e.g., an ORF) encoding a polypeptide of interest. In some embodiments, the IL12 polynucleotide comprises a single ORF encoding an IL12B and/or IL12A polypeptide, a functional fragment, or a variant thereof. However, in some embodiments, the IL12 polynucleotide of the disclosure can comprise more than one ORF, for example, a first ORF encoding an IL12B polypeptide (a first polypeptide of interest), a functional fragment, or a variant thereof, a second ORF encoding an IL12A polypeptide (a second polypeptide of interest), a functional fragment, or a variant thereof, and a third ORF expressing a third polypeptide of interest (e.g., a polypeptide heterologous to IL12). In one embodiment, the third polypeptide of interest can be fused to the IL12B polypeptide directly or by a linker. In another embodiment, the third polypeptide of interest can be fused to the IL12A polypeptide directly or by a linker. In other embodiments, the third polypeptide of interest can be fused to both the IL12B polypeptide and the IL12A polypeptide directly or by a linker. In further embodiments, the IL12 polynucleotide of the disclosure can comprise more than three ORFs, for example, a first ORF encoding an IL12B polypeptide (a first polypeptide of interest), a functional fragment, or a variant thereof, a second ORF encoding an IL12A polypeptide (a second polypeptide of interest), a functional fragment, or a variant thereof, a third ORF expressing a third polypeptide of interest, and a fourth ORF expressing a fourth polypeptide of interest. In other embodiments, the third polypeptide of interest is fused to the IL12A polypeptide directly or by a linker, and the fourth polypeptide of interest is fused to the IL12B polypeptide directly or by a linker. In some embodiments, two or more polypeptides of interest can be genetically fused, i.e., two or more polypeptides can be encoded by the same ORF. In some embodiments, the polynucleotide can comprise a nucleic acid sequence encoding a linker (e.g., a $G_4S$ peptide linker or another linker known in the art) between two or more polypeptides of interest.

In some embodiments, an IL12 polynucleotide of the disclosure (e.g., a RNA, e.g., an mRNA) can comprise two, three, four, or more ORFs, each expressing a polypeptide of interest.

In some embodiments, the IL12 polynucleotide (e.g., a RNA, e.g., an mRNA) can comprise a first nucleic acid sequence (e.g., a first ORF) encoding an IL12B polypeptide, IL12A polypeptide, or both IL12B and IL12A polypeptides and a second nucleic acid sequence (e.g., a second ORF) encoding a second polypeptide of interest.

Linkers in IL12 Chimeric Constructs:

In one aspect, the IL12B polypeptide and/or IL12A polypeptide in an IL12 polypeptide disclosed herein can be fused directly or by a linker. In other embodiments, the IL12B polypeptide and/or IL12A polypeptide can be fused directly to by a linker to a heterologous polypeptide. The linkers suitable for fusing the IL12B polypeptide to the IL12A polypeptide or the IL12B polypeptide and/or the IL12A polypeptide to a heterologous polypeptide can be a polypeptide (or peptide) moiety or a non-polypeptide moiety.

In some embodiments, the linker is a peptide linker, including from one amino acid to about 200 amino acids. In some embodiments, the linker comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, or at least 40 amino acids.

In some embodiments, the linker in the IL12 chimeric construct can be a GS (Gly/Ser) linker, for example, comprising $(G_nS)_m$, wherein n is an integer from 1 to 20 and m is an integer from 1 to 20. In some embodiments, the GS linker can comprise $(GGGGS)_o$(SEQ ID NO:1010) wherein o is an integer from 1 to 5. In some embodiments, the GS linker can comprise GGSGGGGSGG (SEQ ID NO:1011), GGSGGGGG (SEQ ID NO:1012), or GSGSGSGS (SEQ ID NO:1013).

In some embodiments, the linker suitable in the IL12 chimeric construct can be a Gly-rich linker, for example, comprising $(Gly)_p$, wherein p is an integer from 1 to 40. In some embodiments, a Gly-rich linker can comprise GGGGG (SEQ ID NO:1015), GGGGGG (SEQ ID NO:1016), GGGGGGG (SEQ ID NO:1017) or GGGGGGGG (SEQ ID NO:1018).

In some embodiments, the linker suitable for the disclosure can comprise $(EAAAK)_q$ (SEQ ID NO:1019), wherein q is an integer from 1 to 5. In one embodiment, the linker suitable for the disclosure can comprise $(EAAAK)_3$ (SEQ ID NO:1020).

Further exemplary linkers include, but not limited to, GGGGSLVPRGSGGGGS (SEQ ID NO:1021), GSGSGS (SEQ ID NO:1022), GGGGSLVPRGSGGGG (SEQ ID NO:1023), GGSGGHMGSGG (SEQ ID NO:1024), GGSGGSGGSGG (SEQ ID NO:1025), GGSGG (SEQ ID NO:1026), GSGSGSGS (SEQ ID NO:1027), GGGSEGGGSEGGGSEGGG (SEQ ID NO:1028), AAGAATAA (SEQ ID NO:1029), GGSSG (SEQ ID NO:1030), GSGGGTGGGSG (SEQ ID NO:1031), GSGSGSGSGGSG (SEQ ID NO:1032), GSGGSGSGGSGGSG (SEQ ID NO:1023), and GSGGSGGSGGSGGS (SEQ ID NO:1024). The nucleotides encoding the linkers can be constructed to fuse the IL12 ORFs of the present disclosure.

Sequence-Optimized Nucleotide Sequences Encoding IL12 Polypeptides:

In some embodiments, the IL12 polynucleotide of the disclosure comprises a sequence-optimized nucleotide sequence encoding an IL12B and/or IL12A polypeptide disclosed herein. In some embodiments, the IL12 polynucleotide of the disclosure comprises an open reading frame (ORF) encoding an IL12B and/or IL12A polypeptide, wherein the ORF has been sequence optimized.

Exemplary sequence-optimized nucleotide sequences encoding human IL12B and/or IL12A are shown in Table 3. In some embodiments, the sequence optimized IL12B and/or IL12A sequences in TABLE 14, fragments, and variants thereof are used to practice the methods disclosed herein. In some embodiments, the sequence optimized IL12B and/or IL12A sequences in TABLE 14, fragments and variants thereof are combined with or alternatives to the wild-type sequences disclosed in FIG. 109A.

TABLE 14

| Sequence optimized Open Reading Frame sequences for human IL12 |
|---|
| >hIL12AB_001 (SEQ ID NO: 1041)<br>ATGTGTCACCAGCAGCTGGTCATTAGCTGGTTTAGCCTTGTGTTCCTGGCCTCCCCCCTTGTCGCTATTTGGGAGCTCAAGAAG<br>GACGTGTACGTGGTGGAGCTGGACTGGTACCCAGACGCGCCCGGAGAGATGGTAGTTCTGACCTGTGATACCCCAGAGGAGGAC<br>GGCATCACCTGGACTCTGGACCAAAGCAGCGAGGTTTTGGGCTCAGGGAAAACGCTGACCATCCAGGTGAAGGAATTCGGCGAC<br>GCCGGACAGTACACCTGCCATAAGGGAGGAGAGGTGCTGAGCCATTCCCTTCTTCTGCTGCACAAGAAAGAGGACGGCATCTGG<br>TCTACCGACATCCTGAAAGACCAGAAGGAGCCCAAGAACAAAACCTTCCTGAGGTGCGAGGCCAAGAACTACTCCGGCAGGTTC<br>ACTTGTTGGTGGCTGACCACCATCAGTACAGACCTGACTTTTAGTGTAAAAAGCTCCAGAGGCTCGTCCGATCCCCAAGGGGTG<br>ACCTGCGGCGCAGCCACTCTGAGCGCTGAGCGCGTGCGCGGTGACAATAAAGAGTACGAGTACAGCGTTGAGTGTCAAGAAGAC<br>AGCGCTTGCCCTGCCGCCGAGGAGAGCCTGCCTATCGAGGTGATGGTTGACGCAGTGCACAAGCTTAAGTACGAGAATTACACC<br>AGCTCATTCTTCATTAGAGATATAATCAAGCCTGACCCACCCAAGAACCTGCAGCTGAAGCCACTGAAAAACTCACGGCAGGTC<br>GAAGTGAGCTGGGAGTACCCCGACACCTGGAGCACTCCTCATTCCTATTTCTCTCTTACATTCTGCGTCCAGGTGCAGGGCAAG<br>AGCAAGCGGGAAAAGAAGGATCGAGTCTTCACCGACAAAACAAGCGCGACCGTGATTTGCAGGAAGAACGCCAGCATCTCCGTC<br>AGAGCCCAGGATAGATACTATAGTAGCAGCTGGAGCGAGTGGGCAAGCGTGCCCTGTTCCGGCGGCGGGGGCGGGGGCAGCCGA<br>AACTTGCCTGTCGCTACCCCGGACCCTGGAATGTTTCCGTGTCTGCACCACAGCCAGAACCTGCTGAGAGCCGTGTCGAATATG<br>CTCCAGAAGGCCCGGCAGACCCTTGAGTTCTACCCCTGTACCAGCGAAGAGATCGATCATGAGGACATCACGAAAGACAAGACT<br>TCCACCGTCGAGGCTTGTCTCCCGCTGGAGCTGACCAAGAACGAGAGCTGTCTGAATAGCCGGGAGACATCTTTCATCACGAAT<br>GGTAGCTGTCTGGCCAGCAGGAAAACTTCCTTCATGATGGCTCTCTGCCTGAGCTCTATCTATGAAGATCTGAAGATGTATCAG<br>GTGGAGTTTAAGACTATGAACGCCAAACTCCTGATGGACCCAAAAAGGCAAATCTTTCTGGACCAGAATATGCTGGCCGTGATA<br>GACGAGCTGATGCAGGCACTGAACTTCAACAGCGAGACAGTGCCACAGAAATCCAGCCTGGAGGAGCCTGACTTTTACAAAACT<br>AAGATCAAGCTGTGTATCCTGCTGCACGCCTTTAGAATCCGTGCCGTGACTATCGACAGGGTGATGTCATACCTCAACGCTTCA |

TABLE 14-continued

Sequence optimized Open Reading Frame sequences for human IL12

>hIL12AB_002 (SEQ ID NO: 1042)
ATGTGCCACCAGCAGCTGGTGATCAGCTGGTTCAGCCTGGTGTTCCTGGCCAGCCCCCTGGTGGCCATCTGGGAGCTGAAGAAG
GACGTGTACGTGGTGGAGCTGGACTGGTACCCCGACGCCCCCGGCGAGATGGTGGTGCTGACCTGCGACACCCCCGAGGAGGAC
GGCATCACCTGGACCCTGGACCAGAGCAGCGAGGTGCTGGGCAGCGGCAAGACCCTGACCATCCAGGTGAAGGAGTTCGGCGAC
GCCGGCCAGTACACCTGCCACAAGGGCGGCGAGGTGCTGAGCCACAGCCTGCTGCTGCTGCACAAGAAGGAGGACGGCATCTGG
AGCACCGACATCCTGAAGGACCAGAAGGAGCCCAAGAACAAGACCTTCCTGAGATGCGAGGCCAAGAACTACAGCGGCAGATTC
ACCTGCTGGTGGCTGACCACCATCAGCACCGACCTGACCTTCAGCGTGAAGAGCAGCAGAGGCAGCAGCGACCCCCAGGGCGTG
ACCTGCGGCGCCGCCACCCTGAGCGCCGAGAGAGTGAGAGGCGACAACAAGGAGTACGAGTACAGCGTGGAGTGCCAGGAGGAC
AGCGCCTGCCCCGCCGCCGAGGAGAGCCTGCCCATCGAGGTGATGGTGGACGCCGTGCACAAGCTGAAGTACGAGAACTACACC
AGCAGCTTCTTCATCAGAGACATCATCAAGCCCGACCCCCCCAAGAACCTGCAGCTGAAGCCCCTGAAGAACAGCAGACAGGTG
GAGGTGAGCTGGGAGTACCCCGACACCTGGAGCACCCCCCACAGCTACTTCAGCCTGACCTTCTGCGTGCAGGTGCAGGGCAAG
AGCAAGAGAGAGAAGAAGGACAGAGTGTTCACCGACAAGACCAGCGCCACCGTGATCTGCAGAAAGAACGCCAGCATCAGCGTG
AGAGCCCAGGACAGATACTACAGCAGCAGCTGGAGCGAGTGGGCCAGCGTGCCCTGCAGCGGCGGCGGCGGCGGCGGCAGCAGA
AACCTGCCCGTGGCCACCCCCGACCCCGGCATGTTCCCCTGCCTGCACCACAGCCAGAACCTGCTGAGAGCCGTGAGCAACATG
CTGCAGAAGGCCAGACAGACCCTGGAGTTCTACCCCTGCACCAGCGAGGAGATCGACCACGAGGACATCACCAAGGACAAGACC
AGCACCGTGGAGGCCTGCCTGCCCCTGGAGCTGACCAAGAACGAGAGCTGCCTGAACAGCAGAGAGACCAGCTTCATCACCAAC
GGCAGCTGCCTGGCCAGCAGAAAGACCAGCTTCATGATGGCCCTGTGCCTGAGCAGCATCTACGAGGACCTGAAGATGTACCAG
GTGGAGTTCAAGACCATGAACGCCAAGCTGCTGATGGACCCCAAGAGACAGATCTTCCTGGACCAGAACATGCTGGCCGTGATC
GACGAGCTGATGCAGGCCCTGAACTTCAACAGCGAGACCGTGCCCCAGAAGAGCAGCCTGGAGGAGCCCGACTTCTACAAGACC
AAGATCAAGCTGTGCATCCTGCTGCACGCCTTCAGAATCAGAGCCGTGACCATCGACAGAGTGATGAGCTACCTGAACGCCAGC

>hIL12AB_003 (SEQ ID NO: 1043)
ATGTGTCACCAGCAGTTGGTCATCTCTTGGTTTTCCCTGGTTTTTCTGGCATCTCCCCTCGTGGCCATATGGGAACTGAAGAAA
GATGTTTATGTCGTAGAATTGGATTGGTATCCGGATGCCCCTGGAGAAATGGTGGTCCTCACCTGTGACACCCCTGAAGAAGAT
GGTATCACCTGGACCTTGGACCAGAGCAGTGAGGTCTTAGGCTCTGGCAAAACCCTGACCATCCAAGTCAAAGAGTTTGGAGAT
GCTGGCCAGTACACCTGTCACAAAGGAGGCGAGGTTCTAAGCCATTCGCTCCTGCTGCTTCACAAAAAGGAAGATGGAATTTGG
TCCACTGATATTTTAAAGGACCAGAAAGAACCCAAAAATAAGACCTTTCTAAGATGCGAGGCCAAGAATTATTCTGGACGTTTC
ACCTGCTGGTGGCTGACGACAATCAGTACTGATTTGACATTCAGTGTCAAAAGCAGCAGAGGCTCTTCTGACCCCCAAGGGGTG
ACGTGCGGAGCTGCTACACTCTCTGCAGAGAGAGTCAGAGGGGACAACAAGGAGTATGAGTACTCAGTGGAGTGCCAGGAGGAC
AGTGCCTGCCCAGCTGCTGAGGAGAGTCTGCCCATTGAGGTCATGGTGGATGCCGTTCACAAGCTCAAGTATGAAAACTACACC
AGCAGCTTCTTCATCAGGGACATCATCAAACCTGACCCACCCAAGAACTTGCAGCTGAAGCCATTAAAGAATTCTCGGCAGGTG
GAGGTCAGCTGGGAGTACCCTGACACCTGGAGTACTCCACATTCCTACTTCTCCCTGACATTCTGCGTTCAGGTCCAGGGCAAG
AGCAAGAGAGAAAAGAAAGATAGAGTCTTCACGGACAAGACCTCAGCCACGGTCATCTGCCGCAAAAATGCCAGCATTAGCGTG
CGGGCCCAGGACCGCTACTATAGCTCATCTTGGAGCGAATGGGCATCTGTGCCCTGCAGTGGCGGAGGGGGCGGAGGGAGCAGA
AACCTCCCCGTGGCCACTCCAGACCCAGGAATGTTCCCATGCCTTCACCACTCCCAAAACCTGCTGAGGGCCGTCAGCAACATG
CTCCAGAAGGCCAGACAAACTTTAGAATTTTACCCTTGCACTTCTGAAGAGATTGATCATGAAGATATCACAAAAGATAAAACC
AGCACAGTGGAGGCCTGTTTACCATTGGAATTAACCAAGAATGAGAGTTGCCTAAATTCCAGAGAGACCTCTTTCATAACTAAT
GGGAGTTGCCTGGCCTCCAGAAAGACCTCTTTTATGATGGCCCTGTGCCTTAGTAGTATTTATGAAGACTTGAAGATGTACCAG
GTGGAGTTCAAGACCATGAATGCAAAGCTTCTGATGGATCCTAAGAGGCAGATCTTTTTAGATCAAAACATGCTGGCAGTTATT
GATGAGCTGATGCAGGCCCTGAATTTCAACAGTGAGACTGTGCCACAAAAATCCTCCCTTGAAGAACCGGACTTCTACAAGACC
AAGATCAAGCTCTGCATACTTCTTCATGCTTTCAGAATTCGGGCAGTGACTATTGATAGAGTGATGAGCTATCTGAATGCTTCC

>hIL12AB_004 (SEQ ID NO: 1044)
ATGGGCTGCCACCAGCAGCTGGTCATCAGCTGGTTCTCCCTGGTCTTCCTGGCCAGCCCCCTGGTGGCCATCTGGGAGCTGAAG
AAAGATGTCTATGTTGTAGAGCTGGACTGGTACCCAGATGCTCCTGGAGAAATGGTGGTTCTCACCTGTGACACGCCAGAAGAA
GATGGCATCACCTGGACGCTGGACCAGAGCTCAGAAGTTCTTGGCAGTGGAAAAACGCTGACCATACAAGTAAAAGAATTTGGG
GATGCTGGCCAGTACACCTGCCACAAAGGAGGAGAAGTTCTCAGCCACAGCCTGCTGCTGCTGCACAAGAAAGAAGATGGCATC
TGGAGCACAGACATTTTAAAAGACCAGAAGGAGCCCAAGAACAAAACCTTCCTTCGATGTGAGGCCAAGAACTACAGTGGCCGC
TTCACCTGCTGGTGGCTCACCACCATCAGCACAGACCTCACCTTCTCGGTGAAGAGCAGCCGTGGCAGCTCAGACCCCCAAGGA
GTCACCTGTGGGGCGGCCACGCTGTCGGCAGAAAGAGTTCGAGGGGACAACAAGGAATATGAATACTCGGTGGAATGTCAAGAA
GACTCGGCCTGCCCGGCGGCAGAAGAAAGTCTTCCCATAGAAGTCATGGTGGATGCTGTTCACAAATTAAAATATGAAAACTAC
ACCAGCAGCTTCTTCATCAGAGACATCATCAAGCCAGACCCGCCCAAGAACCTGCAGCTGAAGCCCCTGAAGAACAGCAGACAA
GTGGAAGTTTCCTGGGAGTACCCAGACACGTGGAGCACGCCGCACAGCTACTTCAGCCTCACCTTCTGTGTACAAGTACAAGGC
AAGAGCAAGAGAGAGAAGAAAGATCGTGTCTTCACAGACAAAACCTCGGCGACGGTCATCTGCAGGAAGAATGCCTCCATCTCG
GTTCGAGCCCAGGACCGCTACTACAGCAGCAGCTGGAGTGAGTGGGCCTCGGTGCCCTGCAGTGGTGGCGGCGGCGGCGGCAGC
AGAAACCTTCCTGTGGCCACGCCGGACCCTGGCATGTTCCCGTGCCTGCACCACAGCCAAAATTTACTTCGAGCTGTTTCTAAC
ATGCTGCAGAAAGCAAGACAAACTTTAGAATTCTACCCCTGCACCTCAGAAGAAATAGACCATGAAGACATCACCAAAGATAAA
ACCAGCACTGTAGAGGCCTGCCTGCCCCTGGAGCTCACCAAGAATGAATCCTGCCTCAACAGCAGAGAGACCAGCTTCATCACC
AATGGCAGCTGCCTGGCCAGCAGGAAAACCAGCTTCATGATGGCGCTCTGCCTGAGCAGCATCTATGAAGATTTGAAGATGTAC
CAAGTAGAATTTAAAACCATGAATGCCAAGCTGCTCATGGACCCCAAGAGACAAATATTTTTGGATCAAAACATGCTGGCTGTC
ATTGATGAGCTCATGCAAGCATTAAACTTCAACTCAGAGACGGTGCCCCAGAAGAGCAGCCTGGAGGAGCCAGACTTCTACAAA
ACCAAGATCAAGCTCTGCATCTTATTACATGCCTTCCGCATCCGGGCGGTCACCATTGACCGTGTCATGTCCTACTTAAATGCC
AGC

>hIL12AB_005 (SEQ ID NO: 1045)
ATGTGCCACCAGCAGCTGGTCATCAGCTGGTTCTCCCTGGTCTTCCTGGCCAGCCCCCTGGTGGCCATCTGGGAGCTGAAGAAA
GATGTCTATGTTGTAGAGCTGGACTGGTACCCAGATGCTCCTGGAGAAATGGTGGTTCTCACCTGTGACACGCCAGAAGAAGAT
GGCATCACCTGGACGCTGGACCAGAGCTCAGAAGTTCTTGGCAGTGGAAAAACGCTGACCATACAAGTAAAAGAATTTGGGGAT
GCTGGCCAGTACACCTGCCACAAAGGAGGAGAAGTTCTCAGCCACAGCCTGCTGCTGCTGCACAAGAAAGAAGATGGCATCTGG
AGCACAGACATTTTAAAAGACCAGAAGGAGCCCAAGAACAAAACCTTCCTTCGATGTGAGGCCAAGAACTACAGTGGCCGCTTC
ACCTGCTGGTGGCTCACCACCATCAGCACAGACCTCACCTTCTCGGTGAAGAGCAGCCGTGGCAGCTCAGACCCCCAAGGAGTC
ACCTGTGGGGCGGCCACGCTGTCGGCAGAAAGAGTTCGAGGGGACAACAAGGAATATGAATACTCGGTGGAATGTCAAGAAGAC
TCGGCCTGCCCGGCGGCAGAAGAAAGTCTTCCCATAGAAGTCATGGTGGATGCTGTTCACAAATTAAAATATGAAAACTACACC
AGCAGCTTCTTCATCAGAGACATCATCAAGCCAGACCCGCCCAAGAACCTGCAGCTGAAGCCCCTGAAGAACAGCAGACAAGTG
GAAGTTTCCTGGGAGTACCCAGACACGTGGAGCACGCCGCACAGCTACTTCAGCCTCACCTTCTGTGTACAAGTACAAGGCAAG
AGCAAGAGAGAGAAGAAAGATCGTGTCTTCACAGACAAAACCTCGGCGACGGTCATCTGCAGGAAGAATGCCTCCATCTCGGTT
CGAGCCCAGGACCGCTACTACAGCAGCAGCTGGAGTGAGTGGGCCTCGGTGCCCTGCAGTGGTGGCGGCGGCGGCGGCAGCAGA
AACCTTCCTGTGGCCACGCCGGACCCTGGCATGTTCCCGTGCCTGCACCACAGCCAAAATTTACTTCGAGCTGTTTCTAACATG

TABLE 14-continued

Sequence optimized Open Reading Frame sequences for human IL12

CTGCAGAAAGCAAGACAAACTTTAGAATTCTACCCCTGCACCTCAGAAGAAATAGACCATGAAGACATCACCAAAGATAAAACC
AGCACTGTAGAGGCCTGCCTGCCCCTGGAGCTCACCAAGAATGAATCCTGCCTCAACAGCAGAGAGACCAGCTTCATCACCAAT
GGCAGCTGCCTGGCCAGCAGGAAAACCAGCTTCATGATGGCGCTCTGCCTGAGCAGCATCTATGAAGATTTGAAGATGTACCAA
GTAGAATTTAAAACCATGAATGCCAAGCTGCTCATGGACCCCAAGAGACAAATATTTTTGGATCAAAACATGCTGGCTGTCATT
GATGAGCTCATGCAAGCATTAAACTTCAACTCAGAGACGGTGCCCCAGAAGAGCAGCCTGGAGGAGCCAGACTTCTACAAAACC
AAGATCAAGCTCTGCATCTTATTACATGCCTTCCGCATCCGGGCGGTCACCATTGACCGTGTCATGTCCTACTTAAATGCCAGC

>hIL12AB_006 (SEQ ID NO: 1046)
ATGTGCCACCAGCAGCTGGTGATCAGCTGGTTCAGCCTGGTGTTCCTGGCCAGCCCCCTGGTGGCCATCTGGGAGCTGAAGAAG
GACGTGTACGTGGTGGAGCTGGACTGGTACCCCGACGCCCCCGGCGAGATGGTGGTGCTGACCTGTGACACCCCCGAGGAGGAC
GGCATCACCTGGACCCTGGACCAGAGCAGCGAGGTGCTGGGCAGCGGCAAGACCCTGACCATCCAGGTGAAGGAGTTCGGGGAC
GCCGGCCAGTACACCTGCCACAAGGGCGGCGAGGTGCTGAGCCACAGCCTGCTGCTGCTGCACAAGAAGGAGGACGGCATCTGG
AGCACAGATATCCTGAAGGACCAGAAGGAGCCCAAGAACAAGACCTTCCTGAGATGCGAGGCCAAGAACTACAGCGGCAGATTC
ACCTGCTGGTGGCTGACCACCATCAGCACAGACTTGACCTTCAGCGTGAAGAGCAGCAGAGGCAGCAGCGACCCCCAGGGCGTG
ACCTGCGGCGCCGCCACCCTGAGCGCCGAGAGAGTGAGAGGGGACAACAAGGAGTACGAGTACAGCGTGGAGTGCCAGGAGGAC
AGCGCCTGCCCCGCCGCCGAGGAGAGCCTGCCCATCGAGGTGATGGTGGACGCCGTGCACAAGCTGAAGTACGAGAACTACACC
AGCAGCTTCTTCATCAGAGACATCATCAAGCCCGACCCGCCGAAGAACCTGCAGCTGAAGCCCCTGAAGAACAGCAGACAGGTG
GAGGTGAGCTGGGAGTACCCCGACACCTGGAGCACCCCCCACAGCTACTTCAGCCTGACCTTCTGCGTGCAGGTGCAGGGCAAG
AGCAAGAGAGAGAAGAAGGACAGAGTGTTCACAGATAAGACCAGCGCCACCGTGATCTGCAGAAAGAACGCCAGCATCAGCGTG
AGAGCCCAGGACAGATACTACAGCAGCAGCTGGAGCGAGTGGGCCAGCGTGCCCTGCAGCGGCGGCGGCGGCGGCGGCAGCAGA
AACCTGCCCGTGGCCACCCCCGACCCCGGCATGTTCCCCTGCCTGCACCACAGCCAGAACCTGCTGAGAGCCGTGAGCAACATG
CTGCAGAAGGCCAGACAGACCCTGGAGTTCTACCCCTGCACCAGCGAGGAGATCGACCACGAGGACATCACCAAGGACAAGACC
AGCACCGTGGAGGCCTGCCTGCCCCTGGAGCTGACCAAGAATGAAAGCTGCCTGAACAGCAGAGAGACCAGCTTCATCACCAAC
GGCAGCTGCCTGGCCAGCAGAAAGACCAGCTTCATGATGGCCCTGTGCCTGAGCAGCATCTACGAGGACCTGAAGATGTACCAG
GTGGAGTTCAAGACCATGAACGCCAAGCTGCTGATGGACCCCAAGAGACAGATCTTCCTGGACCAGAACATGCTGGCCGTGATC
GACGAGCTGATGCAGGCCCTGAACTTCAACAGCGAGACCGTGCCCCAGAAGAGCAGCCTGGAGGAGCCCGACTTCTACAAGACC
AAGATCAAGCTGTGCATCCTGCTGCACGCCTTCAGAATCAGAGCCGTGACCATCGACAGAGTGATGAGCTACCTGAACGCCAGC

>hIL12AB_007 (SEQ ID NO: 1047)
ATGTGCCACCAGCAGCTTGTCATCTCCTGGTTCTCTCTTGTCTTCCTTGCTTCTCCTCTTGTGGCCATCTGGGAGCTGAAGAAG
GATGTTTATGTTGTGGAGTTGGACTGGTACCCTGATGCTCCTGGAGAAATGGTGGTTCTCACCTGTGACACTCCTGAGGAGGAT
GGCATCACCTGGACTTTGGACCAGTCTTCTGAGGTTCTTGGCAGTGGAAAAACTCTTACTATTCAGGTGAAGGAGTTTGGAGAT
GCTGGCCAGTACACCTGCCACAAGGGTGGTGAAGTTCTCAGCCACAGTTTACTTCTTCTTCACAAGAAGGAGGATGGCATCTGG
TCTACTGACATTTTAAAAGACCAGAAGGAGCCCAAGAACAAGACTTTCCTTCGTTGTGAAGCCAAGAACTACAGTGGTCGTTTC
ACCTGCTGGTGGCTTACTACTATTTCTACTGACCTTACTTTCTCTGTGAAGTCTTCTCGTGGCTCTTCTGACCCTCAGGGTGTC
ACCTGTGGGGCTGCTACTCTTTCTGCTGAGCGTGTGCGTGGGGACAACAAGGAGTATGAATACTCGGTGGAGTGCCAGGAGGAC
TCTGCCTGCCCTGCTGCTGAGGAGTCTCTTCCTATTGAGGTGATGGTGGATGCTGTGCACAAGTTAAAATATGAAAACTACACT
TCTTCTTTCTTCATTCGTGACATTATAAAACCTGACCCTCCCAAGAACCTTCAGTTAAAACCTTTAAAAAACTCTCGTCAGGTG
GAGGTGTCCTGGGAGTACCCTGACACGTGGTCTACTCCTCACTCCTACTTCTCTCTTACTTTCTGTGTCCAGGTGCAGGGCAAG
TCCAAGCGTGAGAAGAAGGACCGTGTCTTCACTGACAAGACTTCTGCTACTGTCATCTGCAGGAAGAATGCATCCATCTCTGTG
CGTGCTCAGGACCGTTACTACAGCTCTTCCTGGTCTGAGTGGGCTTCTGTGCCCTGCTCTGGCGGCGGCGGCGGCGGCAGCAGA
AATCTTCCTGTGGCTACTCCTGACCCTGGCATGTTCCCCTGCCTTCACCACTCGCAGAACCTTCTTCGTGCTGTGAGCAACATG
CTTCAGAAGGCTCGTCAGACTTTAGAATTCTACCCCTGCACTTCTGAGGAGATTGACCATGAAGACATCACCAAGGACAAGACT
TCTACTGTGGAGGCCTGCCTTCCTTTAGAGCTGACCAAGAATGAATCCTGCTTAAATTCTCGTGAGACTTCTTTCATCACCAAT
GGCAGCTGCCTTGCCTCGCGCAAGACTTCTTTCATGATGGCTCTTTGCCTTTCTTCCATCTATGAAGACTTAAAAATGTACCAG
GTGGAGTTCAAGACCATGAATGCAAAGCTTCTCATGGACCCCAAGCGTCAGATATTTTTGGACCAGAACATGCTTGCTGTCATT
GATGAGCTCATGCAGGCTTTAAACTTCAACTCTGAGACTGTGCCTCAGAAGTCTTCTTTAGAAGAGCCTGACTTCTACAAGACC
AAGATAAAACTTTGCATTCTTCTTCATGCTTTCCGCATCCGTGCTGTGACTATTGACCGTGTGATGTCCTACTTAAATGCTTCT

>hIL12AB_008 (SEQ ID NO: 1048)
ATGTGTCATCAACAACTCGTGATTAGCTGGTTCAGTCTCGTGTTCCTGGCCTCTCCGCTGGTGGCCATCTGGGAGCTTAAGAAG
GACGTGTACGTGGTGGAGCTCGATTGGTACCCCGATGCTCCTGGCGAGATGGTGGTGCTAACCTGCGATACCCCCGAGGAGGAC
GGGATCACTTGGACCCTGGATCAGAGTAGCGAAGTCCTGGGCTCTGGCAAGACACTCACAATCCAGGTGAAGGAATTCGGAGAC
GCTGGTCAGTACACTTGCCACAAGGGGGGTGAAGTGCTGTCTCACAGCCTGCTGTTACTGCACAAGAAGGAGGATGGGATCTGG
TCAACCGACATCCTGAAGGATCAGAAGGAGCCTAAGAACAAGACCTTTCTGAGGTGTGAAGCTAAGAACTATTCCGGAAGATTC
ACTTGCTGGTGGTTGACCACAATCAGCACTGACCTGACCTTTTCCGTGAAGTCCAGCAGAGGAAGCAGCGATCCTCAGGGCGTA
ACGTGCGGCGCGGCTACCCTGTCAGCTGAGCGGGTTAGAGGCGACAACAAAGAGTATGAGTACTCCGTGGAGTGTCAGGAGGAC
AGCGCCTGCCCCGCAGCCGAGGAGAGTCTGCCCATCGAGGTGATGGTGGACGCTGTCCATAAGTTAAAATACGAAAATTACACA
AGTTCCTTTTTCATCCGCGATATTATCAAACCCGATCCCCCCAAGAACCTGCAGCTGAAGCCCCTGAAGAATAGCCGACAGGTG
GAAGTCTCTTGGGAGTATCCTGACACCTGGTCCACGCCTCACAGCTACTTTAGTCTGACTTTCTGTGTCCAGGTCCAGGGCAAG
AGCAAGAGAGAGAAAAAGGATAGAGTGTTTACTGACAAGACATCTGCTACAGTCATCTGCAGAAAGAACGCCAGTATCTCAGTG
AGGGCGCAGGACAGATACTACAGTAGTAGCTGGAGCGAATGGGCTAGCGTGCCCTGTTCAGGGGGCGGCGGAGGGGGCTCCAGG
AATCTGCCCGTGGCCACCCCCGACCCTGGGATGTTCCCTTGCCTCCATCACTCACAGAACCTGCTCAGAGCAGTGAGCAACATG
CTCCAAAAGGCCCGCCAGACCCTGGAGTTTTACCCTTGTACTTCAGAAGAGATCGATCACGAAGACATAACAAAGGATAAAACC
AGCACCGTGGAGGCCTGTCTGCCTCTAGAACTCACAAAGAATGAAAGCTGTCTGAATTCCAGGGAAACCTCCTTCATTACTAAC
GGAAGCTGTCTCGCATCTCGCAAAACATCATTCATGATGGCCCTCTGCCTGTCTTCTATCTATGAAGATCTCAAGATGTATCAG
GTGGAGTTCAAAACAATGAACGCCAAGCTGCTGATGGACCCCAAGAGACAGATCTTCCTGGACCAGAACATGCTGGCAGTGATC
GATGAGCTGATGCAAGCCTTGAACTTCAACTCAGAGACAGTGCCGCAAAAGTCCTCGTTGGAGGAACCAGATTTTTACAAAACC
AAAATCAAGCTGTGTATCCTTCTTCACGCCTTTCGGATCAGAGCCGTGACTATCGACCGGGTGATGTCATACCTGAATGCTTCC

>hIL12AB_009 (SEQ ID NO: 1049)
ATGTGCCACCAGCAGCTGGTCATCAGCTGGTTTAGCCTGGTCTTCCTGGCCAGCCCCCTGGTGGCCATCTGGGAGCTGAAGAAA
GATGTCTATGTTGTAGAGCTGGACTGGTACCCAGATGCTCCTGGAGAAATGGTGGTTCTCACCTGCGACACGCCAGAAGAAGAT
GGCATCACCTGGACGCTGGACCAGAGCAGCGAAGTACTGGGCAGTGGAAAAACGCTGACCATACAAGTAAAAGAATTTGGCGAT
GCTGGCCAGTACACCTGCCACAAAGGAGGAGAAGTACTGAGCCACAGCCTGCTGCTGCTGCACAAGAAAGAAGATGGCATCTGG
AGCACCGACATTTTAAAAGACCAGAAGGAGCCCAAGAACAAAACCTTCCTTCGATGTGAGGCGAAGAACTACAGTGGCCGCTTC
ACCTGCTGGTGGCTCACCACCATCAGCACCGACCTCACCTTCTCGGTGAAGAGCAGCCGTGGTAGCTCAGACCCCCAAGGAGTC
ACCTGTGGGGCGGCCACGCTGTCGGCAGAAAGAGTTCGAGGCGACAACAAGGAATATGAATACTCGGTGGAATGTCAAGAAGAC

TABLE 14-continued

Sequence optimized Open Reading Frame sequences for human IL12

TCGGCCTGCCCGGCGGCAGAAGAAAGTCTGCCCATAGAAGTCATGGTGGATGCTGTTCACAAATTAAAATATGAAAACTACACC
AGCAGCTTCTTCATCAGAGACATCATCAAGCCAGACCCCCCCAAGAACCTGCAGCTGAAGCCCCTGAAGAACAGCAGACAAGTG
GAAGTTTCCTGGGAGTACCCAGACACGTGGAGCACGCCGCACAGCTACTTCAGCCTCACCTTCTGTGTACAAGTACAAGGCAAG
AGCAAGAGAGAGAAGAAAGATCGTGTCTTCACCGACAAAACCTCGGCGACGGTCATCTGCAGGAAGAATGCAAGCATCTCGGTT
CGAGCCCAGGACCGCTACTACAGCAGCAGCTGGAGTGAGTGGGCCTCGGTGCCCTGCAGTGGTGGCGGCGGCGGCGGCAGCAGA
AACCTTCCTGTGGCCACGCCGGACCCTGGCATGTTTCCGTGCCTGCACCACAGCCAAAATTTATTACGAGCTGTTAGCAACATG
CTGCAGAAAGCAAGACAAACTTTAGAATTCTACCCCTGCACCTCAGAAGAAATAGACCATGAAGACATCACCAAAGATAAAACC
AGCACTGTAGAGGCCTGCCTGCCCCTGGAGCTCACCAAGAACGAGAGCTGCCTCAATAGCAGAGAGACCAGCTTCATCACCAAT
GGCAGCTGCCTGGCCAGCAGGAAAACCAGCTTCATGATGGCGCTCTGCCTGAGCAGCATCTATGAAGATCTGAAGATGTACCAA
GTAGAATTTAAAACCATGAATGCCAAGCTGCTCATGGACCCCAAGAGACAAATATTCCTCGACCAAAACATGCTGGCTGTCATT
GATGAGCTCATGCAAGCATTAAACTTCAACTCAGAGACGGTGCCCCAGAAGAGCAGCCTGGAGGAGCCAGACTTCTACAAAACC
AAGATCAAGCTCTGCATCTTATTACATGCCTTCCGCATCCGGGCGGTCACCATTGACCGTGTCATGTCCTACTTAAATGCCAGC

>hIL12AB_010 (SEQ ID NO: 1050)
ATGTGCCACCAGCAGCTTGTCATCTCCTGGTTTTCTCTTGTCTTCCTCGCTTCTCCTCTTGTGGCCATCTGGGAGCTGAAGAAA
GATGTCTATGTTGTAGAGCTGGACTGGTACCCGGACGCTCCTGGAGAAATGGTGGTTCTCACCTGCGACACTCCTGAAGAAGAT
GGCATCACCTGGACGCTGGACCAAAGCAGCGAAGTTTTAGGCTCTGGAAAAACGCTGACCATACAAGTAAAAGAATTTGGCGAC
GCTGGCCAGTACACGTGCCACAAAGGAGGAGAAGTTTTAAGCCACAGTTTACTTCTTCTTCACAAGAAAGAAGATGGCATCTGG
AGTACGGACATTTTAAAAGACCAGAAGGAGCCTAAGAACAAAACCTTCCTCCGCTGTGAAGCTAAGAACTACAGTGGTCGTTTC
ACCTGCTGGTGGCTCACCACCATCTCCACTGACCTCACCTTCTCTGTAAAATCAAGCCGTGGTTCTTCTGACCCCCAAGGAGTC
ACCTGTGGGGCTGCCACGCTCAGCGCTGAAAGAGTTCGAGGCGACAACAAGGAATATGAATATTCTGTGGAATGTCAAGAAGAT
TCTGCCTGCCCGGCGGCAGAAGAAAGTCTTCCCATAGAAGTCATGGTGGACGCTGTTCACAAATTAAAATATGAAAACTACACC
AGCAGCTTCTTCATTCGTGACATCATCAAACCAGACCCTCCTAAGAACCTTCAGTTAAAACCGCTGAAGAACAGCAGACAAGTG
GAAGTTTCCTGGGAGTACCCGGACACGTGGAGTACGCCGCACTCCTACTTCAGTTTAACCTTCTGTGTACAAGTACAAGGAAAA
TCAAAAAGAGAGAAGAAAGATCGTGTCTTCACTGACAAAACATCTGCCACGGTCATCTGCCGTAAGAACGCTTCCATCTCGGTT
CGAGCCCAGGACCGCTACTACAGCAGCAGCTGGAGTGAGTGGGCATCTGTTCCCTGCAGTGGTGGCGGCGGCGGCGGCAGCCGC
AACCTTCCTGTGGCCACGCCGGACCCTGGCATGTTCCCGTGCCTTCACCACTCGCAAAATCTTCTTCGTGCTGTTTCTAACATG
CTGCAGAAGGCGAGACAAACTTTAGAATTCTACCCGTGCACTTCTGAAGAAATAGACCATGAAGACATCACCAAGGACAAAACC
AGCACGGTGGAGGCCTGCCTTCCTTTAGAACTTACTAAGAACGAAAGTTGCCTTAACAGCCGTGAGACCAGCTTCATCACCAAT
GGCAGCTGCCTTGCTAGCAGGAAGACCAGCTTCATGATGGCGCTGTGCCTTTCTTCCATCTATGAAGATCTTAAGATGTACCAA
GTAGAATTTAAAACCATGAATGCCAAATTATTAATGGACCCCAAGAGACAAATATTCCTCGACCAAAACATGCTGGCTGTCATT
GATGAGCTCATGCAAGCATTAAACTTCAACTCAGAAACTGTTCCCCAGAAGTCATCTTTAGAAGAACCGGACTTCTACAAAACA
AAAATAAAACTCTGCATTCTTCTTCATGCCTTCCGCATCCGTGCTGTCACCATTGACCGTGTCATGTCCTACTTAAATGCTTCT

>hIL12AB_011 (SEQ ID NO: 1051)
ATGTGCCACCAGCAGCTGGTGATCAGCTGGTTCAGCCTGGTGTTCCTGGCCAGCCCCCTGGTGGCCATCTGGGAGCTGAAGAAG
GACGTGTACGTGGTGGAGCTGGACTGGTACCCGGACGCGCCGGGGGAGATGGTGGTGCTGACGTGCGACACGCCGGAGGAGGAC
GGGATCACGTGGACGCTGGACCAGAGCAGCGAGGTGCTGGGGAGCGGGAAGACGCTGACGATCCAGGTGAAGGAGTTCGGGGAC
GCGGGGCAGTACACGTGCCACAAGGGGGGGGAGGTGCTGAGCCACAGCCTGCTGCTGCTGCACAAGAAGGAGGACGGGATCTGG
AGCACGGACATCCTGAAGGACCAGAAGGAGCCGAAGAACAAGACGTTCCTGAGGTGCGAGGCGAAGAACTACAGCGGGAGGTTC
ACGTGCTGGTGGCTGACGACGATCAGCACGGACCTGACGTTCAGCGTGAAGAGCAGCAGGGGGAGCAGCGACCCGCAGGGGGTG
ACGTGCGGGGCGGCGACGCTGAGCGCGGAGAGGGTGAGGGGGGACAACAAGGAGTACGAGTACAGCGTGGAGTGCCAGGAGGAC
AGCGCGTGCCCGGCGGCGGAGGAGAGCCTGCCGATCGAGGTGATGGTGGACGCGGTGCACAAGCTGAAGTACGAGAACTACACG
AGCAGCTTCTTCATCAGGGACATCATCAAGCCGGACCCGCCGAAGAACCTGCAGCTGAAGCCGCTGAAGAACAGCAGGCAGGTG
GAGGTGAGCTGGGAGTACCCGGACACGTGGAGCACGCCGCACAGCTACTTCAGCCTGACGTTCTGCGTGCAGGTGCAGGGGAAG
AGCAAGAGGGAGAAGAAGGACAGGGTGTTCACGGACAAGACGAGCGCGACGGTGATCTGCAGGAAGAACGCGAGCATCAGCGTG
AGGGCGCAGGACAGGTACTACAGCAGCAGCTGGAGCGAGTGGGCGAGCGTGCCGTGCAGCGGGGGGGGGGGGGGGGGGAGCAGG
AACCTGCCGGTGGCGACGCCGGACCCGGGGATGTTCCCGTGCCTGCACCACAGCCAGAACCTGCTGAGGGCGGTGAGCAACATG
CTGCAGAAGGCGAGGCAGACGCTGGAGTTCTACCCGTGCACGAGCGAGGAGATCGACCACGAGGACATCACGAAGGACAAGACG
AGCACGGTGGAGGCGTGCCTGCCGCTGGAGCTGACGAAGAACGAGAGCTGCCTGAACAGCAGGGAGACGAGCTTCATCACGAAC
GGGAGCTGCCTGGCGAGCAGGAAGACGAGCTTCATGATGGCGCTGTGCCTGAGCAGCATCTACGAGGACCTGAAGATGTACCAG
GTGGAGTTCAAGACGATGAACGCGAAGCTGCTGATGGACCCGAAGAGGCAGATCTTCCTGGACCAGAACATGCTGGCGGTGATC
GACGAGCTGATGCAGGCGCTGAACTTCAACAGCGAGACGGTGCCGCAGAAGAGCAGCCTGGAGGAGCCGGACTTCTACAAGACG
AAGATCAAGCTGTGCATCCTGCTGCACGCGTTCAGGATCAGGGCGGTGACGATCGACAGGGTGATGAGCTACCTGAACGCGAGC

>hIL12AB_012 (SEQ ID NO: 1052)
ATGTGCCATCAGCAGCTGGTGATCAGCTGGTTCAGCCTCGTGTTTCTGGCCAGCCCCCTGGTGGCCATTTGGGAACTCAAGAAG
GACGTGTATGTAGTGGAACTCGACTGGTACCCTGACGCCCCAGGCGAAATGGTGGTCTTAACCTGCGACACCCCTGAGGAGGAC
GGAATCACCTGGACCTTGGACCAGAGCTCCGAGGTCCTCGGCAGTGGCAAGACCCTGACCATACAGGTGAAAGAATTTGGAGAC
GCAGGGCAATACACATGTCACAAGGGCGGGGAGGTTCTTTCTCACTCCCTTCTGCTTCTACATAAAAAGGAAGACGGAATTTGG
TCTACCGACATCCTCAAGGACCAAAAGGAGCCTAAGAATAAAACCTTCTTACGCTGTGAAGCTAAAAACTACAGCGGCAGATTC
ACTTGCTGGTGGCTCACCACCATTTCTACCGACCTGACCTTCTCGGTGAAGTCTTCAAGGGGCTCTAGTGATCCACAGGGAGTG
ACATGCGGGGCCGCCACACTGAGCGCTGAACGGGTGAGGGGCGATAACAAGGAGTATGAATACTCTGTCGAGTGTCAGGAGGAT
TCAGCTTGTCCCGCAGCTGAAGAGTCACTCCCCATAGAGGTTATGGTCGATGCTGTGCATAAACTGAAGTACGAAAACTACACC
AGCAGCTTCTTCATTCGGGACATTATAAAACCTGACCCCCCCAAGAACCTGCAACTTAAACCCCTGAAAAACTCTCGGCAGGTC
GAAGTTAGCTGGGAGTACCCTGATACTTGGTCCACCCCCCACTCGTACTTCTCACTGACTTTCTGTGTGCAGGTGCAGGGCAAG
AGCAAGAGAGAGAAAAAAGATCGTGTATTCACAGACAAGACCTCTGCCACCGTGATCTGCAGAAAAAACGCTTCCATCAGTGTC
AGAGCCCAAGACCGGTACTATAGTAGTAGCTGGAGCGAGTGGGCAAGTGTCCCCTGCTCTGGCGGCGGAGGGGGCGGCTCTCGA
AACCTCCCCGTCGCTACCCCTGATCCAGGAATGTTCCCTTGCCTGCATCACTCACAGAATCTGCTGAGAGCGGTCAGCAACATG
CTGCAGAAAGCTAGGCAAACACTGGAGTTTTATCCTTGTACCTCAGAGGAGATCGACCACGAGGATATTACCAAGGACAAGACC
AGCACGGTGGAGGCCTGCTTGCCCCTGGAACTGACAAAGAATGAATCCTGCCTTAATAGCCGTGAGACCTCTTTTATAACAAAC
GGATCCTGCCTGGCCAGCAGGAAGACCTCCTTCATGATGGCCCTCTGCCTGTCCTCAATCTACGAAGACCTGAAGATGTACCAG
GTGGAATTTAAAACTATGAACGCCAAGCTGTTGATGGACCCCAAGCGGCAGATCTTTCTGGATCAAAATATGCTGGCTGTGATC
GACGAACTGATGCAGGCCCTCAACTTTAACAGCGAGACCGTGCCACAAAAGAGCAGTCTTGAGGAGCCCGACTTCTACAAGACC
AAGATCAAGCTGTGCATCCTCCTTCATGCCTTCAGGATAAGAGCTGTCACCATCGACAGAGTCATGAGTTACCTGAATGCATCC

TABLE 14-continued

Sequence optimized Open Reading Frame sequences for human IL12

>hIL12AB_013 (SEQ ID NO: 1053)
ATGTGCCACCAGCAGCTGGTCATCTCCTGGTTCAGTCTTGTCTTCCTGGCCTCGCCGCTGGTGGCCATCTGGGAGCTGAAGAAA
GATGTTTATGTTGTAGAGCTGGACTGGTACCCAGATGCTCCTGGAGAAATGGTGGTCCTCACCTGTGACACGCCAGAAGAAGAT
GGCATCACCTGGACGCTGGACCAGAGCAGTGAAGTTCTTGGAAGTGGAAAAACGCTGACCATACAAGTAAAAGAATTTGGAGAT
GCTGGCCAGTACACCTGCCACAAAGGAGGAGAAGTTCTCAGCCACAGTTTATTATTACTTCACAAGAAAGAAGATGGCATCTGG
TCCACGGACATTTTAAAAGACCAGAAGGAGCCCAAAAATAAAACATTTCTTCGATGTGAGGCCAAGAACTACAGTGGTCGTTTC
ACCTGCTGGTGGCTGACCACCATCTCCACAGACCTCACCTTCAGTGTAAAAAGCAGCCGTGGTTCTTCTGACCCCCAAGGAGTC
ACCTGTGGGGCTGCCACGCTCTCTGCAGAAAGAGTTCGAGGGGACAACAAAGAATATGAGTACTCGGTGGAATGTCAAGAAGAC
TCGGCCTGCCCAGCTGCTGAGGAGAGTCTTCCCATAGAAGTCATGGTGGATGCTGTTCACAAATTAAAATATGAAAACTACACC
AGCAGCTTCTTCATCAGAGACATCATCAAACCTGACCCGCCCAAGAACTTACAGCTGAAGCCGCTGAAAAACAGCAGACAAGTA
GAAGTTTCCTGGGAGTACCCGGACACCTGGTCCACGCCGCACTCCTACTTCTCCCTCACCTTCTGTGTACAAGTACAAGGCAAG
AGCAAGAGAGAGAAGAAAGATCGTGTCTTCACGGACAAAACATCAGCCACGGTCATCTGCAGGAAAAATGCCAGCATCTCGGTG
CGGGCCCAGGACCGCTACTACAGCAGCAGCTGGAGTGAGTGGGCATCTGTGCCCTGCAGTGGTGGTGGGGGTGGTGGCAGCAGA
AACCTTCCTGTGGCCACTCCAGACCCTGGCATGTTCCCGTGCCTTCACCACTCCCAAAATTTACTTCGAGCTGTTTCTAACATG
CTGCAGAAAGCAAGACAAACTTTAGAATTCTACCCGTGCACTTCTGAAGAAATTGACCATGAAGACATCACAAAAGATAAAACC
AGCACAGTGGAGGCCTGTCTTCCTTTAGAGCTGACCAAAAATGAATCCTGCCTCAACAGCAGAGAGACCAGCTTCATCACCAAT
GGCAGCTGCCTGGCCTCCAGGAAAACCAGCTTCATGATGGCGCTCTGCCTCAGCTCCATCTATGAAGATTTGAAGATGTACCAA
GTAGAATTTAAAACCATGAATGCCAAATTATTAATGGACCCCAAGAGGCAGATATTTTTAGATCAAAACATGCTGGCAGTTATT
GATGAGCTCATGCAAGCATTAAACTTCAACAGTGAGACTGTACCTCAAAAAAGCAGCCTTGAAGAGCCGGACTTCTACAAAACC
AAGATCAAACTCTGCATTTTACTTCATGCCTTCCGCATCCGGGCGGTCACCATTGACCGTGTCATGTCCTACTTAAATGCCTCG

>hIL12AB_014 (SEQ ID NO: 1054)
ATGTGCCACCAGCAGCTTGTGATTTCTTGGTTCTCTCTTGTGTTCCTTGCTTCTCCTCTTGTGGCTATTTGGGAGTTAAAAAAG
GACGTGTACGTGGTGGAGCTTGACTGGTACCCTGATGCTCCTGGCGAGATGGTGGTGCTTACTTGTGACACTCCTGAGGAGGAC
GGCATTACTTGGACTCTTGACCAGTCTTCTGAGGTGCTTGGCTCTGGCAAGACTCTTACTATTCAGGTGAAGGAGTTCGGGGAT
GCTGGCCAGTACACTTGCCACAAGGGCGGCGAGGTGCTTTCTCACTCTCTTCTTCTTCTTCACAAGAAGGAGGACGGCATTTGG
TCTACTGACATTTTAAAAGACCAGAAGGAGCCCAAGAACAAGACTTTCCTTCGTTGCGAGGCCAAGAACTACTCTGGCCGTTTC
ACTTGCTGGTGGCTTACTACTATTTCTACTGACCTTACTTTCTCTGTGAAGTCTTCTCGTGGCTCTTCTGACCCTCAGGGCGTG
ACTTGTGGGGCTGCTACTCTTTCTGCTGAGCGTGTGCGTGGGGACAACAAGGAGTACGAGTACTCTGTGGAGTGCCAGGAGGAC
TCTGCTTGCCCTGCTGCTGAGGAGTCTCTTCCTATTGAGGTGATGGTGGATGCTGTGCACAAGTTAAAATACGAGAACTACACT
TCTTCTTTCTTCATTCGTGACATTATTAAGCCTGACCCTCCCAAGAACCTTCAGTTAAAACCTTTAAAAAACTCTCGTCAGGTG
GAGGTGTCTTGGGAGTACCCTGACACTTGGTCTACTCCTCACTCTTACTTCTCTCTTACTTTCTGCGTGCAGGTGCAGGGCAAG
TCTAAGCGTGAGAAGAAGGACCGTGTGTTCACTGACAAGACTTCTGCTACTGTGATTTGCAGGAAGAATGCATCTATTTCTGTG
CGTGCTCAGGACCGTTACTACTCTTCTTCTTGGTCTGAGTGGGCTTCTGTGCCTTGCTCTGGCGGCGGCGGCGGCGGCTCTAGA
AATCTTCCTGTGGCTACTCCTGACCCTGGCATGTTCCCTTGCCTTCACCACTCTCAGAACCTTCTTCGTGCTGTGAGCAACATG
CTTCAGAAGGCTCGTCAGACTCTTGAGTTCTACCCTTGCACTTCTGAGGAGATTGACCACGAGGACATCACCAAGGACAAGACT
TCTACTGTGGAGGCTTGCCTTCCTCTTGAGCTTACCAAGAATGAATCTTGCTTAAATTCTCGTGAGACTTCTTTCATCACCAAC
GGCTCTTGCCTTGCCTCGCGCAAGACTTCTTTCATGATGGCTCTTTGCCTTTCTTCTATTTACGAGGACTTAAAAATGTACCAG
GTGGAGTTCAAGACTATGAATGCAAAGCTTCTTATGGACCCCAAGCGTCAGATTTTCCTTGACCAGAACATGCTTGCTGTGATT
GACGAGCTTATGCAGGCTTTAAATTTCAACTCTGAGACTGTGCCTCAGAAGTCTTCTCTTGAGGAGCCTGACTTCTACAAGACC
AAGATTAAGCTTTGCATTCTTCTTCATGCTTTCCGTATTCGTGCTGTGACTATTGACCGTGTGATGTCTTACTTAAATGCTTCT

>hIL12AB_015 (SEQ ID NO: 1055)
ATGTGTCACCAGCAGCTGGTGATCAGCTGGTTTAGCCTGGTGTTTCTGGCCAGCCCCCTGGTGGCCATATGGGAACTGAAGAAA
GATGTGTATGTGGTAGAACTGGATTGGTATCCGGATGCCCCCGGCGAAATGGTGGTGCTGACCTGTGACACCCCCGAAGAAGAT
GGTATCACCTGGACCCTGGACCAGAGCAGCGAGGTGCTGGGCAGCGGCAAAACCCTGACCATCCAAGTGAAAGAGTTTGGCGAT
GCCGGCCAGTACACCTGTCACAAAGGCGGCGAGGTGCTAAGCCATTCGCTGCTGCTGCTGCACAAAAAGGAAGATGGCATCTGG
AGCACCGATATCCTGAAGGACCAGAAAGAACCCAAAAATAAGACCTTTCTAAGATGCGAGGCCAAGAATTATAGCGGCCGTTTC
ACCTGCTGGTGGCTGACGACCATCAGCACCGATCTGACCTTCAGCGTGAAAAGCAGCAGAGGCAGCAGCGACCCCCAAGGCGTG
ACGTGCGGCGCCGCCACCCTGAGCGCCGAGAGAGTGAGAGGCGACAACAAGGAGTATGAGTACAGCGTGGAGTGCCAGGAGGAC
AGCGCCTGCCCCGCCGCCGAGGAGAGCCTGCCCATCGAGGTGATGGTGGATGCCGTGCACAAGCTGAAGTATGAAAACTACACC
AGCAGCTTCTTCATCAGAGACATCATCAAACCCGACCCCCCCAAGAACCTGCAGCTGAAGCCCCTGAAGAATAGCAGACAGGTG
GAGGTGAGCTGGGAGTACCCCGACACCTGGAGCACCCCCCATAGCTACTTCAGCCTGACCTTCTGCGTGCAGGTGCAGGGCAAG
AGCAAGAGAGAAAAGAAAGATAGAGTGTTCACGGACAAGACCAGCGCCACGGTGATCTGCAGAAAAAATGCCAGCATCAGCGTG
AGAGCCCAGGACAGATACTATAGCAGCAGCTGGAGCGAATGGGCCAGCGTGCCCTGCAGCGGCGGCGGCGGCGGCGGCAGCAGA
AACCTGCCCGTGGCCACCCCCGACCCCGGCATGTTCCCCTGCCTGCACCACAGCCAAAACCTGCTGAGAGCCGTGAGCAACATG
CTGCAGAAGGCCAGACAAACCCTGGAATTTTACCCCTGCACCAGCGAAGAGATCGATCATGAAGATATCACCAAAGATAAAACC
AGCACCGTGGAGGCCTGTCTGCCCCTGGAACTGACCAAGAATGAGAGCTGCCTAAATAGCAGAGAGACCAGCTTCATAACCAAT
GGCAGCTGCCTGGCCAGCAGAAAGACCAGCTTTATGATGGCCCTGTGCCTGAGCAGCATCTATGAAGACCTGAAGATGTACCAG
GTGGAGTTCAAGACCATGAATGCCAAGCTGCTGATGGATCCCAAGAGACAGATCTTTCTGGATCAAAACATGCTGGCCGTGATC
GATGAGCTGATGCAGGCCCTGAATTTCAACAGCGAGACCGTGCCCCAAAAAAGCAGCCTGGAAGAACCGGATTTTTATAAAACC
AAAATCAAGCTGTGCATACTGCTGCATGCCTTCAGAATCAGAGCCGTGACCATCGATAGAGTGATGAGCTATCTGAATGCCAGC

>hIL12AB_016 (SEQ ID NO: 1056)
ATGTGCCACCAGCAGCTGGTCATCAGCTGGTTCAGCCTGGTCTTCCTGGCCAGCCCCCTGGTGGCCATCTGGGAGCTGAAGAAG
GATGTTTATGTTGTGGAGCTGGACTGGTACCCAGATGCCCCTGGGGAGATGGTGGTGCTGACCTGTGACACCCCAGAAGAGGAT
GGCATCACCTGGACCCTGGACCAGAGCTCAGAAGTGCTGGGCAGTGGAAAAACCCTGACCATCCAGGTGAAGGAGTTTGGAGAT
GCTGGCCAGTACACCTGCCACAAGGGTGGTGAAGTGCTGAGCCACAGCCTGCTGCTGCTGCACAAGAAGGAGGATGGCATCTGG
AGCACAGACATCCTGAAGGACCAGAAGGAGCCCAAGAACAAGACCTTCCTTCGCTGTGAAGCCAAGAACTACAGTGGCCGCTTC
ACCTGCTGGTGGCTGACCACCATCAGCACAGACCTCACCTTCTCGGTGAAGAGCAGCAGAGGCAGCTCAGACCCCCAGGGTGTC
ACCTGTGGGGCGGCCACGCTGTCGGCGGAGAGAGTTCGAGGGGACAACAAGGAGTATGAATACTCGGTGGAGTGCCAGGAGGAC
TCGGCGTGCCCGGCGGCAGAAGAGAGCCTGCCCATAGAAGTGATGGTGGATGCTGTGCACAAGCTGAAGTATGAAAACTACACC
AGCAGCTTCTTCATCAGAGACATCATCAAGCCAGACCCGCCCAAGAACCTGCAGCTGAAGCCCCTGAAGAACAGCAGACAAGTG
GAGGTTTCCTGGGAGTACCCAGACACGTGGAGCACCCCCCACAGCTACTTCAGCCTGACCTTCTGTGTCCAGGTGCAGGGCAAG
AGCAAGAGAGAGAAGAAGGACAGAGTCTTCACAGACAAGACCTCGGCCACGGTCATCTGCAGAAAGAATGCCTCCATCTCGGTT
CGAGCCCAGGACAGATACTACAGCAGCAGCTGGTCAGAATGGGCCTCGGTGCCCTGCAGTGGTGGCGGCGGCGGCGGCAGCAGA
AACCTGCCTGTTGCCACCCCAGACCCTGGGATGTTCCCCTGCCTGCACCACAGCCAGAACTTATTACGAGCTGTTTCTAACATG
CTGCAGAAGGCCAGACAAACCCTGGAGTTCTACCCCTGCACCTCAGAAGAGATTGACCATGAAGACATCACCAAGGACAAGACC

TABLE 14-continued

Sequence optimized Open Reading Frame sequences for human IL12

AGCACTGTAGAGGCCTGCCTGCCCCTGGAGCTGACCAAGAATGAAAGCTGCCTGAACAGCAGAGAGACCAGCTTCATCACCAAT
GGAAGCTGCCTGGCCAGCAGAAAGACCAGCTTCATGATGGCCCTGTGCCTGAGCAGCATCTATGAAGACCTGAAGATGTACCAG
GTGGAGTTCAAGACCATGAATGCAAAGCTGCTGATGGACCCCAAGAGACAAATATTTTTGGACCAGAACATGCTGGCTGTCATT
GATGAGCTGATGCAGGCCCTGAACTTCAACTCAGAAACTGTACCCCAGAAGAGCAGCCTGGAGGAGCCAGACTTCTACAAGACC
AAGATCAAGCTGTGCATCCTGCTTCATGCTTTCAGAATCAGAGCTGTCACCATTGACCGCGTGATGAGCTACTTAAATGCCTCG

>hIL12AB_017 (SEQ ID NO: 1057)
ATGTGCCACCAGCAGCTGGTAATCAGCTGGTTTTCCCTCGTCTTTCTGGCATCACCCCTGGTGGCTATCTGGGAGCTGAAGAAG
GACGTGTACGTGGTGGAGCTGGATTGGTACCCTGACGCCCCGGGGGAAATGGTGGTGTTAACATGCGACACGCCTGAGGAGGAC
GGCATCACCTGGACACTGGACCAGAGCAGCGAGGTGCTTGGGTCTGGTAAAACTCTGACTATTCAGGTGAAAGAGTTCGGGGAT
GCCGGCCAATATACTTGCCACAAGGGTGGCGAGGTGCTTTCTCATTCTCTGCTCCTGCTGCACAAGAAAGAAGATGGCATTTGG
TCTACTGATATTCTGAAAGACCAGAAGGAGCCCAAGAACAAGACCTTTCTGAGATGCGAGGCTAAAAACTACAGCGGAAGATTT
ACCTGCTGGTGGCTGACCACAATCTCAACCGACCTGACATTTTCAGTGAAGTCCAGCAGAGGGAGCTCCGACCCTCAGGGCGTG
ACCTGCGGAGCCGCCACTCTGTCCGCAGAAAGAGTGAGAGGTGATAATAAGGAGTACGAGTATTCAGTCGAGTGCCAAGAGGAC
TCTGCCTGCCCAGCCGCCGAGGAGAGCCTGCCAATCGAGGTGATGGTAGATGCGGTACACAAGCTGAAGTATGAGAACTACACA
TCCTCCTTCTTCATAAGAGACATTATCAAGCCTGACCCACCTAAAAATCTGCAACTCAAGCCTTTGAAAAATTCAAGACAGGTG
GAGGTGAGCTGGGAGTACCCTGATACTTGGAGCACCCCCCATAGCTACTTTTCGCTGACATTCTGCGTCCAGGTGCAGGGCAAG
TCAAAGAGAGAGAAGAAGGATCGCGTGTTCACTGATAAGACAAGCGCCACAGTGATCTGCAGAAAAAACGCTAGCATTAGCGTC
AGAGCACAGGACCGGTATTACTCCAGCTCCTGGAGCGAATGGGCATCTGTGCCCTGCAGCGGTGGGGGCGGAGGCGGATCTAGA
AACCTCCCCGTTGCCACACCTGATCCTGGAATGTTCCCCTGTCTGCACCACAGCCAGAACCTGCTGAGAGCAGTGTCTAACATG
CTCCAGAAGGCCAGGCAGACCCTGGAGTTTTACCCCTGCACCAGCGAGGAAATCGATCACGAGGACATCACCAAAGATAAAACC
TCCACCGTGGAGGCCTGCCTGCCCCTGGAACTGACCAAAAACGAGAGCTGCCTGAATAGCAGGGAGACCTCCTTCATCACCAAC
GGCTCATGCCTTGCCAGCCGGAAAACTAGCTTCATGATGGCCCTGTGCCTGTCTTCGATCTATGAGGACCTGAAAATGTACCAG
GTCGAATTTAAGACGATGAACGCAAAGCTGCTGATGGACCCCAAGCGGCAGATCTTTCTGGACCAGAACATGCTGGCAGTCATA
GATGAGTTGATGCAGGCATTAAACTTCAACAGCGAGACCGTGCCTCAGAAGTCCAGCCTCGAGGAGCCAGATTTTTATAAGACC
AAGATCAAACTATGCATCCTGCTGCATGCTTTCAGGATTAGAGCCGTCACCATCGATCGAGTCATGTCTTACCTGAATGCTAGC

>hIL12AB_018 (SEQ ID NO: 1058)
ATGTGTCACCAACAGTTAGTAATCTCCTGGTTTTCTCTGGTGTTTCTGGCCAGCCCCCTCGTGGCCATCTGGGAGCTTAAAAAG
GATGTGTACGTGGTGGAGCTGGACTGGTATCCCGATGCACCAGGCGAAATGGTCGTGCTGACCTGCGATACCCCTGAAGAAGAT
GGCATCACCTGGACTCTGGACCAGTCTTCCGAGGTGCTTGGATCTGGCAAGACTCTGACAATACAAGTTAAGGAGTTCGGGGAC
GCAGGACAGTACACCTGCCACAAAGGCGGCGAGGTCCTGAGTCACTCCCTGTTACTGCTCCACAAGAAAGAGGACGGCATTTGG
TCCACCGACATTCTGAAGGACCAGAAGGAGCCTAAGAATAAAACTTTCCTGAGATGCGAGGCAAAAAACTATAGCGGCCGCTTT
ACTTGCTGGTGGCTTACAACAATCTCTACCGATTTAACTTTCTCCGTGAAGTCTAGCAGAGGATCCTCTGACCCGCAAGGAGTG
ACTTGCGGAGCCGCCACCTTGAGCGCCGAAAGAGTCCGTGGCGATAACAAAGAATACGAGTACTCCGTGGAGTGCCAGGAAGAT
TCCGCCTGCCCAGCTGCCGAGGAGTCCCTGCCCATTGAAGTGATGGTGGATGCCGTCCACAAGCTGAAGTACGAAAACTATACC
AGCAGCTTCTTCATCCGGGATATCATTAAGCCCGACCCTCCTAAAAACCTGCAACTTAAGCCCCTAAAGAATAGTCGGCAGGTT
GAGGTCAGCTGGGAATATCCTGACACATGGAGCACCCCCCACTCTTATTTCTCCCTGACCTTCTGCGTGCAGGTGCAGGGCAAG
AGTAAACGGGAGAAAAAGGACAGGGTCTTTACCGATAAAACCAGCGCTACGGTTATCTGTCGGAAGAACGCTTCCATCTCCGTC
CGCGCTCAGGATCGTTACTACTCGTCCTCATGGAGCGAGTGGGCCAGCGTGCCCTGCAGCGGCGGCGGTGGAGGCGGATCCAGA
AATCTGCCTGTTGCCACACCAGACCCTGGCATGTTCCCCTGTCTGCATCATAGCCAGAACCTGCTCAGAGCCGTGAGCAACATG
CTCCAGAAGGCCAGGCAGACATTGGAGTTCTACCCGTGTACATCTGAGGAAATCGATCACGAAGATATAACCAAGGACAAAACC
TCTACAGTAGAGGCTTGTTTGCCCCTGGAGTTGACCAAAAACGAGAGTTGCCTGAACAGTCGCGAGACAAGCTTCATTACTAAC
GGCAGCTGTCTCGCCTCCAGAAAGACATCCTTCATGATGGCCCTGTGTCTTTCCAGCATATACGAAGACCTGAAAATGTACCAG
GTCGAGTTCAAAACAATGAACGCCAAGCTGCTTATGGACCCCAAGAGACAGATCTTCCTCGACCAAAACATGCTCGCTGTGATC
GATGAGCTGATGCAGGCTCTCAACTTCAATTCCGAAACAGTGCCACAGAAGTCCAGTCTGGAAGAACCCGACTTCTACAAGACC
AAGATTAAGCTGTGTATTTTGCTGCATGCGTTTAGAATCAGAGCCGTGACCATTGATCGGGTGATGAGCTACCTGAACGCCTCG

>hIL12AB_019 (SEQ ID NO: 1059)
ATGTGCCACCAGCAGCTTGTCATCTCCTGGTTTTCTCTTGTCTTCCTGGCCTCGCCGCTGGTGGCCATCTGGGAGCTGAAGAAA
GATGTCTATGTTGTAGAGCTGGACTGGTACCCAGATGCTCCTGGAGAAATGGTGGTTCTCACCTGTGACACTCCTGAAGAAGAT
GGCATCACCTGGACGCTGGACCAAAGCTCAGAAGTTCTTGGCAGTGGAAAAACGCTGACCATACAAGTAAAAGAATTTGGGGAT
GCTGGCCAGTACACGTGCCACAAAGGAGGAGAAGTTCTCAGCCACAGTTTACTTCTTCTTCACAAGAAAGAAGATGGCATCTGG
TCCACGGACATTTTAAAAGACCAGAAGGAGCCCAAGAACAAAACCTTCCTCCGCTGTGAGGCCAAGAACTACAGTGGTCGTTTC
ACCTGCTGGTGGCTCACCACCATCTCCACTGACCTCACCTTCTCTGTAAAAAGCAGCCGTGGTTCTTCTGACCCCCAAGGAGTC
ACCTGTGGGGCTGCCACGCTCTCGGCAGAAAGAGTTCGAGGGGACAACAAGGAATATGAATATTCTGTGGAATGTCAAGAAGAT
TCTGCCTGCCCGGCGGCAGAAGAAAGTCTTCCCATAGAAGTCATGGTGGATGCTGTTCACAAATTAAAATATGAAAACTACACC
AGCAGCTTCTTCATTCGTGACATCATCAAACCAGACCCGCCCAAGAACCTTCAGTTAAAACCTTTAAAAAACAGCAGACAAGTA
GAAGTTTCCTGGGAGTACCCGGACACGTGGTCCACGCCGCACTCCTACTTCAGTTTAACCTTCTGTGTACAAGTACAAGGAAAA
TCAAAAAGAGAGAAGAAAGATCGTGTCTTCACTGACAAAACATCTGCCACGGTCATCTGCAGGAAGAATGCCTCCATCTCGGTT
CGAGCCCAGGACCGCTACTACAGCAGCAGCTGGAGTGAGTGGGCATCTGTTCCCTGCAGTGGTGGCGGCGGCGGCGGCAGCCGC
AACCTTCCTGTGGCCACGCCGGACCCTGGCATGTTCCCGTGCCTTCACCACTCCCAAAATCTTCTTCGTGCTGTTTCTAACATG
CTGCAGAAGGCGCGCCAAACTTTAGAATTCTACCCGTGCACTTCTGAAGAAATAGACCATGAAGACATCACCAAAGATAAAACC
AGCACGGTGGAGGCCTGCCTTCCTTTAGAGCTGACCAAGAATGAATCCTGCCTCAACAGCAGAGAGACCAGCTTCATCACCAAT
GGCAGCTGCCTGGCCTCGCGCAAGACCAGCTTCATGATGGCGCTGTGCCTTTCTTCCATCTATGAAGATTTAAAGATGTACCAA
GTAGAATTTAAAACCATGAATGCCAAATTATTAATGGACCCCAAAAGACAAATATTTTTGGATCAAAACATGCTGGCTGTCATT
GATGAGCTCATGCAAGCATTAAACTTCAACTCAGAAACTGTTCCCCAGAAGTCATCTTTAGAAGAGCCGGACTTCTACAAAACA
AAAATAAAACTCTGCATTCTTCTTCATGCCTTCCGCATCCGTGCTGTCACCATTGACCGTGTCATGTCCTACTTAAATGCTTCT

>hIL12AB_020 (SEQ ID NO: 1060)
ATGTGCCACCAGCAGCTGGTGATCAGCTGGTTCAGCCTGGTGTTCCTGGCTAGCCCTCTGGTGGCCATCTGGGAGCTGAAGAAG
GACGTGTACGTGGTGGAGTTAGACTGGTACCCCGACGCTCCCGGCGAGATGGTGGTGCTGACCTGCGACACCCCCGAGGAGGAC
GGGATCACCTGGACCCTGGATCAGTCAAGCGAGGTGCTGGGAAGCGGCAAGACCCTGACCATCCAGGTGAAGGAGTTCGGCGAC
GCCGGCCAATACACTTGCCACAAGGGAGGCGAGGTGCTGTCCCACTCCCTCCTGCTGCTGCACAAAAAGGAAGACGGCATCTGG
AGCACCGACATCCTGAAAGACCAGAAGGAGCCTAAGAACAAGACATTCCTCAGATGCGAGGCCAAGAATTACTCCGGGAGATTC
ACCTGTTGGTGGCTGACCACCATCAGCACAGACCTGACCTTCAGCGTGAAGAGCAGCAGAGGCAGCAGCGACCCCCAGGGCGTG
ACCTGTGGCGCCGCCACCCTGAGCGCCGAAAGAGTGCGCGGCGACAACAAGGAGTACGAGTACTCCGTGGAATGCCAGGAGGAC
AGCGCCTGCCCCGCCGCCGAGGAGAGCCTGCCCATCGAGGTGATGGTGGACGCCGTCCACAAGCTGAAGTACGAGAACTACACC

TABLE 14-continued

Sequence optimized Open Reading Frame sequences for human IL12

TCTAGCTTCTTCATCCGGGACATCATCAAGCCCGATCCCCCCAAGAACCTGCAGCTGAAACCCCTGAAGAACAGCAGACAGGTG
GAGGTGAGCTGGGAGTATCCCGACACCTGGTCCACCCCCCACAGCTATTTTAGCCTGACCTTCTGCGTGCAAGTGCAGGGCAAG
AGCAAGAGAGAGAAGAAGGACCGCGTGTTCACCGACAAAACCAGCGCCACCGTGATCTGCAGAAAGAACGCCAGCATCAGCGTG
AGGGCCCAGGATAGATACTACAGTTCCAGCTGGAGCGAGTGGGCCAGCGTGCCCTGCAGCGGCGGCGGCGGGGAGGCTCTAGA
AACCTGCCCGTGGCTACCCCCGATCCCGGAATGTTCCCCTGCCTGCACCACAGCCAGAACCTGCTGAGGGCGGTGTCCAACATG
CTTCAGAAGGCCCGGCAGACCCTGGAGTTCTACCCCTGTACCTCTGAGGAGATCGATCATGAGGACATCACAAAGGACAAAACC
AGCACCGTGGAGGCCTGCCTGCCCCTGGAGCTGACCAAGAACGAGAGCTGCCTGAACTCCCGCGAGACCAGCTTCATCACGAAC
GGCAGCTGCCTGGCCAGCAGGAAGACCTCCTTCATGATGGCCCTGTGCCTGAGCAGCATCTACGAGGACCTGAAAATGTACCAG
GTGGAGTTTAAGACCATGAACGCCAAGCTGCTGATGGACCCCAAGCGGCAAATCTTCCTGGACCAGAACATGCTGGCAGTGATC
GACGAGCTCATGCAGGCCCTGAACTTCAATAGCGAGACAGTCCCCCAGAAGAGCAGCCTGGAGGAGCCCGACTTTTACAAGACC
AAGATCAAGCTGTGCATCCTGCTGCACGCCTTTAGAATCCGTGCCGTGACCATTGACAGAGTGATGAGCTACCTGAATGCCAGC

>hIL12AB_021 (SEQ ID NO: 1061)
ATGTGCCACCAGCAGCTGGTGATCAGCTGGTTCAGCCTGGTGTTCCTGGCCAGCCCTCTGGTTGCCATCTGGGAGCTGAAGAAA
GACGTGTACGTCGTGGAACTGGACTGGTATCCGGACGCCCCGGGCGAGATGGTGGTGCTGACCTGTGACACCCCCGAGGAGGAC
GGCATCACCTGGACGCTGGACCAATCCTCCGAGGTGCTGGGAAGCGGCAAGACCCTGACCATCCAGGTGAAGGAATTCGGGGAC
GCCGGGCAGTACACCTGCCACAAGGGGGGCGAAGTGCTGTCCCACTCGCTGCTGCTCCTGCATAAGAAGGAGGATGGAATCTGG
TCCACCGACATCCTCAAAGATCAGAAGGAGCCCAAGAACAAGACGTTCCTGCGCTGTGAAGCCAAGAATTATTCGGGGCGATTC
ACGTGCTGGTGGCTGACAACCATCAGCACCGACCTGACGTTTAGCGTGAAGAGCAGCAGGGGGTCCAGCGACCCCCAGGGCGTG
ACGTGCGGCGCCGCCACCCTCTCCGCCGAGAGGGTGCGGGGGGACAATAAGGAGTACGAGTACAGCGTGGAATGCCAGGAGGAC
AGCGCCTGCCCCGCCGCGGAGGAAAGCCTCCCGATAGAGGTGATGGTGGACGCCGTGCACAAGCTCAAGTATGAGAATTACACC
AGCAGCTTTTTCATCCGGGACATTATCAAGCCCGACCCCCCGAAGAACCTCCAGCTGAAGCCCCTGAAGAACAGCCGGCAGGTG
GAAGTCTCCTGGGAGTATCCCGACACCTGGAGCACCCCGCACAGCTACTTCTCCCTGACCTTCTGTGTGCAGGTGCAGGGCAAG
TCCAAGAGGGAAAAGAAGGACAGGGTTTTCACCGACAAGACCAGCGCGACCGTGATCTGCCGGAAGAACGCCAGCATAAGCGTC
CGCGCCCAAGATAGGTACTACAGCAGCTCCTGGAGCGAGTGGGCTAGCGTGCCCTGCAGCGGGGGCGGGGGTGGGGGCTCCAGG
AACCTGCCAGTGGCGACCCCCGACCCCGGCATGTTCCCCTGCCTCCATCACAGCCAGAACCTGCTGAGGGCCGTCAGCAATATG
CTGCAGAAGGCCAGGCAGACCCTGGAATTCTACCCCTGCACGTCGGAGGAGATCGATCACGAGGATATCACAAAAGACAAGACT
TCCACCGTGGAGGCCTGCCTGCCCCTGGAGCTCACCAAGAATGAGTCCTGTCTGAACTCCCGGGAAACCAGCTTCATCACCAAC
GGGTCCTGCCTGGCCAGCAGGAAGACCAGCTTTATGATGGCCCTGTGCCTGTCGAGCATCTACGAGGACCTGAAGATGTACCAG
GTCGAGTTCAAGACAATGAACGCCAAGCTGCTGATGGACCCCAAGAGGCAAATCTTCCTGGACCAGAATATGCTTGCCGTCATC
GACGAGCTCATGCAGGCCCTGAACTTCAACTCCGAGACCGTGCCCCAGAAGAGCAGCCTGGAGGAGCCCGACTTCTACAAGACC
AAGATCAAGCTGTGCATCCTGCTGCACGCGTTCAGGATCCGGGCAGTCACCATCGACCGTGTGATGTCCTACCTGAACGCCAGC

>hIL12AB_022 (SEQ ID NO: 1062)
ATGTGCCATCAGCAGCTGGTGATCAGCTGGTTCAGCCTGGTGTTCCTCGCCTCTCCCCTGGTGGCCATCTGGGAGCTCAAAAAG
GACGTGTACGTGGTGGAGCTCGACTGGTACCCAGACGCCCCCGGGGAGATGGTGGTGCTGACCTGCGACACCCCCGAAGAAGAC
GGCATCACGTGGACCCTCGACCAGTCCAGCGAGGTGCTGGGGAGCGGGAAGACTCTGACCATCCAGGTCAAGGAGTTCGGGGAC
GCCGGGCAGTACACGTGCCACAAGGGCGGCGAAGTCTTAAGCCACAGCCTGCTCCTGCTGCACAAGAAGGAGGACGGGATCTGG
TCCACAGACATACTGAAGGACCAGAAGGAGCCGAAGAATAAAACCTTTCTGAGGTGCGAGGCCAAGAACTATTCCGGCAGGTTC
ACGTGCTGGTGGCTTACAACAATCAGCACAGACCTGACGTTCAGCGTGAAGTCCAGCCGCGGCAGCAGCGACCCCCAGGGGGTG
ACCTGCGGCGCCGCCACCCTGAGCGCCGAGCGGGTGCGCGGGGACAACAAGGAGTACGAGTACTCCGTGGAGTGCCAGGAAGAC
AGCGCCTGTCCCGCCGCCGAAGAGAGCCTGCCTATCGAGGTCATGGTAGATGCAGTGCATAAGCTGAAGTACGAGAACTATACG
AGCAGCTTTTTCATACGCGACATCATCAAGCCCGACCCCCCCAAGAACCTGCAGCTTAAGCCCCTGAAGAATAGCCGGCAGGTG
GAGGTCTCCTGGGAGTACCCCGACACCTGGTCAACGCCCCACAGCTACTTCTCCCTGACCTTTTGTGTCCAAGTCCAGGGAAAG
AGCAAGAGGGAGAAGAAAGATCGGGTGTTCACCGACAAGACCTCCGCCACGGTGATCTGCAGGAAGAACGCCAGCATCTCCGTG
AGGGCGCAAGACAGGTACTACTCCAGCAGCTGGTCCGAATGGGCCAGCGTGCCCTGCTCCGGCGGCGGGGGCGGCGGCAGCCGA
AACCTACCCGTGGCCACGCCGGATCCCGGCATGTTTCCCTGCCTGCACCACAGCCAGAACCTCCTGAGGGCCGTGTCCAACATG
CTGCAGAAGGCCAGGCAGACTCTGGAGTTCTACCCCTGCACGAGCGAGGAGATCGATCACGAGGACATCACCAAGGATAAGACC
AGCACTGTGGAGGCCTGCCTTCCCCTGGAGCTGACCAAGAACGAGAGCTGTCTGAACTCCAGGGAGACCTCATTCATCACCAAC
GGCTCCTGCCTGGCCAGCAGGAAAACCAGCTTCATGATGGCCTTGTGTCTCAGCTCCATCTACGAGGACCTGAAGATGTATCAG
GTCGAGTTCAAGACAATGAACGCCAAGCTGCTGATGGACCCCAAAAGGCAGATCTTCCTGGACCAGAACATGCTGGCCGTCATC
GACGAGCTGATGCAGGCCCTGAACTTCAACAGCGAGACGGTGCCCCAGAAAAGCTCCCTGGAGGAGCCCGACTTCTACAAGACC
AAGATCAAGCTGTGCATCCTGCTGCACGCCTTCAGGATCAGGGCAGTGACCATCGACCGGGTGATGTCATACCTTAACGCCAGC

>hIL12AB_023 (SEQ ID NO: 1063)
ATGTGCCATCAGCAGCTGGTGATCTCCTGGTTCAGCCTGGTGTTTCTGGCCTCGCCCCTGGTCGCCATCTGGGAGCTGAAGAAA
GACGTGTACGTCGTCGAACTGGACTGGTACCCCGACGCCCCCGGGGAGATGGTGGTGCTGACCTGCGACACGCCGGAGGAGGAC
GGCATCACCTGGACCCTGGATCAAAGCAGCGAGGTGCTGGGCAGCGGCAAGACCCTGACCATCCAAGTGAAGGAATTCGGCGAT
GCCGGCCAGTACACCTGTCACAAAGGGGGCGAGGTGCTCAGCCACAGCCTGCTGCTGCTGCACAAGAAGGAGGATGGCATCTGG
AGCACCGATATCCTGAAGGACCAGAAAGAGCCCAAGAACAAGACGTTCCTGAGGTGCGAGGCCAAGAACTACAGCGGTAGGTTC
ACGTGTTGGTGGCTGACCACCATCAGCACCGACCTGACGTTCAGCGTGAAGAGCTCCAGGGGCAGCTCCGACCCACAGGGGGTG
ACGTGCGGGGCCGCAACCCTCAGCGCCGAAAGGGTGCGGGGGGACAACAAGGAGTACGAATACTCCGTGGAGTGCCAGGAAGAT
TCGGCCTGCCCCGCCGCGGAGGAGAGCCTCCCCATCGAGGTAATGGTGGACGCCGTGCATAAGCTGAAGTACGAGAACTACACC
AGCTCGTTCTTCATCCGAGACATCATCAAACCCGACCCGCCCAAAAATCTGCAGCTCAAGCCCCTGAAGAACTCCAGGCAGGTG
GAGGTGAGCTGGGAGTACCCCGACACCTGGTCCACCCCGCACAGCTACTTCTCCCTGACATTCTGCGTGCAGGTGCAGGGCAAG
AGCAAGCGGGAGAAGAAGGACAGGGTGTTCACCGACAAGACGAGCGCCACCGTGATCTGCCGAAAGAACGCCAGCATCTCGGTG
CGCGCCCAGGATAGGTACTATTCCAGCTCCTGGAGCGAGTGGGCCTCGGTACCCTGCAGCGGCGGCGGGGGCGGCGGCAGTAGG
AATCTGCCCGTGGCTACCCCGGACCCGGGCATGTTCCCCTGCCTCCACCACAGCCAGAACCTGCTGAGGGCCGTGAGCAACATG
CTGCAGAAGGCCAGACAGACGCTGGAGTTCTACCCCTGCACGAGCGAGGAGATCGACCACGAGGACATCACCAAGGATAAAACT
TCCACCGTCGAGGCCTGCCTGCCCTTGGAGCTGACCAAGAATGAATCCTGTCTGAACAGCAGGGAGACCTCGTTTATCACCAAT
GGCAGCTGCCTCGCCTCCAGGAAGACCAGCTTCATGATGGCCCTCTGTCTGAGCTCCATCTATGAGGACCTGAAGATGTACCAG
GTGGAGTTCAAGACCATGAACGCGAAGCTGCTGATGGACCCCAAGAGGCAGATCTTCCTGGATCAGAATATGCTGGCGGTGATC
GACGAGCTCATGCAGGCCCTCAATTTCAATAGCGAGACAGTGCCCCAGAAGTCCTCCCTGGAGGAGCCCGACTTCTACAAGACC
AAGATCAAGCTGTGTATCCTGCTGCACGCCTTCCGGATCCGGGCCGTCACCATCGACCGGGTCATGAGCTACCTCAATGCCAGC

>hIL12AB_024 (SEQ ID NO: 1064)
ATGTGCCACCAGCAGCTGGTGATCTCCTGGTTCTCCCTGGTGTTCCTGGCCTCGCCCCTGGTGGCCATCTGGGAGCTGAAGAAG
GACGTGTACGTCGTGGAGCTCGACTGGTACCCCGACGCCCCTGGCGAGATGGTGGTGCTGACCTGCGACACCCCAGAGGAGGAT

TABLE 14-continued

Sequence optimized Open Reading Frame sequences for human IL12

GGCATCACCTGGACCCTGGATCAGTCCTCCGAGGTGCTGGGCTCCGGCAAGACGCTGACCATCCAAGTGAAGGAGTTCGGTGAC
GCCGGACAGTATACCTGCCATAAGGGCGGCGAGGTCCTGTCCCACAGCCTCCTCCTCCTGCATAAGAAGGAGGACGGCATCTGG
AGCACCGACATCCTGAAGGACCAGAAGGAGCCCAAGAACAAGACCTTTCTGAGGTGCGAGGCCAAGAACTACAGCGGCCGATTC
ACCTGCTGGTGGCTCACCACCATATCCACCGACCTGACTTTCTCCGTCAAGTCCTCCCGGGGGTCCAGCGACCCCCAGGGAGTG
ACCTGCGGCGCCGCCACCCTCAGCGCCGAGCGGGTGCGGGGGGACAACAAGGAGTACGAATACTCCGTCGAGTGCCAGGAGGAC
TCCGCCTGCCCGGCCGCCGAGGAGAGCCTGCCCATCGAGGTGATGGTCGACGCGGTGCACAAGCTGAAGTACGAGAACTACACC
AGCAGTTTCTTCATCAGGGATATCATCAAGCCAGATCCCCCGAAGAATCTGCAACTGAAGCCGCTGAAAAACTCACGACAGGTG
GAGGTGAGCTGGGAGTACCCCGACACGTGGAGCACCCCACATTCCTACTTCAGCCTGACCTTCTGCGTGCAGGTCCAGGGCAAG
AGCAAGCGGGAGAAGAAGGACAGGGTGTTCACGGATAAGACCAGTGCCACCGTGATCTGCAGGAAGAACGCCTCTATTAGCGTG
AGGGCCCAGGATCGGTATTACTCCTCGAGCTGGAGCGAATGGGCCTCCGTGCCCTGCAGTGGGGGGGGTGGAGGCGGGAGCAGG
AACCTGCCCGTAGCAACCCCCGACCCCGGGATGTTCCCCTGTCTGCACCACTCGCAGAACCTGCTGCGCGCGGTGAGCAACATG
CTCCAAAAAGCCCGTCAGACCTTAGAGTTCTACCCCTGCACCAGCGAAGAAATCGACCACGAAGACATCACCAAGGACAAAACC
AGCACCGTGGAGGCGTGCCTGCCGCTGGAGCTGACCAAGAACGAGAGCTGCCTCAACTCCAGGGAGACCAGCTTTATCACCAAC
GGCTCGTGCCTAGCCAGCCGGAAAACCAGCTTCATGATGGCCCTGTGCCTGAGCTCCATTTACGAGGACCTGAAGATGTATCAG
GTGGAGTTCAAGACCATGAATGCCAAACTCCTGATGGACCCCAAGAGGCAGATCTTCCTGGACCAGAACATGCTCGCGGTGATC
GATGAGCTGATGCAGGCCCTGAACTTTAATAGCGAGACCGTGCCCCAGAAAAGCAGCCTGGAGGAGCCGGACTTCTACAAGACC
AAAATCAAGCTGTGCATCCTGCTCCACGCCTTCCGCATCCGGGCCGTGACCATCGACAGGGTGATGAGCTACCTGAACGCCAGC

>hIL12AB_025 (SEQ ID NO: 1065)
ATGTGCCATCAGCAGCTGGTGATTTCCTGGTTCTCCCTGGTGTTCCTGGCCAGCCCCCTCGTGGCGATCTGGGAGCTAAAGAAG
GACGTGTACGTGGTGGAGCTGGACTGGTACCCGGACGCACCCGGCGAGATGGTCGTTCTGACCTGCGATACGCCAGAGGAGGAC
GGCATCACCTGGACCCTCGATCAGAGCAGCGAGGTCCTGGGGAGCGGAAAGACCCTGACCATCCAGGTCAAGGAGTTCGGCGAC
GCCGGCCAGTACACCTGCCACAAAGGTGGCGAGGTCCTGAGCCACTCGCTGCTGCTCCTGCATAAGAAGGAGGACGGAATCTGG
AGCACAGACATCCTGAAAGACCAGAAGGAGCCCAAGAACAAGACCTTCCTGAGGTGCGAGGCCAAGAACTACAGCGGGCGCTTC
ACGTGCTGGTGGCTGACCACCATCAGCACGGACCTCACCTTCTCCGTGAAGAGCAGCCGGGGATCCAGCGATCCCCAAGGCGTC
ACCTGCGGCGCGGCCACCCTGAGCGCGGAGAGGGTCAGGGGCGATAATAAGGAGTATGAGTACAGCGTGGAGTGCCAGGAGGAC
AGCGCCTGCCCGGCCGCCGAGGAGTCCCTGCCAATCGAAGTGATGGTCGACGCCGTGCACAAGCTGAAGTACGAGAACTACACC
AGCAGCTTCTTCATCCGGGATATCATCAAGCCCGATCCCCCGAAGAACCTGCAGCTGAAGCCCCTCAAGAACAGCCGGCAGGTG
GAGGTGAGTTGGGAGTACCCCGACACCTGGTCAACGCCCCACAGCTACTTCTCCCTGACCTTCTGTGTGCAGGTGCAGGGAAAG
AGCAAGAGGGAGAAGAAAGACCGGGTCTTCACCGACAAGACCAGCGCCACGGTGATCTGCAGGAAGAACGCAAGCATCTCCGTG
AGGGCCCAGGACAGGTACTACAGCTCCAGCTGGTCCGAATGGGCCAGCGTGCCCTGTAGCGGCGGCGGGGGCGGTGGCAGCCGC
AACCTCCCAGTGGCCACCCCCGACCCCGGCATGTTCCCCTGCCTGCACCACAGCCAGAATCTGCTGAGGGCCGTGAGTAACATG
CTGCAGAAGGCAAGGCAAACCCTCGAATTCTATCCCTGCACCTCCGAGGAGATCGACCACGAGGATATCACCAAGGACAAGACC
AGCACCGTCGAGGCCTGTCTCCCCCTGGAGCTGACCAAGAATGAGAGCTGCCTGAACAGCCGGGAGACCAGCTTCATCACCAAC
GGGAGCTGCCTGGCCTCCAGGAAGACCTCGTTCATGATGGCGCTGTGCCTCTCAAGCATATACGAGGATCTGAAGATGTACCAG
GTGGAGTTTAAGACGATGAACGCCAAGCTGCTGATGGACCCGAAGAGGCAGATCTTCCTGGACCAGAACATGCTGGCCGTGATA
GACGAGCTCATGCAGGCCCTGAACTTCAACTCCGAGACCGTGCCGCAGAAGTCATCCCTCGAGGAGCCCGACTTCTATAAGACC
AAGATCAAGCTGTGCATCCTGCTCCACGCCTTCCGGATAAGGGCCGTGACGATCGACAGGGTGATGAGCTACCTTAACGCCAGC

>hIL12AB_026 (SEQ ID NO: 1066)
ATGTGCCACCAGCAGCTCGTGATCAGCTGGTTCTCCCTGGTGTTTCTCGCCAGCCCCCTGGTGGCCATCTGGGAGCTGAAGAAG
GACGTGTACGTGGTGGAGCTGGACTGGTACCCTGACGCCCCGGGGGAGATGGTCGTGCTGACCTGCGACACCCCCGAAGAGGAC
GGTATCACCTGGACCCTGGACCAGTCCAGCGAGGTGCTGGGCAGCGGCAAGACCCTGACTATTCAAGTCAAGGAGTTCGGAGAC
GCCGGCCAGTACACCTGCCACAAGGGTGGAGAGGTGTTATCACACAGCCTGCTGCTGCTGCACAAGAAGGAAGACGGGATCTGG
AGCACCGACATCCTGAAGGACCAGAAGGAGCCCAAAAACAAGACCTTCCTGCGGTGCGAGGCCAAGAACTATTCGGGCCGCTTT
ACGTGCTGGTGGCTGACCACCATCAGCACTGATCTCACCTTCAGCGTGAAGTCCTCCCGGGGGTCGTCCGACCCCCAGGGGGTG
ACCTGCGGGGCCGCCACCCTGTCCGCCGAGAGAGTGAGGGGCGATAATAAGGAGTACGAGTACAGCGTTGAGTGCCAGGAAGAT
AGCGCCTGTCCCGCCGCCGAGGAGAGCCTGCCCATCGAGGTGATGGTGGACGCCGTCCACAAGCTGAAGTATGAGAACTACACC
TCAAGCTTCTTCATCAGGGACATCATCAAACCCGATCCGCCCAAGAATCTGCAGCTGAAGCCCCTGAAAAATAGCAGGCAGGTG
GAGGTGAGCTGGGAGTACCCCGACACCTGGTCCACCCCCCATAGCTATTTCTCCCTGACGTTCTGCGTGCAGGTGCAAGGGAAG
AGCAAGCGGGAGAAGAAGGACCGGGTGTTCACCGACAAGACCTCCGCCACCGTGATCTGTAGGAAGAACGCGTCGATCTCGGTC
AGGGCCCAGGACAGGTATTACAGCAGCAGCTGGAGCGAGTGGGCGAGCGTGCCCTGCTCGGGCGGCGGCGGCGGCGGGAGCAGA
AATCTGCCCGTGGCCACCCCAGACCCCGGAATGTTCCCCTGCCTGCACCATTCGCAGAACCTCCTGAGGGCCGTGAGCAACATG
CTGCAGAAGGCCCGCCAGACGCTGGAGTTCTACCCCTGCACGAGCGAGGAGATCGACCACGAAGACATCACCAAGGACAAAACC
AGCACCGTGGAGGCCTGCCTGCCCCTGGAGCTGACCAAAAACGAATCCTGCCTCAACAGCCGGGAGACCAGCTTCATCACCAAC
GGCAGCTGCCTGGCCAGCCGAAAGACCTCCTTCATGATGGCCCTCTGCCTGAGCAGCATCTATGAGGATCTGAAGATGTATCAG
GTGGAGTTCAAGACCATGAATGCCAAGCTGCTGATGGACCCCAAGAGGCAGATATTCCTGGACCAGAATATGCTGGCCGTGATC
GACGAGCTGATGCAGGCCCTGAACTTCAACAGCGAGACCGTCCCCCAGAAGTCCAGCCTGGAGGAGCCGGACTTTTACAAAACG
AAGATCAAGCTGTGCATACTGCTGCACGCCTTCAGGATCCGGGCCGTGACAATCGACAGGGTGATGTCCTACCTGAACGCCAGC

>hIL12AB_027 (SEQ ID NO: 1067)
ATGTGTCACCAGCAGCTGGTGATCAGCTGGTTCTCCCTGGTGTTCCTGGCCAGCCCCCTGGTGGCCATCTGGGAGCTCAAGAAG
GACGTCTACGTCGTGGAGCTGGATTGGTACCCCGACGCTCCCGGGGAGATGGTGGTGCTGACCTGCGACACCCCCGAGGAGGAC
GGCATCACCTGGACGCTGGACCAGAGCTCAGAGGTGCTGGGAAGCGGAAAGACACTGACCATCCAGGTGAAGGAGTTCGGGGAT
GCCGGGCAGTATACCTGCCACAAGGGCGGCGAAGTGCTGAGCCATTCCCTGCTGCTGCACAAGAAGGAGGACGGCATATGG
TCCACCGACATCCTGAAGGATCAGAAGGAGCCGAAGAATAAAACCTTCCTGAGGTGCGAGGCCAAGAATTACAGCGGCCGATTC
ACCTGCTGGTGGCTGACCACCATCAGCACCGACCTGACCTTCAGTGTGAAGTCCTCACGGGGCAGCTCAGATCCCCAGGGCGTG
ACCTGCGGGGCCGCGACACTCAGCGCCGAGCGGGTGAGGGGTGATAACAAGGAGTACGAGTATTCTGTGGAGTGCCAGGAAGAC
TCCGCCTGTCCCGCCGCCGAGGAGTCCCTGCCCATCGAGGTGATGGTGGACGCCGTGCATAAACTGAAGTACGAGAACTACACC
TCCAGCTTCTTCATCCGGGATATAATCAAGCCCGACCCTCCGAAAAACCTGCAGCTGAAGCCCCTTAAAAACAGCCGGCAGGTG
GAGGTGAGCTGGGAGTACCCCGACACCTGGAGCACCCCCCATAGCTATTTCAGCCTGACCTTCTGCGTGCAGGTGCAGGGGAAG
TCCAAGCGCGAGAAAAAGGACCGGGTGTTCACCGACAAGACGAGCGCCACCGTGATCTGCCGGAAGAACGCCAGTATAAGCGTA
AGGGCCCAGGATAGGTACTACAGCTCCAGCTGGTCGGAGTGGGCCTCCGTGCCCTGTTCCGGCGGCGGGGGGGGTGGCAGCAGG
AACCTCCCCGTGGCCACGCCGGACCCCGGCATGTTCCCGTGCCTGCACCACTCCCAAAACCTCCTGCGGGCCGTCAGCAACATG
CTGCAAAAGGCGCGGCAGACCCTGGAGTTTTACCCCTGTACCTCCGAAGAGATCGACCACGAGGATATCACCAAGGATAAGACC
TCCACCGTGGAGGCCTGTCTCCCCCTGGAGCTGACCAAGAACGAGAGCTGTCTTAACAGCAGAGAGACCTCGTTCATAACGAAC
GGCTCCTGCCTCGCTTCCAGGAAGACGTCGTTCATGATGGCGCTGTGCCTGTCCAGCATCTACGAGGACCTGAAGATGTATCAG
GTCGAGTTCAAAACCATGAACGCCAAGCTGCTGATGGACCCCAAGAGGCAGATCTTCCTGGACCAGAACATGCTCGCCGTGATC

TABLE 14-continued

Sequence optimized Open Reading Frame sequences for human IL12

GACGAGCTGATGCAGGCCCTGAACTTCAACAGCGAAACCGTGCCCCAGAAGTCAAGCCTGGAGGAGCCGGACTTCTATAAGACC
AAGATCAAGCTGTGTATCCTGCTACACGCTTTTCGTATCCGGGCCGTGACCATCGACAGGGTTATGTCGTACTTGAACGCCAGC

>hIL12AB_028 (SEQ ID NO: 1068)
ATGTGCCACCAACAGCTCGTGATCAGCTGGTTCAGCCTGGTGTTCCTGGCCAGCCCGCTGGTGGCCATCTGGGAGCTGAAGAAG
GACGTGTACGTGGTGGAGCTGGACTGGTACCCCGACGCCCCCGGCGAGATGGTGGTCCTGACCTGCGACACGCCGGAAGAGGAC
GGCATCACCTGGACCCTGGATCAGTCCAGCGAGGTGCTGGGCTCCGGCAAGACCCTGACCATTCAGGTGAAGGAGTTCGGCGAC
GCCGGTCAGTACACCTGCCACAAGGGCGGCGAGGTGCTGAGCCACAGCCTACTGCTCCTGCACAAAAAGGAGGATGGAATCTGG
TCCACCGACATCCTCAAGGACCAGAAGGAGCCGAAGAACAAGACGTTCCTCCGGTGCGAGGCCAAGAACTACAGCGGCAGGTTT
ACCTGCTGGTGGCTGACCACCATCAGCACCGACCTGACATTTTCCGTGAAGAGCAGCCGCGGCAGCAGCGATCCCCAGGGCGTG
ACCTGCGGGGCGGCCACCCTGTCCGCCGAGCGTGTGAGGGGCGACAACAAGGAGTACGAGTACAGCGTGGAATGCCAGGAGGAC
AGCGCCTGTCCCGCCGCCGAGGAGAGCCTGCCAATCGAGGTCATGGTGGACGCCGTGCACAAGCTGAAGTACGAGAACTACACG
AGCAGCTTCTTCATCAGGGACATCATCAAACCGGACCCGCCCAAGAACCTGCAGCTGAAACCCTTGAAAAACAGCAGGCAGGTG
GAAGTGTCTTGGGAGTACCCCGACACCTGGTCCACCCCCCACAGCTACTTTAGCCTGACCTTCTGTGTGCAGGTCCAGGGCAAG
TCCAAGAGGGAGAAGAAGGACAGGGTGTTCACCGACAAAACCAGCGCCACCGTGATCTGCAGGAAGAACGCCTCCATCAGCGTG
CGGGCCCAGGACAGGTATTACAGCTCGTCGTGGAGCGAGTGGGCCAGCGTGCCCTGCTCCGGGGGAGGCGGCGGCGGAAGCCGG
AATCTGCCCGTGGCCACCCCCGATCCCGGCATGTTCCCGTGTCTGCACCACAGCCAGAACCTGCTGCGGGCCGTGAGCAACATG
CTGCAGAAGGCCCGCCAAACCCTGGAGTTCTACCCCTGTACAAGCGAGGAGATCGACCATGAGGACATTACCAAGGACAAGACC
AGCACCGTGGAGGCCTGCCTGCCCCTCGAGCTCACAAAGAACGAATCCTGCCTGAATAGCCGCGAGACCAGCTTTATCACGAAC
GGGTCCTGCCTCGCCAGCCGGAAGACAAGCTTCATGATGGCCCTGTGCCTGAGCAGCATCTACGAGGACCTGAAAATGTACCAA
GTGGAGTTCAAAACGATGAACGCCAAGCTGCTGATGGACCCCAAGCGCCAGATCTTCCTGGACCAGAACATGCTGGCCGTCATC
GACGAGCTCATGCAGGCCCTGAACTTCAACAGCGAGACCGTGCCCCAGAAGAGCAGCCTGGAGGAGCCCGACTTCTACAAGACG
AAGATCAAGCTCTGCATCCTGCTGCACGCTTTCCGCATCCGCGCGGTGACCATCGACCGGGTGATGAGCTACCTCAACGCCAGT

>hIL12AB_029 (SEQ ID NO: 1069)
ATGTGCCACCAACAGCTGGTGATCAGCTGGTTCAGCCTGGTGTTTCTGGCCTCCCCTCTGGTGGCCATCTGGGAGCTGAAGAAG
GACGTGTACGTGGTGGAGCTGGACTGGTACCCTGACGCCCCCGGCGAAATGGTGGTGCTGACGTGCGACACCCCCGAGGAGGAT
GGCATCACCTGGACCCTGGACCAAAGCAGCGAGGTCCTCGGAAGCGGCAAGACCCTCACTATCCAAGTGAAGGAGTTCGGGGAT
GCGGGCCAGTACACCTGCCACAAGGGCGGCGAGGTGCTGTCTCATAGCCTGCTGCTCCTGCATAAGAAGGAAGACGGCATCTGG
AGCACCGACATACTGAAGGATCAGAAGGAGCCCAAGAACAAGACCTTCCTGAGGTGCGAGGCCAAGAACTACTCCGGGCGCTTC
ACCTGTTGGTGGCTGACCACCATCTCCACCGACCTGACCTTCAGCGTGAAGAGCAGCAGGGGGAGCAGCGACCCCCAGGGGGTG
ACCTGCGGAGCCGCGACCTTGTCGGCCGAGCGGGTGAGGGGCGACAATAAGGAGTACGAGTACTCGGTCGAATGCCAGGAGGAC
TCCGCCTGCCCCGCCGCCGAGGAGTCCCTCCCCATCGAAGTGATGGTGGACGCCGTCCACAAGCTGAAGTACGAGAACTACACC
AGCAGCTTCTTCATACGGGATATCATCAAGCCCGACCCCCCGAAGAACCTGCAGCTGAAACCCTTGAAGAACTCCAGGCAGGTG
GAGGTGAGCTGGGAGTACCCCGACACCTGGTCCACCCCGCACTCATACTTCAGCCTGACCTTCTGTGTACAGGTCCAGGGCAAG
AGCAAGAGGGAAAAGAAGGATAGGGTGTTCACCGACAAGACCTCCGCCACGGTGATCTGTCGGAAAAACGCCAGCATCTCCGTG
CGGGCCCAGGACAGGTACTATTCCAGCAGCTGGAGCGAGTGGGCCTCCGTCCCCTGCTCCGGCGGCGGTGGCGGGGGCAGCAGG
AACCTCCCCGTGGCCACCCCCGATCCCGGGATGTTCCCATGCCTGCACCACAGCCAAAACCTGCTGAGGGCCGTCTCCAATATG
CTGCAGAAGGCGAGGCAGACCCTGGAGTTCTACCCCTGTACCTCCGAGGAGATCGACCACGAGGATATCACCAAGGACAAGACC
TCCACGGTCGAGGCGTGCCTGCCCCTGGAGCTCACGAAGAACGAGAGCTGCCTTAACTCCAGGGAAACCTCGTTTATCACGAAC
GGCAGCTGCCTGGCGTCACGGAAGACCTCCTTTATGATGGCCCTATGTCTGTCCTCGATCTACGAGGACCTGAAGATGTACCAG
GTGGAGTTCAAGACCATGAACGCCAAGCTGCTGATGGATCCCAAGAGGCAGATTTTCCTGGACCAGAACATGCTGGCCGTGATT
GACGAGCTGATGCAGGCGCTGAACTTCAACAGCGAGACAGTGCCGCAGAAGAGCTCCCTGGAGGAGCCGGACTTTTACAAGACC
AAGATAAAGCTGTGCATCCTGCTCCACGCCTTCAGAATACGGGCCGTCACCATCGATAGGGTGATGTCTTACCTGAACGCCTCC

>hIL12AB_030 (SEQ ID NO: 1070)
ATGTGCCACCAGCAGCTGGTGATTAGCTGGTTTAGCCTGGTGTTCCTGGCAAGCCCCCTGGTGGCCATCTGGGAACTGAAAAAG
GACGTGTACGTGGTCGAGCTGGATTGGTACCCCGACGCCCCCGGCGAAATGGTGGTGCTGACGTGTGATACCCCCGAGGAGGAC
GGGATCACCTGGACCCTGGATCAGAGCAGCGAGGTGCTGGGGAGCGGGAAGACCCTGACGATCCAGGTCAAGGAGTTCGGCGAC
GCTGGGCAGTACACCTGTCACAAGGGCGGGGAGGTGCTGTCCCACTCCCTGCTGCTCCTGCATAAGAAAGAGGACGGCATCTGG
TCCACCGACATCCTCAAGGACCAGAAGGAGCCCAAGAACAAGACCTTCCTGCGGTGTGAGGCGAAGAACTACAGCGGCCGTTTC
ACCTGCTGGTGGCTGACGACAATCAGCACCGACTTGACGTTCTCCGTGAAGTCCTCCAGAGGCAGCTCCGACCCCCAAGGGGTG
ACGTGCGGCGCGGCCACCCTGAGCGCCGAGCGGGTGCGGGGGGACAACAAGGAGTACGAGTACTCCGTGGAGTGCCAGGAGGAC
AGCGCCTGTCCCGCAGCCGAGGAGTCCCTGCCCATCGAAGTCATGGTGGACGCCGTCCACAAGCTGAAGTACGAGAACTACACC
AGCAGCTTCTTCATCCGCGATATCATCAAGCCCGATCCCCCCAAAAACCTGCAACTGAAGCCGCTGAAGAATAGCAGGCAGGTG
GAGGTGTCCTGGGAGTACCCGGACACCTGGAGCACGCCCCACAGCTATTTCAGCCTGACCTTTTGCGTGCAGGTCCAGGGGAAG
AGCAAGCGGGAGAAGAAGGACCGCGTGTTTACGGACAAAACCAGCGCCACCGTGATCTGCAGGAAGAACGCCAGCATCAGCGTG
AGGGCCCAGGACAGGTACTACAGCAGCTCCTGGAGCGAGTGGGCCTCCGTGCCCTGTTCCGGAGGCGGCGGGGGCGGTTCCCGG
AACCTCCCGGTGGCCACCCCCGACCCGGGCATGTTCCCGTGCCTGCACCACTCACAGAATCTGCTGAGGGCCGTGAGCAATATG
CTGCAGAAGGCAAGGCAGACCCTGGAGTTTTATCCCTGCACCAGCGAGGAGATCGACCACGAAGACATCACCAAGGACAAGACC
AGCACAGTGGAGGCCTGCCTGCCCCTGGAACTGACCAAGAACGAGTCCTGTCTGAACTCCCGGGAAACCAGCTTCATAACCAAC
GGCTCCTGTCTCGCCAGCAGGAAGACCAGCTTCATGATGGCCCTGTGCCTCAGCTCCATCTACGAGGACCTCAAGATGTACCAG
GTTGAGTTCAAGACCATGAACGCCAAGCTCCTGATGGACCCCAAGAGGCAGATCTTCCTGGACCAGAATATGCTGGCCGTGATC
GATGAGTTAATGCAGGCGCTGAACTTCAACAGCGAGACGGTGCCCCAAAAGTCCTCGCTGGAGGAGCCCGACTTCTACAAGACC
AAGATCAAGCTGTGCATCCTCCTGCACGCCTTCCGAATCCGGGCCGTAACCATCGACAGGGTGATGAGCTATCTCAACGCCTCC

>hIL12AB_031 (SEQ ID NO: 1071)
ATGTGCCACCAGCAGCTCGTGATCAGCTGGTTCTCGCTTGTGTTCCTGGCCTCCCCCCTCGTCGCCATCTGGGAGCTGAAGAAA
GACGTGTACGTGGTGGAGCTGGACTGGTATCCCGACGCCCCGGGGGAGATGGTGGTGCTGACCTGCGACACCCCGGAAGAGGAC
GGCATCACCTGGACGCTCGACCAGTCGTCCGAAGTGCTGGGGTCGGGCAAGACCCTCACCATCCAGGTGAAGGAGTTCGGAGAC
GCCGGCCAGTACACCTGTCATAAGGGGGGGGAGGTGCTGAGCCACAGCCTCCTGCTCCTGCACAAAAAGGAGGACGGCATCTGG
AGCACCGATATCCTCAAGGACCAGAAGGAGCCCAAGAACAAGACGTTCCTGAGGTGTGAGGCCAAGAACTACAGCGGGCGGTTC
ACGTGTTGGTGGCTCACCACCATCTCCACCGACCTCACCTTCTCCGTGAAGTCAAGCAGGGGCAGCTCCGACCCCCAAGGCGTC
ACCTGCGGCGCCGCCACCCTGAGCGCCGAGAGGGTCAGGGGGGATAACAAGGAATACGAGTACAGTGTGGAGTGCCAAGAGGAT
AGCGCCTGTCCCGCCGCCGAAGAGAGCCTGCCCATCGAAGTGATGGTGGACGCCGTGCACAAGCTGAAGTACGAGAACTACACC
TCCAGCTTCTTCATCAGGGATATCATCAAGCCCGATCCCCCCAAGAACCTGCAGCTGAAGCCCCTGAAGAACAGCAGGCAGGTG
GAGGTGAGCTGGGAGTATCCCGACACGTGGAGCACCCCGCACAGCTACTTCTCGCTGACCTTCTGCGTGCAGGTGCAAGGGAAG
TCCAAGAGGGAGAAGAAGGATAGGGTGTTCACCGACAAAACGAGCGCCACCGTGATCTGCCGGAAGAATGCCAGCATCTCTGTG

TABLE 14-continued

Sequence optimized Open Reading Frame sequences for human IL12

AGGGCCCAGGACAGGTACTATTCCAGCTCCTGGTCGGAGTGGGCCAGCGTGCCCTGTAGCGGCGGGGGCGGGGGCGGCAGCAGG
AACCTCCCGGTTGCCACCCCCGACCCCGGCATGTTTCCGTGCCTGCACCACTCGCAAAACCTGCTGCGCGCGGTCTCCAACATG
CTGCAAAAAGCGCGCCAGACGCTGGAGTTCTACCCCCTGCACCAGCGAGGAGATCGATCATGAAGATATCACCAAAGACAAGACC
TCGACCGTGGAGGCCTGCCTGCCCCTGGAGCTCACCAAGAACGAAAGCTGCCTGAACAGCAGGGAGACAAGCTTCATCACCAAC
GGCAGCTGCCTGGCCTCCCGGAAGACCAGCTTCATGATGGCCCTGTGCCTGTCCAGCATCTACGAGGATCTGAAGATGTACCAA
GTGGAGTTTAAGACCATGAACGCCAAGCTGTTAATGGACCCCAAAAGGCAGATCTTCCTGGATCAGAACATGCTGGCCGTCATC
GACGAGCTGATGCAAGCCCTGAACTTCAACAGCGAGACGGTGCCCCAGAAGAGCAGCCTCGAGGAGCCCGACTTCTATAAGACC
AAGATAAAGCTGTGCATTCTGCTGCACGCCTTCAGAATCAGGGCCGTGACCATCGATAGGGTGATGAGCTACCTGAACGCCAGC

>hIL12AB_032 (SEQ ID NO: 1072)
ATGTGTCACCAGCAGCTGGTGATTTCCTGGTTCAGTCTGGTGTTTCTTGCCAGCCCCCTGGTGGCCATCTGGGAGCTGAAGAAA
GACGTATACGTCGTGGAGCTGGACTGGTATCCCGACGCTCCCGGCGAGATGGTGGTCCTCACCTGCGACACCCCAGAGGAGGAC
GGCATCACCTGGACCCTGGACCAGAGCTCCGAGGTCCTGGGCAGCGGTAAGACCCTCACCATCCAGGTGAAGGAGTTTGGTGAT
GCCGGGCAGTATACCTGCCACAAGGGCGGCGAGGTGCTGTCCCACAGCCTCCTGTTACTGCATAAGAAGGAGGATGGCATCTGG
AGCACCGACATCCTCAAGGACCAGAAAGAGCCCAAGAACAAGACCTTTCTGCGGTGCGAGGCGAAAAATTACTCCGGCCGGTTC
ACCTGCTGGTGGCTGACCACCATCAGCACGGACCTGACGTTCTCCGTGAAGTCGAGCAGGGGGAGCTCCGATCCCCAGGGCGTG
ACCTGCGGCGCGGCCACCCTGAGCGCCGAGCGCGTCCGCGGGGACAATAAGGAATACGAATATAGCGTGGAGTGCCAGGAGGAC
AGCGCCTGCCCCGCGGCCGAGGAGAGCCTCCCGATCGAGGTGATGGTGGATGCCGTCCACAAGCTCAAATACGAAAACTACACC
AGCAGCTTCTTCATTAGGGACATCATCAAGCCCGACCCCCCCAAAAACCTGCAGCTGAAGCCCCTGAAGAACAGCCGCCAGGTC
GAGGTGTCATGGGAGTACCCAGACACCTGGAGCACCCCCCACTCCTACTTCAGCCTGACCTTCTGCGTCCAGGTGCAGGGAAAG
TCCAAACGGGAGAAGAAGGATAGGGTCTTTACCGATAAGACGTCGGCCACCGTCATCTGCAGGAAGAACGCCAGCATAAGCGTG
CGGGCGCAGGATCGGTACTACAGCTCGAGCTGGTCCGAATGGGCCTCCGTGCCCTGTAGCGGAGGGGGTGGCGGGGGCAGCAGG
AACCTGCCCGTGGCCACCCCGGACCCGGGCATGTTTCCCTGCCTGCATCACAGTCAGAACCTGCTGAGGGCCGTGAGCAACATG
CTCCAGAAGGCCCGCCAGACCCTGGAGTTTTACCCCTGCACCAGCGAAGAGATCGATCACGAAGACATCACCAAAGACAAGACC
TCCACCGTGGAGGCCTGTCTGCCCCTGGAGCTGACCAAGAACGAGAGCTGTCTGAACAGCAGGGAGACCTCCTTCATCACCAAC
GGCTCCTGCCTGGCATCCCGGAAGACCAGCTTCATGATGGCCCTGTGTCTGAGCTCTATCTACGAGGACCTGAAGATGTACCAG
GTCGAGTTCAAGACCATGAACGCCAAGCTGCTGATGGACCCCAAGCGACAGATATTCCTGGACCAGAACATGCTCGCCGTGATC
GATGAACTGATGCAAGCCCTGAACTTCAATAGCGAGACCGTGCCCCAGAAAAGCAGCCTGGAGGAGCCCGACTTCTACAAGACC
AAGATCAAACTGTGCATACTGCTGCACGCGTTCAGGATCCGGGCCGTCACCATCGACCGGGTGATGTCCTATCTGAATGCCAGC

>hIL12AB_033 (SEQ ID NO: 1073)
ATGTGCCACCAGCAGCTCGTGATTAGCTGGTTTTCGCTGGTGTTCCTGGCCAGCCCTCTCGTGGCCATCTGGGAGCTGAAAAAA
GACGTGTACGTGGTGGAGCTGGACTGGTACCCGGACGCCCCCGGCGAGATGGTGGTGCTGACGTGCGACACCCCGGAAGAGGAC
GGCATCACCTGGACCCTGGACCAGTCATCCGAGGTCCTGGGCAGCGGCAAGACGCTCACCATCCAGGTGAAGGAGTTCGGCGAC
GCCGGCCAGTACACATGCCATAAGGGCGGGGAGGTGCTGAGCCACAGCCTGCTCCTCCTGCACAAGAAGGAGGATGGCATCTGG
TCTACAGACATCCTGAAGGACCAGAAAGAGCCCAAGAACAAGACCTTCCTCCGGTGCGAGGCCAAGAACTACTCCGGGCGGTTT
ACTTGTTGGTGGCTGACCACCATCAGCACCGACCTCACCTTCAGCGTGAAGAGCTCCCGAGGGAGCTCCGACCCCCAGGGGGTC
ACCTGCGGCGCCGCCACCCTGAGCGCCGAGCGGGTGAGGGGCGACAACAAGGAGTATGAATACAGCGTGGAATGCCAAGAGGAC
AGCGCCTGTCCCGCGGCCGAGGAAAGCCTGCCCATCGAGGTGATGGTGGACGCCGTCCACAAACTCAAGTACGAGAACTACACC
AGCAGTTTCTTCATTCGCGACATCATCAAGCCGGACCCCCCCAAAAACCTGCAGCTCAAACCCCTGAAGAACAGCAGGCAGGTG
GAGGTCAGCTGGGAGTACCCGGACACCTGGAGCACCCCCCATAGCTACTTCAGCCTGACCTTCTGCGTGCAGGTGCAGGGCAAG
AGCAAACGCGAGAAGAAGGACCGGGTGTTTACCGACAAGACCAGCGCCACGGTGATCTGCCGAAAGAATGCAAGCATCTCCGTG
AGGGCGCAGGACCGCTACTACTCTAGCAGCTGGAGCGAGTGGGCCAGCGTGCCCTGCAGCGGTGGCGGCGGAGGCGGCAGCCGT
AACCTCCCCGTGGCCACCCCCGACCCCGGCATGTTCCCGTGTCTGCACCACTCCCAGAACCTGCTGAGGGCCGTCAGCAATATG
CTGCAGAAGGCCCGGCAGACGCTGGAGTTCTACCCCTGCACCTCCGAGGAGATCGACCATGAGGACATTACCAAGGACAAGACG
AGCACTGTGGAGGCCTGCCTGCCCCTGGAGCTCACCAAAAACGAGAGCTGCCTGAATAGCAGGGAGACGTCCTTCATCACCAAC
GGCAGCTGTCTGGCCAGCAGGAAGACCAGCTTCATGATGGCCCTGTGCCTCTCCTCCATATATGAGGATCTGAAGATGTACCAG
GTGGAGTTCAAGACCATGAACGCCAAGCTGCTGATGGATCCCAAGAGGCAGATCTTCCTGGACCAGAATATGCTGGCCGTGATT
GACGAGCTGATGCAGGCCCTGAACTTTAATAGCGAGACCGTCCCCCAGAAGAGCAGCCTGGAGGAGCCCGACTTCTATAAGACC
AAGATCAAGCTGTGCATACTGCTGCACGCGTTTAGGATAAGGGCCGTCACCATCGACAGGGTGATGAGCTACCTGAATGCCAGC

>hIL12AB_034 (SEQ ID NO: 1074)
ATGTGCCACCAACAGCTGGTGATCTCCTGGTTCAGCCTGGTGTTCCTCGCCAGCCCCCTGGTGGCCATCTGGGAGCTGAAGAAA
GACGTGTACGTGGTGGAGCTGGACTGGTATCCCGACGCCCCCGGCGAGATGGTCGTGCTGACCTGCGACACCCCGGAGGAGGAC
GGCATCACCTGGACCCTGGATCAGTCCTCCGAGGTGCTGGGCAGCGGGAAGACCCTGACCATCCAGGTGAAAGAGTTCGGAGAT
GCCGGCCAGTATACCTGTCACAAGGGGGGTGAGGTGCTGAGCCATAGCCTCTTGCTTCTGCACAAGAAGGAGGACGGCATCTGG
TCCACCGACATCCTCAAGGACCAAAAGGAGCCGAAGAATAAAACGTTCCTGAGGTGCGAAGCCAAGAACTATTCCGGACGGTTC
ACCTGCTGGTGGCTGACCACCATCAGCACCGACCTCACCTTCTCCGTAAAGTCAAGCAGGGGCAGCTCCGACCCCCAGGGCGTG
ACCTGCGGAGCCGCCACCCTGAGCGCAGAGAGGGTGAGGGGCGACAACAAGGAGTACGAATACTCCGTCGAGTGCCAGGAGGAC
AGCGCCTGCCCCGCCGCCGAGGAAAGTCTGCCCATCGAGGTGATGGTGGACGCCGTGCACAAGCTCAAATACGAGAACTACACC
AGCAGCTTCTTCATCCGGGATATCATCAAGCCCGACCCTCCAAAGAATCTGCAGCTGAAACCCCTTAAGAACAGCAGGCAGGTG
GAGGTCAGCTGGGAGTACCCCGACACCTGGAGCACGCCCCACTCCTACTTTAGCCTGACCTTTTGCGTGCAGGTGCAGGGGAAA
AGCAAGCGGGAGAAGAAGGACAGGGTGTTCACCGATAAGACCTCCGCTACCGTGATCTGCAGGAAGAACGCCTCAATCAGCGTG
AGGGCCCAGGATCGGTACTACTCCAGCTCCTGGAGCGAGTGGGCCAGCGTGCCCTGCTCTGGCGGTGGCGGCGGGGGCAGCCGG
AACCTGCCGGTGGCCACTCCCGACCCGGGCATGTTCCCGTGCCTCCACCATTCCCAGAACCTGCTGCGGGCCGTGTCCAATATG
CTCCAGAAGGCAAGGCAGACCCTGGAGTTCTACCCCTGCACCAGCGAGGAGATCGATCACGAGGACATCACCAAAGACAAAACC
AGCACGGTCGAGGCCTGCCTGCCCCTGGAACTCACCAAGAACGAAAGCTGTCTCAACAGCCGCGAGACCAGCTTCATAACCAAC
GGTTCCTGTCTGGCCTCCCGCAAGACCAGCTTTATGATGGCCCTCTGTCTGAGCTCCATCTATGAAGACCTGAAAATGTACCAG
GTGGAGTTCAAAACCATGAACGCCAAGCTTCTGATGGACCCCAAGAGGCAGATCTTCCTGGATCAGAACATGCTGGCCGTGATC
GACGAGCTGATGCAGGCCCTGAACTTTAACTCCGAGACCGTGCCCCAGAAAAGCAGCCTGGAAGAGCCCGATTTCTACAAAACG
AAGATCAAGCTGTGCATCCTGCTGCACGCCTTCCGGATCCGTGCGGTGACCATCGATAGGGTGATGAGCTACCTGAACGCCAGC

>hIL12AB_035 (SEQ ID NO: 1075)
ATGTGCCACCAACAGCTGGTAATCAGCTGGTTCAGCCTGGTTTTCCTCGCGTCGCCCCTGGTGGCCATCTGGGAGTTAAAGAAG
GACGTGTACGTGGTGGAGCTGGATTGGTACCCCGACGCCCCGGGCGAGATGGTCGTGCTCACCTGCGATACCCCCGAGGAGGAC
GGGATCACCTGGACCCTGGACCAATCCAGCGAGGTGCTGGGCAGCGGCAAGACCCTGACCATACAGGTGAAGGAATTTGGGGAC
GCCGGGCAGTACACCTGCCACAAGGGCGGGGAAGTGCTGTCCCACTCCCTCCTGCTGCTGCATAAGAAGGAGGACGGCATCTGG
AGCACCGACATCCTGAAGGACCAAAAGGAGCCCAAGAACAAGACCTTCCTGAGGTGCGAGGCCAAAAACTATTCCGGCCGCTTT

TABLE 14-continued

Sequence optimized Open Reading Frame sequences for human IL12

ACCTGTTGGTGGCTGACCACCATCTCCACCGATCTGACCTTCAGCGTGAAGTCGTCTAGGGGCTCCTCCGACCCCCAGGGCGTA
ACCTGCGGCGCCGCGACCCTGAGCGCCGAGAGGGTGCGGGGCGATAACAAAGAGTACGAGTACTCGGTGGAGTGCCAGGAGGAC
AGCGCCTGTCCGGCGGCCGAGGAGAGCCTGCCCATCGAGGTGATGGTGGACGCCGTCCACAAGCTGAAGTACGAGAACTACACC
AGTTCGTTCTTCATCAGGGACATCATCAAGCCGGACCCCCCCAAGAACCTCCAGCTGAAGCCCCTGAAGAACAGCAGGCAGGTG
GAAGTGTCCTGGGAGTATCCCGACACCTGGAGCACCCCCCACAGCTACTTCAGCCTGACCTTTTGCGTGCAGGTGCAGGGCAAA
AGCAAGAGGGAAAAGAAGGACCGGGTGTTCACCGATAAGACGAGCGCCACCGTTATCTGCAGGAAGAACGCCTCCATAAGCGTG
AGGGCGCAGGACCGTTACTACAGCAGCAGCTGGAGTGAGTGGGCAAGCGTGCCCTGTAGCGGCGGGGGCGGGGGCGGGTCCCGC
AACCTCCCCGTCGCCACCCCCGACCCAGGCATGTTTCCGTGCCTGCACCACAGCCAGAACCTGCTGCGGGCCGTTAGCAACATG
CTGCAGAAGGCCAGGCAGACCCTCGAGTTCTATCCCTGCACATCTGAGGAGATCGACCACGAAGACATCACTAAGGATAAGACC
TCCACCGTGGAGGCCTGTCTGCCCCTCGAGCTGACCAAGAATGAATCCTGCCTGAACAGCCGAGAGACCAGCTTTATCACCAAC
GGCTCCTGCCTGGCCAGCAGGAAGACCTCCTTCATGATGGCCCTGTGCCTCTCCAGCATCTACGAGGATCTGAAGATGTACCAG
GTAGAGTTCAAGACGATGAACGCCAAGCTCCTGATGGACCCCAAGAGGCAGATATTCCTGGACCAGAACATGCTGGCGGTGATC
GACGAGCTGATGCAGGCCCTGAATTTCAACAGCGAGACGGTGCCACAGAAGTCCAGCCTGGAGGAGCCAGACTTCTACAAGACC
AAGATCAAACTGTGCATCCTCCTGCACGCGTTCAGGATCCGCGCCGTCACCATAGACAGGGTGATGAGTTATCTGAACGCCAGC

>hIL12AB_036 (SEQ ID NO: 1076)
ATGTGCCATCAGCAGCTGGTAATCAGCTGGTTTAGCCTGGTGTTCCTGGCCAGCCCACTGGTGGCCATCTGGGAGCTGAAGAAG
GACGTGTACGTGGTGGAACTGGACTGGTACCCCGACGCCCCTGGCGAGATGGTGGTACTGACCTGTGACACCCCGGAGGAAGAC
GGTATCACCTGGACCCTGGATCAGAGCTCCGAGGTGCTGGGCTCCGGCAAGACACTGACCATCCAAGTTAAGGAATTTGGGGAC
GCCGGCCAGTACACCTGCCACAAGGGGGGCGAGGTGCTGTCCCACTCCCTGCTGCTTCTGCATAAGAAGGAGGATGGCATCTGG
TCCACCGACATACTGAAGGACCAGAAGGAGCCCAAGAATAAGACCTTCCTGAGATGCGAGGCCAAGAACTACTCGGGAAGGTTC
ACCTGCTGGTGGCTGACCACCATCAGCACCGACCTGACCTTCTCCGTGAAGAGCTCCCGGGGCAGCTCCGACCCCCAGGGCGTA
ACCTGTGGGGCCGCTACCCTGTCCGCCGAGAGGGTCCGGGGCGACAACAAGGAATACGAGTACAGCGTGGAGTGCCAGGAGGAC
TCCGCCTGCCCCGCCGCCGAGGAGTCGCTGCCCATAGAGGTGATGGTGGACGCCGTGCACAAGCTCAAGTACGAGAATTACACC
AGCAGCTTCTTTATCAGGGACATAATTAAGCCGGACCCCCCAAAGAATCTGCAGCTGAAGCCCCTGAAGAATAGCCGGCAGGTG
GAAGTGTCCTGGGAGTACCCCGACACCTGGAGCACCCCCCACTCCTATTTCTCACTGACATTCTGCGTGCAGGTGCAAGGGAAA
AGCAAGAGGGAGAAGAAGGATAGGGTGTTCACCGACAAGACAAGCGCCACCGTGATCTGCCGAAAAAATGCCAGCATCAGCGTG
AGGGCCCAGGATCGGTATTACAGCAGCTCCTGGAGCGAGTGGGCCAGCGTGCCCTGTTCCGGCGGGGGAGGGGGCGGCTCCCGG
AACCTGCCGGTGGCCACCCCCGACCCTGGCATGTTCCCCTGCCTGCATCACAGCCAGAACCTGCTCCGGGCCGTGTCGAACATG
CTGCAGAAGGCCCGGCAGACCCTCGAGTTTTACCCCTGCACCAGCGAAGAGATCGACCACGAAGACATAACCAAGGACAAGACC
AGCACGGTGGAGGCCTGCCTGCCCCTGGAGCTTACCAAAAACGAGTCCTGCCTGAACAGCCGGGAAACCAGCTTCATAACGAAC
GGGAGCTGCCTGGCCTCCAGGAAGACCAGCTTCATGATGGCGCTGTGTCTGTCCAGCATATACGAGGATCTGAAGATGTATCAG
GTGGAATTCAAAACTATGAATGCCAAGCTCCTGATGGACCCCAAGAGGCAGATCTTCCTGGACCAGAACATGCTAGCCGTGATC
GACGAGCTGATGCAGGCCCTCAACTTCAACTCGGAGACGGTGCCCCAGAAGTCCAGCCTCGAGGAGCCCGACTTCTACAAGACC
AAGATCAAGCTGTGCATACTGCTGCATGCCTTCAGGATAAGGGCGGTGACTATCGACAGGGTCATGTCCTACCTGAACGCCAGC

>hIL12AB_037 (SEQ ID NO: 1077)
ATGTGCCACCAACAACTGGTGATCAGCTGGTTCTCCCTGGTGTTCCTGGCCAGCCCCCTGGTGGCCATCTGGGAGCTCAAAAAA
GACGTGTACGTGGTGGAGCTCGATTGGTACCCAGACGCGCCGGGGGAAATGGTGGTGCTGACCTGCGACACCCCAGAGGAGGAT
GGCATCACGTGGACGCTGGATCAGTCCAGCGAGGTGCTGGGGAGCGGCAAGACGCTCACCATCCAGGTGAAGGAATTTGGCGAC
GCGGGCCAGTATACCTGTCACAAGGGCGGCGAGGTGCTGAGCCACTCCCTGCTGCTGCTGCACAAGAAGGAGGATGGGATCTGG
TCAACCGATATCCTGAAAGACCAGAAGGAGCCCAAGAACAAGACCTTCCTGCGCTGCGAGGCCAAGAACTATAGCGGCAGGTTC
ACCTGCTGGTGGCTGACCACCATCAGCACCGACCTGACCTTCAGCGTGAAATCCTCCAGGGGCAGCAGCGACCCCCAGGGCGTG
ACCTGCGGTGCCGCCACGCTCTCCGCCGAGCGAGTGAGGGGTGACAACAAGGAGTACGAGTACAGCGTGGAATGTCAGGAGGAC
AGCGCCTGTCCCGCCGCCGAGGAGTCGCTGCCCATCGAGGTGATGGTCGACGCGGTGCACAAGCTCAAATACGAGAATTACACC
AGCAGCTTCTTCATCAGGGACATCATCAAGCCCGACCCCCCCAAGAACCTGCAGCTGAAGCCCTTGAAGAACAGCAGGCAGGTG
GAGGTGAGCTGGGAGTACCCGGACACCTGGAGCACCCCCCACTCCTACTTCAGCCTGACGTTCTGTGTGCAGGTGCAGGGGAAG
TCCAAGAGGGAGAAGAAGGACCGGGTGTTCACCGACAAGACCAGCGCCACCGTGATATGCCGCAAGAACGCGTCCATCAGCGTT
CGCGCCCAGGACCGCTACTACAGCAGCTCCTGGTCCGAATGGGCCAGCGTGCCCTGCAGCGGTGGAGGGGGCGGGGGCTCCAGG
AATCTGCCGGTGGCCACCCCCGACCCCGGGATGTTCCCGTGTCTGCATCACTCCCAGAACCTGCTGCGGGCCGTGAGCAATATG
CTGCAGAAGGCCAGGCAGACGCTCGAGTTCTACCCCTGCACCTCCGAAGAGATCGACCATGAGGACATCACCAAGGACAAGACC
AGCACCGTGGAGGCCTGCCTCCCCCTGGAGCTGACCAAAAACGAGAGCTGCCTGAACTCCAGGGAGACCAGCTTTATAACCAAC
GGCAGCTGCCTCGCCTCCAGGAAGACCTCGTTTATGATGGCCCTCTGCCTGTCCAGCATCTACGAGGACCTGAAGATGTACCAG
GTGGAGTTCAAGACCATGAACGCGAAGTTGCTCATGGACCCCAAGAGGCAGATCTTCCTGGACCAGAACATGCTCGCGGTGATC
GACGAGCTGATGCAAGCCCTGAACTTCAACAGCGAGACCGTGCCCCAGAAGAGCAGCCTGGAAGAGCCCGACTTCTACAAGACC
AAGATCAAGCTGTGCATCCTGCTGCACGCCTTCCGGATCCGGGCCGTGACCATCGACAGGGTGATGAGCTACCTCAACGCCTCC

>hIL12AB_038 (SEQ ID NO: 1078)
ATGTGCCACCAGCAGCTCGTGATCAGCTGGTTCTCCCTCGTCTTCCTGGCCTCCCCGCTGGTGGCCATCTGGGAGCTGAAGAAG
GACGTGTACGTGGTGGAGCTGGACTGGTATCCCGACGCCCCCGGCGAGATGGTGGTGCTGACGTGCGACACACCAGAAGAGGAC
GGGATCACATGGACCCTGGATCAGTCGTCCGAGGTGCTGGGGAGCGGCAAGACCCTCACCATCCAAGTGAAGGAGTTCGGGGAC
GCCGGCCAGTACACCTGCCACAAGGGCGGGGAGGTGCTCTCCCATAGCCTGCTCCTCCTGCACAAAAAGGAGGATGGCATCTGG
AGCACCGACATCCTGAAGGACCAGAAGGAGCCCAAGAACAAGACATTTCTCAGGTGTGAGGCCAAGAACTATTCGGGCAGGTTT
ACCTGTTGGTGGCTCACCACCATCTCTACCGACCTGACGTTCTCCGTCAAGTCAAGCAGGGGGAGCTCGGACCCCCAGGGGGTG
ACATGTGGGGCCGCCACCCTGAGCGCGGAGCGTGTCCGCGGCGACAACAAGGAGTACGAGTATTCCGTGGAGTGCCAGGAGGAC
AGCGCCTGCCCCGCCGCCGAGGAGTCCCTGCCCATAGAGGTGATGGTGGACGCCGTCCACAAGTTGAAGTACGAAAATTATACC
TCCTCGTTCTTCATTAGGGACATCATCAAGCCTGACCCCCCGAAGAACCTACAACTCAAGCCCCTCAAGAACTCCCGCCAGGTG
GAGGTGTCCTGGGAGTACCCCGACACCTGGTCCACCCCGCACAGCTACTTCAGCCTGACCTTCTGCGTGCAGGTCCAGGGGAAG
AGCAAGCGTGAAAAGAAAGACAGGGTGTTCACCGACAAGACGAGCGCCACCGTGATCTGCAGGAAAAACGCCTCCATCTCCGTG
CGCGCCCAGGACAGGTACTACAGTAGCTCCTGGAGCGAATGGGCCAGCGTGCCGTGCAGCGGCGGGGAGGAGGCGGCAGTCGC
AACCTGCCCGTGGCCACCCCCGACCCCGGCATGTTCCCATGCCTGCACCACAGCCAGAACCTGCTGAGGGCAGTCAGCAATATG
CTGCAGAAGGCCAGGCAGACCCTGGAGTTTTATCCCTGCACCAGCGAGGAGATCGACCACGAGGACATCACCAAGGACAAGACC
TCCACCGTCGAGGCCTGCCTGCCACTGGAGCTGACCAAAAACGAGAGCTGCCTGAACTCCAGGGAGACCTCCTTCATCACCAAC
GGGAGCTGCCTGGCCAGCCGGAAGACCAGCTTCATGATGGCGCTGTGCCTCAGCAGCATCTACGAGGATCTCAAGATGTACCAG
GTGGAGTTCAAGACCATGAACGCGAAGCTGCTGATGGACCCCAAGCGGCAGATCTTCCTGGACCAGAACATGCTGGCCGTGATT
GACGAGCTCATGCAGGCCCTGAACTTCAATAGCGAGACCGTCCCCCAAAAGAGCAGCCTGGAGGAACCCGACTTCTACAAAACG
AAGATCAAGCTCTGCATCCTGCTGCACGCCTTCCGGATCCGGGCCGTGACCATCGATCGTGTGATGAGCTACCTGAACGCCTCG

TABLE 14-continued

| Sequence optimized Open Reading Frame sequences for human IL12 |
|---|
| >hIL12AB_039 (SEQ ID NO: 1079)<br>ATGTGCCACCAGCAGCTCGTCATCTCCTGGTTTAGCCTGGTGTTTCTGGCCTCCCCCCTGGTCGCCATCTGGGAGCTGAAGAAA<br>GACGTGTACGTGGTGGAGCTGGACTGGTACCCGGACGCTCCCGGGGAGATGGTGGTGCTGACCTGCGACACCCCCGAGGAGGAC<br>GGCATCACCTGGACCCTGGACCAGAGCTCCGAGGTGCTGGGGAGCGGCAAGACCCTGACCATTCAGGTGAAAGAGTTCGGCGAC<br>GCCGGCCAATATACCTGCCACAAGGGGGGGGAGGTCCTGTCGCATTCCCTGCTGCTGCTTCACAAAAAGGAGGATGGCATCTGG<br>AGCACCGACATCCTGAAGGACCAGAAAGAACCCAAGAACAAGACGTTCCTGCGCTGCGAGGCCAAGAACTACAGCGGCCGGTTC<br>ACCTGTTGGTGGCTGACCACCATCTCCACCGACCTGACTTTCTCGGTGAAGAGCAGCCGCGGGAGCAGCGACCCCCAGGGAGTG<br>ACCTGCGGCGCCGCCACCCTGAGCGCCGAAAGGGTGAGGGGCGACAATAAAGAGTACGAGTATTCCGTGGAGTGCCAGGAGGAC<br>AGCGCCTGTCCCGCCGCCGAGGAGTCCCTGCCTATCGAGGTGATGGTCGACGCGGTGCACAAGCTCAAGTACGAAAACTACACC<br>AGCAGCTTTTTCATCAGGGATATCATCAAACCAGACCCCCCCAAGAACCTGCAGCTGAAGCCCCTGAAAAACAGCAGGCAGGTG<br>GAAGTGAGCTGGGAATACCCCGATACCTGGTCCACCCCCCACAGCTACTTCAGCCTGACCTTCTGCGTGCAGGTGCAGGGGAAG<br>TCCAAGCGGGAGAAGAAAGATCGGGTGTTCACGGACAAGACCAGCGCCACCGTGATTTGCAGGAAAAACGCCAGCATCTCCGTG<br>AGGGCTCAGGACAGGTACTACAGCTCCAGCTGGAGCGAGTGGGCCTCCGTGCCTTGCAGCGGGGGAGGAGGCGGCGGCAGCAGG<br>AATCTGCCCGTCGCAACCCCCGACCCCGGCATGTTCCCCTGCCTGCACCACAGCCAGAATCTGCTGCGAGCCGTGAGCAACATG<br>CTCCAGAAGGCCCGGCAGACGCTGGAGTTCTACCCCTGCACCTCCGAGGAGATCGACCACGAGGACATCACCAAGGATAAGACG<br>AGCACCGTCGAGGCCTGTCTCCCCCTGGAGCTCACCAAGAACGAGTCCTGCCTGAATAGCAGGGAGACGTCCTTCATAACCAAC<br>GGCAGCTGTCTGGCGTCCAGGAAGACCAGCTTCATGATGGCCCTCTGCCTGAGCTCCATCTACGAGGACCTCAAGATGTACCAG<br>GTCGAGTTCAAGACCATGAACGCAAAACTGCTCATGGATCCAAAGAGGCAGATCTTTCTGGACCAGAACATGCTGGCCGTGATC<br>GATGAACTCATGCAGGCCCTGAATTTCAATTCCGAGACCGTGCCCCAGAAGAGCTCCCTGGAGGAACCCGACTTCTACAAAACA<br>AAGATCAAGCTGTGTATCCTCCTGCACGCCTTCCGGATCAGGGCCGTCACCATTGACCGGGTGATGTCCTACCTGAACGCCAGC |
| >hIL12AB_040 (SEQ ID NO: 1080)<br>ATGTGCCATCAGCAGCTGGTGATCAGCTGGTTCAGCCTCGTGTTCCTCGCCAGCCCCCTCGTGGCCATCTGGGAGCTGAAAAAG<br>GACGTGTACGTGGTGGAGCTGGACTGGTATCCCGACGCCCCGGGCGAGATGGTGGTGCTGACCTGCGACACCCCCGAGGAGGAC<br>GGCATTACCTGGACACTGGACCAGAGCAGCGAGGTCCTGGGCAGCGGGAAGACCCTGACAATTCAGGTGAAGGAGTTCGGCGAC<br>GCCGGACAGTACACGTGCCACAAGGGGGGGGAGGTGCTGTCCCACAGCCTCCTCCTGCTGCACAAGAAGGAGGATGGCATCTGG<br>AGCACCGACATCCTGAAGGATCAGAAGGAGCCCAAGAACAAGACCTTTCTGAGATGCGAGGCCAAGAATTACAGCGGCCGTTTC<br>ACCTGCTGGTGGCTCACCACCATCAGCACCGACCTGACCTTCAGCGTGAAATCCTCCAGGGGCTCCTCCGACCCGCAGGGAGTG<br>ACCTGCGGCGCCGCCACACTGAGCGCCGAGCGGGTCAGAGGGGACAACAAGGAGTACGAGTACAGCGTTGAGTGCCAGGAGGAC<br>AGCGCCTGTCCCGCGGCCGAGGAATCCCTGCCCATCGAGGTGATGGTGGACGCAGTGCACAAGCTGAAGTACGAGAACTATACC<br>TCGAGCTTCTTCATCCGGGATATCATTAAGCCCGATCCCCCGAAGAACCTGCAGCTCAAACCCCTGAAGAACAGCAGGCAGGTG<br>GAGGTCTCCTGGGAGTACCCCGACACATGGTCCACCCCCCATTCCTATTTCTCCCTGACCTTTTGCGTGCAGGTGCAGGGCAAG<br>AGCAAGAGGGAGAAAAAGGACAGGGTGTTCACCGACAAGACCTCCGCCACCGTGATCTGCCGTAAGAACGCTAGCATCAGCGTC<br>AGGGCCCAGGACAGGTACTATAGCAGCTCCTGGTCCGAGTGGGCCAGCGTCCCGTGCAGCGGCGGGGGCGGTGGAGGCTCCCGG<br>AACCTCCCCGTGGCCACCCCGGACCCCGGGATGTTTCCCTGCCTGCATCACAGCCAGAACCTGCTGAGGGCCGTGTCCAACATG<br>CTGCAGAAGGCCAGGCAGACACTCGAGTTTTACCCCTGCACCAGCGAGGAGATCGACCACGAAGACATCACCAAGGACAAGACC<br>TCCACCGTGGAGGCATGCCTGCCCCTGGAGCTGACCAAAAACGAAAGCTGTCTGAACTCCAGGGAGACCTCCTTTATCACGAAC<br>GGCTCATGCCTGGCCTCCAGAAAGACCAGCTTCATGATGGCCCTGTGCCTGAGCTCCATCTACGAGGACTTGAAAATGTACCAG<br>GTCGAGTTCAAGACCATGAACGCCAAGCTGCTCATGGACCCCAAAAGGCAGATCTTTCTGGACCAGAATATGCTGGCCGTGATC<br>GACGAGCTCATGCAAGCCCTGAATTTCAACAGCGAGACCGTGCCCCAGAAGTCCTCCCTGGAGGAGCCCGACTTCTACAAGACC<br>AAGATCAAGCTGTGCATACTCCTGCACGCGTTTAGGATCAGGGCGGTGACCATCGATAGGGTGATGAGCTACCTGAATGCCTCC |

TABLE 15

| Sequence Optimized IL12 Polynucleotides Comprising 5' UTR, ORF, and 3' UTR | | |
|---|---|---|
| SEQ ID NO | Description | Sequence |
| 1081 | hIL12AB_001 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAGCAGCTGGTCATTAGCTGG<br>TTTAGCCTTGTGTTCCTGGCCTCCCCCCTTGTCGCTATTTGGGAGCTCAAGAAGGACGTGT<br>ACGTGGTGGAGTTGGATTGGTACCCAGACGCGCCCGGAGAGATGGTAGTTCTGACCTGTGA<br>TACCCCAGAGGAGGACGGCATCACCTGGACGCTGGACCAAAGCAGCGAGGTTTTGGGCTCA<br>GGGAAAACGCTGACCATCCAGGTGAAGGAATTCGGCGACGCCGGGCAGTACACCTGCCATA<br>AGGGAGGAGAGGTGCTGAGCCATTCCCTTCTTCTGCTGCACAAGAAAGAGGACGGCATCTG<br>GTCTACCGACATCCTGAAAGACCAGAAGGAGCCCAAGAACAAAACCTTCCTGAGGTGCGAG<br>GCCAAGAACTACTCCGGCAGGTTCACTTGTTGGTGGCTGACCACCATCAGTACAGACCTGA<br>CTTTTAGTGTAAAAAGCTCCAGAGGCTCGTCCGATCCCCAAGGGGTGACCTGCGGCGCAGC<br>CACTCTGAGCGCTGAGCGCGTGCGCGGTGACAATAAAGAGTACGAGTACAGCGTTGAGTGT<br>CAAGAAGATAGCGCTTGCCCTGCCGCCGAGGAGAGCCTGCCTATCGAGGTGATGGTTGACG<br>CAGTGCACAAGCTTAAGTACGAGAATTACACCAGCTCATTCTTCATTAGAGATATAATCAA<br>GCCTGACCCACCCAAGAACCTGCAGCTGAAGCCACTGAAAAACTCACGGCAGGTCGAAGTG<br>AGCTGGGAGTACCCCGACACCTGGAGCACTCCTCATTCCTATTTCTCTCTTACATTCTGCG<br>TCCAGGTGCAGGGCAAGAGCAAGCGGGAAAAGAAGGATCGAGTCTTCACCGACAAAACAAG<br>CGCGACCGTGATTTGCAGGAAGAACGCCAGCATCTCCGTCAGAGCCCAGGATAGATACTAT<br>AGTAGCAGCTGGAGCGAGTGGGCAAGCGTGCCCTGTTCCGGCGGCGGGGGCGGGGGCAGCC<br>GAAACTTGCCTGTCGCTACCCCGGACCCTGGAATGTTTCCGTGTCTGCACCACAGCCAGAA<br>CCTGCTGAGAGCCGTGTCGAATATGCTCCAGAAGGCCCGGCAGACCCTTGAGTTCTACCCC<br>TGTACCAGCGAAGAGATCGATCATGAAGATATCACGAAAGATAAAACATCCACCGTCGAGG<br>CTTGTCTCCCGCTGGAGCTGACCAAGAACGAGAGCTGTCTGAATAGCCGGGAGACGTCTTT<br>CATCACGAATGGTAGCTGTCTGGCCAGCAGGAAAACTTCCTTCATGATGGCTCTCTGCCTG<br>AGCTCTATCTATGAAGATCTGAAGATGTATCAGGTGGAGTTTAAAACAATGAACGCCAAAC<br>TCCTGATGGACCCAAAAAGGCAAATCTTTCTGGACCAGAATATGCTGGCCGTGATAGACGA<br>GCTGATGCAGGCACTGAACTTCAACAGCGAGACGGTGCCACAGAAATCCAGCCTGGAGGAG<br>CCTGACTTTTACAAAACTAAGATCAAGCTGTGTATCCTGCTGCACGCCTTTAGAATCCGTG |

TABLE 15-continued

Sequence Optimized IL12 Polynucleotides Comprising 5' UTR, ORF, and 3' UTR

| SEQ ID NO | Description | Sequence |
|---|---|---|
| | | CCGTGACTATCGACAGGGTGATGTCATACCTCAACGCTTCATGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1082 | hIL12AB_002 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTGATCAGCTGG<br>TTCAGCCTGGTGTTCCTGGCCAGCCCCCTGGTGGCCATCTGGGAGCTGAAGAAGGACGTGT<br>ACGTGGTGGAGTTGGATTGGTACCCCGACGCCCCCGGCGAGATGGTGGTGCTGACCTGCGA<br>CACCCCCGAGGAGGACGGCATCACCTGGACCCTGGACCAGAGCAGCGAGGTGCTGGGCAGC<br>GGCAAGACCCTGACCATCCAGGTGAAGGAGTTCGGCGACGCCGGCCAGTACACCTGCCACA<br>AGGGCGGCGAGGTGCTGAGCCACAGCCTGCTGCTGCTGCACAAGAAGGAGGACGGCATCTG<br>GAGCACCGACATCCTGAAGGACCAGAAGGAGCCCAAGAACAAGACCTTCCTGAGATGCGAG<br>GCCAAGAACTACAGCGGCAGATTCACCTGCTGGTGGCTGACCACCATCAGCACCGACCTGA<br>CCTTCAGCGTGAAGAGCAGCAGAGGCAGCAGCGACCCCCAGGGCGTGACCTGCGGCGCCGC<br>CACCCTGAGCGCCGAGAGAGTGAGAGGCGACAACAAGGAGTACGAGTACAGCGTGGAGTGC<br>CAGGAAGATAGCGCCTGCCCCGCCGCCGAGGAGAGCCTGCCCATCGAGGTGATGGTGGACG<br>CCGTGCACAAGCTGAAGTACGAGAACTACACCAGCAGCTTCTTCATCAGAGATATCATCAA<br>GCCCGACCCCCCCAAGAACCTGCAGCTGAAGCCCCTGAAGAACAGCCGGCAGGTGGAGGTG<br>AGCTGGGAGTACCCCGACACCTGGAGCACCCCCCACAGCTACTTCAGCCTGACCTTCTGCG<br>TGCAGGTGCAGGGCAAGAGCAAGAGAGAGAAGAAAGATAGAGTGTTCACCGACAAGACCAG<br>CGCCACCGTGATCTGCAGAAAGAACGCCAGCATCAGCGTGAGAGCCCAAGATAGATACTAC<br>AGCAGCAGCTGGAGCGAGTGGGCCAGCGTGCCCTGCAGCGGCGGCGGCGGCGGCGGCAGCA<br>GAAACCTGCCCGTGGCCACCCCCGACCCCGGCATGTTCCCCTGCCTGCACCACAGCCAGAA<br>CCTGCTGAGAGCCGTGAGCAACATGCTGCAGAAGGCCCGGCAGACCCTGGAGTTCTACCCC<br>TGCACCAGCGAGGAGATCGACCACGAAGATATCACCAAAGATAAGACCAGCACCGTGGAGG<br>CCTGCCTGCCCCTGGAGCTGACCAAGAACGAGAGCTGCCTGAACAGCAGAGAGACCAGCTT<br>CATCACCAACGGCAGCTGCCTGGCCAGCAGAAAGACCAGCTTCATGATGGCCCTGTGCCTG<br>AGCAGCATCTACGAGGACCTGAAGATGTACCAGGTGGAGTTCAAGACCATGAACGCCAAGC<br>TGCTGATGGACCCCAAGCGGCAGATCTTCCTGGACCAGAACATGCTGGCCGTGATCGACGA<br>GCTGATGCAGGCCCTGAACTTCAACAGCGAGACCGTGCCCCAGAAGAGCAGCCTGGAGGAG<br>CCCGACTTCTACAAGACCAAGATCAAGCTGTGCATCCTGCTGCACGCCTTCAGAATCAGAG<br>CCGTGACCATCGACAGAGTGATGAGCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1083 | hIL12AB_003 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAGCAGTTGGTCATCTCTTGG<br>TTTTCCCTGGTTTTTCTGGCATCTCCCCTCGTGGCCATCTGGGAACTGAAGAAAGACGTTT<br>ACGTTGTAGAATTGGATTGGTATCCGGACGCTCCTGGAGAAATGGTGGTCCTCACCTGTGA<br>CACCCCTGAAGAAGACGGAATCACCTGGACCTTGGACCAGAGCAGTGAGGTCTTAGGCTCT<br>GGCAAAACCCTGACCATCCAAGTCAAAGAGTTTGGAGATGCTGGCCAGTACACCTGTCACA<br>AAGGAGGCGAGGTTCTAAGCCATTCGCTCCTGCTGCTTCACAAAAAGGAAGATGGAATTTG<br>GTCCACTGATATTTTAAAGGACCAGAAAGAACCCAAAAATAAGACCTTTCTAAGATGCGAG<br>GCCAAGAATTATTCTGGACGTTTCACCTGCTGGTGGCTGACGACAATCAGTACTGATTTGA<br>CATTCAGTGTCAAAAGCAGCAGAGGCTCTTCTGACCCCCAAGGGGTGACGTGCGGAGCTGC<br>TACACTCTCTGCAGAGAGAGTCAGAGGTGACAACAAGGAGTATGAGTACTCAGTGGAGTGC<br>CAGGAAGATAGTGCCTGCCCAGCTGCTGAGGAGAGTCTGCCCATTGAGGTCATGGTGGATG<br>CCGTTCACAAGCTCAAGTATGAAAACTACACCAGCAGCTTCTTCATCAGAGATATCATCAA<br>ACCTGACCCACCCAAGAACTTGCAGCTGAAGCCATTAAAGAATTCTCGGCAGGTGGAGGTC<br>AGCTGGGAGTACCCTGACACCTGGAGTACTCCACATTCCTACTTCTCCCTGACATTCTGCG<br>TTCAGGTCCAGGGCAAGAGCAAGAGAGAAAAGAAAGATAGAGTCTTCACAGATAAGACCTC<br>AGCCACGGTCATCTGCCGCAAAAATGCCAGCATTAGCGTGCGGGCCCAGGACCGCTACTAT<br>AGCTCATCTTGGAGCGAATGGGCATCTGTGCCCTGCAGTGGCGGAGGGGGCGGAGGGAGCA<br>GAAACCTCCCCGTGGCCACTCCAGACCCAGGAATGTTCCCATGCCTTCACCACTCCCAAAA<br>CCTGCTGAGGGCCGTCAGCAACATGCTCCAGAAGGCCCGGCAAACTTTAGAATTTTACCCT<br>TGCACTTCTGAAGAGATTGATCATGAAGATATCACAAAAGATAAAACCAGCACAGTGGAGG<br>CCTGTTTACCATTGGAATTAACCAAGAATGAGAGTTGCCTAAATTCCAGAGAGACCTCTTT<br>CATAACTAATGGGAGTTGCCTGGCCTCCAGAAAGACCTCTTTTATGATGGCCCTGTGCCTT<br>AGTAGTATTTATGAAGATTTGAAGATGTACCAGGTGGAGTTCAAGACCATGAATGCAAAGC<br>TTCTGATGGATCCTAAGAGGCAGATCTTTTTAGATCAAAACATGCTGGCAGTTATTGATGA<br>GCTGATGCAGGCCCTGAATTTCAACAGTGAGACGGTGCCACAAAAATCCTCCCTTGAAGAA<br>CCAGATTTCTACAAGACCAAGATCAAGCTCTGCATACTTCTTCATGCTTTCAGAATTCGGG<br>CAGTGACTATTGATAGAGTGATGAGCTATCTGAATGCTTCCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1084 | hIL12AB_005 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTCATCAGCTGG<br>TTCTCCCTGGTCTTCCTGGCCAGCCCCCTGGTGGCCATCTGGGAGCTGAAGAAAGACGTCT<br>ACGTAGTAGAGTTGGATTGGTACCCAGACGCACCTGGAGAAATGGTGGTTCTCACCTGTGA<br>CACGCCAGAAGAAGACGGTATCACCTGGACGCTGGACCAGAGCTCAGAAGTTCTTGGCAGT<br>GGAAAAACGCTGACCATACAAGTAAAAGAATTTGGGGATGCTGGCCAGTACACCTGCCACA<br>AAGGAGGAGAAGTTCTCAGCCACAGCCTGCTGCTGCTGCACAAGAAAGAAGATGGCATCTG<br>GAGCACAGATATTTTAAAAGACCAGAAGGAGCCCAAGAACAAAACCTTCCTTCGATGTGAG<br>GCCAAGAACTACAGTGGCCGCTTCACCTGCTGGTGGCTCACCACCATCAGCACAGACCTCA<br>CCTTCTCGGTGAAGAGCAGCCGTGGCAGCTCAGACCCCCAAGGAGTCACCTGTGGGGCGGC |

TABLE 15-continued

Sequence Optimized IL12 Polynucleotides Comprising 5' UTR, ORF, and 3' UTR

| SEQ ID NO | Description | Sequence |
|---|---|---|
| | | CACGCTGTCGGCAGAAAGAGTTCGAGGTGACAACAAGGAATATGAATACTCGGTGGAATGT |
| | | CAAGAAGATTCGGCCTGCCCGGCGGCAGAAGAAAGTCTTCCCATAGAAGTCATGGTGGATG |
| | | CTGTTCACAAATTAAAATATGAAAACTACACCAGCAGCTTCTTCATCAGAGATATCATCAA |
| | | GCCAGACCCGCCCAAGAACCTGCAGCTGAAGCCCCTGAAGAACAGCCGGCAGGTGGAAGTT |
| | | TCCTGGGAGTACCCAGATACGTGGAGCACGCCGCACAGCTACTTCAGCCTCACCTTCTGTG |
| | | TACAAGTACAAGGCAAGAGCAAGAGAGAGAAGAAAGATCGTGTCTTCACAGATAAAACCTC |
| | | GGCGACGGTCATCTGCAGGAAGAATGCCTCCATCTCGGTTCGAGCCCAGGACCGCTACTAC |
| | | AGCAGCAGCTGGAGTGAGTGGGCCTCGGTGCCCTGCAGTGGTGGCGGCGGCGGCGGCAGCA |
| | | GAAACCTTCCTGTGGCCACGCCGGACCCTGGCATGTTCCCGTGCCTGCACCACAGCCAAAA |
| | | TTTACTTCGAGCTGTTTCTAACATGCTGCAGAAAGCACGGCAAACTTTAGAATTCTACCCC |
| | | TGCACCTCAGAAGAAATAGACCATGAAGATATCACCAAAGATAAAACCAGCACTGTAGAGG |
| | | CCTGCCTGCCCCTGGAGCTCACCAAGAATGAATCCTGCCTCAACAGCAGAGAGACCAGCTT |
| | | CATCACCAATGGCAGCTGCCTGGCCAGCAGGAAAACCAGCTTCATGATGGCGCTCTGCCTG |
| | | AGCAGCATCTATGAAGATTTGAAGATGTACCAAGTAGAATTTAAAACCATGAATGCCAAGC |
| | | TGCTCATGGACCCCAAGCGGCAGATATTTTTGGATCAAAACATGCTGGCTGTCATTGATGA |
| | | GCTCATGCAAGCATTAAACTTCAACTCAGAGACGGTGCCCCAGAAGAGCAGCCTGGAGGAG |
| | | CCAGATTTCTACAAAACCAAGATCAAGCTCTGCATCTTATTACATGCCTTCCGCATCCGGG |
| | | CGGTCACCATTGACCGTGTCATGTCCTACTTAAATGCCAGCTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1085 | hIL12AB_006 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAGCAGCTGGTGATCAGCTGG |
| | | TTCAGCCTGGTGTTCCTGGCCAGCCCCCTGGTGGCCATCTGGGAGCTGAAGAAGGACGTGT |
| | | ACGTGGTGGAGTTGGATTGGTACCCCGACGCCCCCGGCGAGATGGTGGTGCTGACCTGTGA |
| | | CACCCCCGAGGAGGACGGCATCACCTGGACCCTGGACCAGAGCAGCGAGGTGCTGGGCAGC |
| | | GGCAAGACCCTGACCATCCAGGTGAAGGAGTTCGGGGACGCCGGCCAGTACACCTGCCACA |
| | | AGGGCGGCGAGGTGCTGAGCCACAGCCTGCTGCTGCTGCACAAGAAGGAGGACGGCATCTG |
| | | GAGCACAGATATCCTGAAGGACCAGAAGGAGCCCAAGAACAAGACCTTCCTGAGATGCGAG |
| | | GCCAAGAACTACAGCGGCAGATTCACCTGCTGGTGGCTGACCACCATCAGCACAGATTTGA |
| | | CCTTCAGCGTGAAGAGCAGCAGAGGCAGCAGCGACCCCCAGGGCGTGACCTGCGGCGCCGC |
| | | CACCCTGAGCGCCGAGAGAGTGAGAGGTGACAACAAGGAGTACGAGTACAGCGTGGAGTGC |
| | | CAGGAAGATAGCGCCTGCCCCGCCGCCGAGGAGAGCCTGCCCATCGAGGTGATGGTGGACG |
| | | CCGTGCACAAGCTGAAGTACGAGAACTACACCAGCAGCTTCTTCATCAGAGATATCATCAA |
| | | GCCCGACCCGCCGAAGAACCTGCAGCTGAAGCCCCTGAAGAACAGCCGGCAGGTGGAGGTG |
| | | AGCTGGGAGTACCCCGACACCTGGAGCACCCCCCACAGCTACTTCAGCCTGACCTTCTGCG |
| | | TGCAGGTGCAGGGCAAGAGCAAGAGAGAGAAGAAAGATAGAGTGTTCACAGATAAGACCAG |
| | | CGCCACCGTGATCTGCAGAAAGAACGCCAGCATCAGCGTGAGAGCCCAAGATAGATACTAC |
| | | AGCAGCAGCTGGAGCGAGTGGGCCAGCGTGCCCTGCAGCGGCGGCGGCGGCGGCGGCAGCA |
| | | GAAACCTGCCCGTGGCCACCCCCGACCCCGGCATGTTCCCCTGCCTGCACCACAGCCAGAA |
| | | CCTGCTGAGAGCCGTGAGCAACATGCTGCAGAAGGCCCGGCAGACCCTGGAGTTCTACCCC |
| | | TGCACCAGCGAGGAGATCGACCACGAAGATATCACCAAAGATAAGACCAGCACCGTGGAGG |
| | | CCTGCCTGCCCCTGGAGCTGACCAAGAATGAAAGCTGCCTGAACAGCAGAGAGACCAGCTT |
| | | CATCACCAACGGCAGCTGCCTGGCCAGCAGAAAGACCAGCTTCATGATGGCCCTGTGCCTG |
| | | AGCAGCATCTACGAGGACCTGAAGATGTACCAGGTGGAGTTCAAGACCATGAACGCCAAGC |
| | | TGCTGATGGACCCCAAGCGGCAGATCTTCCTGGACCAGAACATGCTGGCCGTGATCGACGA |
| | | GCTGATGCAGGCCCTGAACTTCAACAGCGAGACCGTGCCCCAGAAGAGCAGCCTGGAGGAG |
| | | CCCGACTTCTACAAGACCAAGATCAAGCTGTGCATCCTGCTGCACGCCTTCAGAATCAGAG |
| | | CCGTGACCATCGACAGAGTGATGAGCTACCTGAACGCCAGCTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1086 | hIL12AB_007 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAGCAGCTTGTCATCTCCTGG |
| | | TTCTCTCTTGTCTTCCTTGCTTCTCCTCTTGTGGCCATCTGGGAGCTGAAGAAGGACGTTT |
| | | ACGTAGTGGAGTTGGATTGGTACCCTGACGCACCTGGAGAAATGGTGGTTCTCACCTGTGA |
| | | CACTCCTGAGGAGGACGGTATCACCTGGACGTTGGACCAGTCTTCTGAGGTTCTTGGCAGT |
| | | GGAAAAACTCTTACTATTCAGGTGAAGGAGTTTGGAGATGCTGGCCAGTACACCTGCCACA |
| | | AGGGTGGTGAAGTTCTCAGCCACAGTTTACTTCTTCTTCACAAGAAGGAGGATGGCATCTG |
| | | GTCTACTGACATTTTAAAAGACCAGAAGGAGCCCAAGAACAAAACATTCCTTCGTTGTGAA |
| | | GCCAAGAACTACAGTGGTCGTTTCACCTGCTGGTGGCTTACTACTATTTCTACTGACCTTA |
| | | CTTTCTCTGTGAAGTCTTCTCGTGGCTCTTCTGACCCTCAGGGTGTCACCTGTGGGGCTGC |
| | | TACTCTTTCTGCTGAGCGTGTGCGTGGTGACAACAAGGAGTATGAATACTCGGTGGAGTGC |
| | | CAGGAAGATTCTGCCTGCCCTGCTGCTGAGGAGTCTCTTCCTATTGAGGTGATGGTGGATG |
| | | CTGTGCACAAGTTAAAATATGAAAACTACACTTCTTCTTTCTTCATTCGTGACATTATAAA |
| | | ACCTGACCCTCCCAAGAACCTTCAGTTAAAACCTTTAAAAAACTCTCGTCAGGTGGAGGTG |
| | | TCCTGGGAGTACCCTGACACGTGGTCTACTCCTCACTCCTACTTCTCTCTTACTTTCTGTG |
| | | TCCAGGTGCAGGGCAAGTCCAAGCGTGAGAAGAAGGACCGTGTCTTCACTGACAAAACATC |
| | | TGCTACTGTCATCTGCAGGAAGAATGCATCCATCTCTGTGCGTGCTCAGGACCGTTACTAC |
| | | AGCTCTTCCTGGTCTGAGTGGGCTTCTGTGCCCTGCTCTGGCGGCGGCGGCGGCGGCAGCA |
| | | GAAATCTTCCTGTGGCTACTCCTGACCCTGGCATGTTCCCCTGCCTTCACCACTCGCAGAA |
| | | CCTTCTTCGTGCTGTGAGCAACATGCTTCAGAAGGCTCGTCAAACTTTAGAATTCTACCCC |
| | | TGCACTTCTGAGGAGATTGACCATGAAGATATCACCAAAGATAAAACATCTACTGTGGAGG |
| | | CCTGCCTTCCTTTAGAGCTGACCAAGAATGAATCCTGCTTAAATTCTCGTGAGACGTCTTT |
| | | CATCACCAATGGCAGCTGCCTTGCCTCGCGCAAAACATCTTTCATGATGGCTCTTTGCCTT |
| | | TCTTCCATCTATGAAGATTTAAAAATGTACCAGGTGGAGTTCAAGACCATGAATGCAAAGC |

TABLE 15-continued

| SEQ ID NO | Description | Sequence |
|---|---|---|
| | | TTCTCATGGACCCCAAGCGTCAGATATTTTTGGACCAGAACATGCTTGCTGTCATTGATGAGCTCATGCAGGCTTTAAACTTCAACTCTGAGACGGTGCCTCAGAAGTCTTCTTTAGAAGAGCCTGACTTCTACAAGACCAAGATAAAACTTTGCATTCTTCTTCATGCTTTCCGCATCCGTGCTGTGACTATTGACCGTGTGATGTCCTACTTAAATGCTTCTTGATAATAGGCTGGAGCCTCGGTGGCCAAGCTTCTTGCCCCTTGGGCCTCCCCCCAGCCCCTCCTCCCCTTCCTGCACCCGTACCCCCCAAACACCATTGTCACACTCCAGTGGTCTTTGAATAAAGTCTGAGTGGGCGGC |
| 1087 | hIL12AB_008 | TCAAGCTTTTGGACCCTCGTACAGAAGCTAATACGACTCACTATAGGGAAATAAGAGAGAAAAGAAGAGTAAGAAGAAATATAAGAGCCACCATGTGTCATCAACAACTCGTGATTAGCTGGTTCAGTCTCGTGTTCCTGGCCTCTCCGCTGGTGGCCATCTGGGAGCTTAAGAAGGACGTGTACGTGGTGGAGCTCGATTGGTACCCCGACGCACCTGGCGAGATGGTGGTGCTAACCTGCGATACCCCCGAGGAGGACGGGATCACTTGGACCCTGGATCAGAGTAGCGAAGTCCTGGGCTCTGGCAAAACACTCACAATCCAGGTGAAGGAATTCGGAGACGCTGGTCAGTACACTTGCCACAAGGGGGGTGAAGTGCTGTCTCACAGCCTGCTGTTACTGCACAAGAAGGAGGATGGGATCTGGTCAACCGACATCCTGAAGGATCAGAAGGAGCCTAAGAACAAGACCTTTCTGAGGTGTGAAGCTAAGAACTATTCCGGAAGATTCACTTGCTGGTGGTTGACCACAATCAGCACTGACCTGACCTTTTCCGTGAAGTCCAGCAGAGGAAGCAGCGATCCTCAGGGCGTAACGTGCGGCGCGGCTACCCTGTCAGCTGAGCGGGTTAGAGGCGACAACAAAGAGTATGAGTACTCCGTGGAGTGTCAGGAAGATAGCGCCTGCCCCGCAGCCGAGGAGAGTCTGCCCATCGAGGTGATGGTGGACGCTGTCCATAAGTTAAAATACGAAAATTACACAAGTTCCTTTTTCATCCGCGATATTATCAAACCCGATCCCCCCAAGAACCTGCAGCTGAAGCCCCTGAAGAATAGCCGACAGGTGGAAGTCTCTTGGGAGTATCCTGACACCTGGTCCACGCCTCACAGCTACTTTAGTCTGACTTTCTGTGTCCAGGTCCAGGGCAAGAGCAAGAGAGAGAAAAAGGATAGAGTGTTTACTGACAAAACATCTGCTACAGTCATCTGCAGAAAGAACGCCAGTATCTCAGTGAGGGCGCAAGATAGATACTACAGTAGTAGCTGGAGCGAATGGGCTAGCGTGCCCTGTTCAGGGGGCGGCGGAGGGGGCTCCAGGAATCTGCCCGTGGCCACCCCCGACCCTGGGATGTTCCCTTGCCTCCATCACTCACAGAACCTGCTCAGAGCAGTGAGCAACATGCTCCAAAAGGCCCGCCAGACCCTGGAGTTTTACCCTTGTACTTCAGAAGAGATCGATCACGAAGATATAACAAAGGATAAAACCAGCACCGTGGAGGCCTGTCTGCCTCTGGAACTCACAAAGAATGAAAGCTGTCTGAATTCCAGGGAAACCTCCTTCATTACTAACGGAAGCTGTCTCGCATCTCGCAAAACATCATTCATGATGGCCCTCTGCCTGTCTTCTATCTATGAAGATCTCAAGATGTATCAGGTGGAGTTCAAAACAATGAACGCCAAGCTGCTGATGGACCCCAAGCGGCAGATCTTCCTGGACCAGAACATGCTGGCAGTGATCGATGAGCTGATGCAAGCCTTGAACTTCAACTCAGAGACGGTGCCGCAAAAGTCCTCGTTGGAGGAACCAGATTTTTACAAAACCAAAATCAAGCTGTGTATCCTTCTTCACGCCTTTCGGATCAGAGCCGTGACTATCGACCGGGTGATGTCATACCTGAATGCTTCCTGATAATAGGCTGGAGCCTCGGTGGCCATGCTTCTTGCCCCTTGGGCCTCCCCCCAGCCCCTCCTCCCCTTCCTGCACCCGTACCCCCCAAACACCATTGTCACACTCCAGTGGTCTTTGAATAAAGTCTGAGTGGGCGGC |
| 1088 | hIL12AB_009 | TCAAGCTTTTGGACCCTCGTACAGAAGCTAATACGACTCACTATAGGGAAATAAGAGAGAAAAGAAGAGTAAGAAGAAATATAAGAGCCACCATGTGCCACCAGCAGCTGGTCATCAGCTGGTTTAGCCTGGTCTTCCTGGCCAGCCCCCTGGTGGCCATCTGGGAGCTGAAGAAAGACGTCTACGTAGTAGAGTTGGATTGGTACCCAGACGCACCTGGAGAAATGGTGGTTCTCACCTGCGACACGCCAGAAGAAGACGGTATCACCTGGACGCTGGACCAGAGCAGCGAAGTACTGGGCAGTGGAAAAACGCTGACCATACAAGTAAAAGAATTTGGCGATGCTGGCCAGTACACCTGCCACAAAGGAGGAGAAGTACTGAGCCACAGCCTGCTGCTGCTGCACAAGAAAGAAGATGGCATCTGGAGCACCGACATTTTAAAAGACCAGAAGGAGCCCAAGAACAAAACCTTCCTTCGATGTGAGGCGAAGAACTACAGTGGCCGCTTCACCTGCTGGTGGCTCACCACCATCAGCACCGACCTCACCTTCTCGGTGAAGAGCAGCCGTGGTAGCTCAGACCCCCAAGGAGTCACCTGTGGGGCGGCCACGCTGTCGGCAGAAAGAGTTCGAGGCGACAACAAGGAATATGAATACTCGGTGGAATGTCAAGAAGATTCGGCCTGCCCGGCGGCAGAAGAAAGTCTGCCCATAGAAGTCATGGTGGATGCTGTTCACAAATTAAAATATGAAAACTACACCAGCAGCTTCTTCATCAGAGATATCATCAAGCCAGACCCCCCCAAGAACCTGCAGCTGAAGCCCCTGAAGAACAGCCGGCAGGTGGAAGTTTCCTGGGAGTACCCAGATACGTGGAGCACGCCGCACAGCTACTTCAGCCTCACCTTCTGTGTACAAGTACAAGGCAAGAGCAAGAGAGAGAAGAAAGATCGTGTCTTCACCGACAAAACCTCGGCGACGGTCATCTGCAGGAAGAATGCAAGCATCTCGGTTCGAGCCCAGGACCGCTACTACAGCAGCAGCTGGAGTGAGTGGGCCTCGGTGCCCTGCAGTGGTGGCGGCGGCGGCGGCAGCAGAAACCTTCCTGTGGCCACGCCGGACCCTGGCATGTTTCCGTGCCTGCACCACAGCCAAAATTTATTACGAGCTGTTAGCAACATGCTGCAGAAAGCACGGCAAACTTTAGAATTCTACCCCTGCACCTCAGAAGAAATAGACCATGAAGATATCACCAAAGATAAAACCAGCACTGTAGAGGCCTGCCTGCCCCTGGAGCTCACCAAGAACGAGAGCTGCCTCAATAGCAGAGAGACCAGCTTCATCACCAATGGCAGCTGCCTGGCCAGCAGGAAAACCAGCTTCATGATGGCGCTCTGCCTGAGCAGCATCTATGAAGATCTGAAGATGTACCAAGTAGAATTTAAAACCATGAATGCCAAGCTGCTCATGGACCCCAAGCGGCAGATATTCCTCGACCAAAACATGCTGGCTGTCATTGATGAGCTCATGCAAGCATTAAACTTCAACTCAGAGACGGTGCCCCAGAAGAGCAGCCTGGAGGAGCCAGATTTCTACAAAACCAAGATCAAGCTCTGCATCTTATTACATGCCTTCCGCATCCGGGCGGTCACCATTGACCGTGTCATGTCCTACTTAAATGCCAGCTGATAATAGGCTGGAGCCTCGGTGGCCATGCTTCTTGCCCCTTGGGCCTCCCCCCAGCCCCTCCTCCCCTTCCTGCACCCGTACCCCCCAAACACCATTGTCACACTCCAGTGGTCTTTGAATAAAGTCTGAGTGGGCGGC |
| 1089 | hIL12AB_010 | TCAAGCTTTTGGACCCTCGTACAGAAGCTAATACGACTCACTATAGGGAAATAAGAGAGAAAAGAAGAGTAAGAAGAAATATAAGAGCCACCATGTGCCACCAGCAGCTTGTCATCTCCTGGTTTTCTCTTGTCTTCCTCGCTTCTCCTCTTGTGGCCATCTGGGAGCTGAAGAAAGACGTCTACGTAGTAGAGTTGGATTGGTACCCGGACGCTCCTGGAGAAATGGTGGTTCTCACCTGCGACACTCCTGAAGAAGACGGTATCACCTGGACGCTGGACCAAAGCAGCGAAGTTTTAGGCTCTGGAAAAACGCTGACCATACAAGTAAAAGAATTTGGCGACGCTGGCCAGTACACGTGCCACAAAGGAGGAGAAGTTTTAAGCCACAGTTTACTTCTTCTTCACAAGAAAGAAGATGGCATCTG |

TABLE 15-continued

Sequence Optimized IL12 Polynucleotides Comprising 5' UTR, ORF, and 3' UTR

| SEQ ID NO | Description | Sequence |
|---|---|---|
| | | GAGTACAGATATTTTAAAAGACCAGAAGGAGCCTAAGAACAAAACCTTCCTCCGCTGTGAA GCTAAGAACTACAGTGGTCGTTTCACCTGCTGGTGGCTCACCACCATCTCCACTGACCTCA CCTTCTCTGTAAAATCAAGCCGTGGTTCTTCTGACCCCCAAGGAGTCACCTGTGGGGCTGC CACGCTCAGCGCTGAAAGAGTTCGAGGCGACAACAAGGAATATGAATATTCTGTGGAATGT CAAGAAGATTCTGCCTGCCCGGCGGCAGAAGAAAGTCTTCCCATAGAAGTCATGGTGGACG CTGTTCACAAATTAAAATATGAAAACTACACCAGCAGCTTCTTCATTCGTGACATCATCAA ACCAGACCCTCCTAAGAACCTTCAGTTAAAACCGCTGAAGAACAGCCGGCAGGTGGAAGTT TCCTGGGAGTACCCAGATACGTGGAGTACGCCGCACTCCTACTTCAGTTTAACCTTCTGTG TACAAGTACAAGGAAAATCAAAAAGAGAGAAGAAAGATCGTGTCTTCACTGACAAAACATC TGCCACGGTCATCTGCCGTAAGAACGCTTCCATCTCGGTTCGAGCCCAGGACCGCTACTAC AGCAGCAGCTGGAGTGAGTGGGCATCTGTTCCCTGCAGTGGTGGCGGCGGCGGCGGCAGCC GCAACCTTCCTGTGGCCACGCCGGACCCTGGCATGTTCCCGTGCCTTCACCACTCGCAAAA TCTTCTTCGTGCTGTTTCTAACATGCTGCAGAAGGCGCGGCAAACTTTAGAATTCTACCCG TGCACTTCTGAAGAAATAGACCATGAAGATATCACCAAAGATAAAACCAGCACGGTGGAGG CCTGCCTTCCTTTAGAACTTACTAAGAACGAAAGTTGCCTTAACAGCCGTGAGACCAGCTT CATCACCAATGGCAGCTGCCTTGCTAGCAGGAAGACCAGCTTCATGATGGCGCTGTGCCTT TCTTCCATCTATGAAGATCTTAAGATGTACCAAGTAGAATTTAAAACCATGAATGCCAAAT TATTAATGGACCCCAAGCGGCAGATATTCCTCGACCAAAACATGCTGGCTGTCATTGATGA GCTCATGCAAGCATTAAACTTCAACTCAGAAACTGTTCCCCAGAAGTCATCTTTAGAAGAA CCAGATTTCTACAAAACAAAAATAAAACTCTGCATTCTTCTTCATGCCTTCCGCATCCGTG CTGTCACCATTGACCGTGTCATGTCCTACTTAAATGCTTCTTGATAATAGGCTGGAGCCTC GGTGGCCATGCTTCTTGCCCCTTGGGCCTCCCCCCAGCCCCTCCTCCCCTTCCTGCACCCG TACCCCCCAAACACCATTGTCACACTCCAGTGGTCTTTGAATAAAGTCTGAGTGGGCGGC |
| 1090 | hIL12AB_011 | TCAAGCTTTTGGACCCTCGTACAGAAGCTAATACGACTCACTATAGGGAAATAAGAGAGAA AAGAAGAGTAAGAAGAAATATAAGAGCCACCATGTGCCACCAGCAGCTGGTGATCAGCTGG TTCAGCCTGGTGTTCCTGGCCAGCCCCCTGGTGGCCATCTGGGAGCTGAAGAAGGACGTGT ACGTGGTGGAGTTGGATTGGTACCCGGACGCGCCGGGGGAGATGGTGGTGCTGACGTGCGA CACGCCGGAGGAGGACGGGATCACGTGGACGCTGGACCAGAGCAGCGAGGTGCTGGGGAGC GGGAAGACGCTGACGATCCAGGTGAAGGAGTTCGGGGACGCGGGGCAGTACACGTGCCACA AGGGGGGGGAGGTGCTGAGCCACAGCCTGCTGCTGCTGCACAAGAAGGAGGACGGGATCTG GAGCACAGATATCCTGAAGGACCAGAAGGAGCCGAAGAACAAGACGTTCCTGAGGTGCGAG GCGAAGAACTACAGCGGGAGGTTCACGTGCTGGTGGCTGACGACGATCAGCACGGACCTGA CGTTCAGCGTGAAGAGCAGCAGGGGGAGCAGCGACCCGCAGGGGGTGACGTGCGGGGCGGC GACGCTGAGCGCGGAGAGGGTGAGGGGTGACAACAAGGAGTACGAGTACAGCGTGGAGTGC CAGGAAGATAGCGCGTGCCCGGCGGCGGAGGAGAGCCTGCCGATCGAGGTGATGGTGGACG CGGTGCACAAGCTGAAGTACGAGAACTACACGAGCAGCTTCTTCATCAGAGATATCATCAA GCCGGACCCGCCGAAGAACCTGCAGCTGAAGCCGCTGAAGAACAGCAGGCAGGTGGAGGTG AGCTGGGAGTACCCAGATACGTGGAGCACGCCGCACAGCTACTTCAGCCTGACGTTCTGCG TGCAGGTGCAGGGGAAGAGCAAGAGGGAGAAGAAAGATAGGGTGTTCACAGATAAGACGAG CGCGACGGTGATCTGCAGGAAGAACGCGAGCATCAGCGTGAGGGCGCAAGATAGGTACTAC AGCAGCAGCTGGAGCGAGTGGGCGAGCGTGCCGTGCAGCGGGGGGGGGGGGGGGGGGAGCA GGAACCTGCCGGTGGCGACGCCGGACCCGGGGATGTTCCCGTGCCTGCACCACAGCCAGAA CCTGCTGAGGGCGGTGAGCAACATGCTGCAGAAGGCGAGGCAGACGCTGGAGTTCTACCCG TGCACGAGCGAGGAGATCGACCACGAAGATATCACGAAAGATAAGACGAGCACGGTGGAGG CGTGCCTGCCGCTGGAGCTGACGAAGAACGAGAGCTGCCTGAACAGCAGGGAGACGAGCTT CATCACGAACGGGAGCTGCCTGGCGAGCAGGAAGACGAGCTTCATGATGGCGCTGTGCCTG AGCAGCATCTACGAGGACCTGAAGATGTACCAGGTGGAGTTCAAGACGATGAACGCGAAGC TGCTGATGGACCCGAAGAGGCAGATCTTCCTGGACCAGAACATGCTGGCGGTGATCGACGA GCTGATGCAGGCGCTGAACTTCAACAGCGAGACGGTGCCGCAGAAGAGCAGCCTGGAGGAG CCAGATTTCTACAAGACGAAGATCAAGCTGTGCATCCTGCTGCACGCGTTCAGGATCAGGG CGGTGACGATCGACAGGGTGATGAGCTACCTGAACGCGAGCTGATAATAGGCTGGAGCCTC GGTGGCCATGCTTCTTGCCCCTTGGGCCTCCCCCCAGCCCCTCCTCCCCTTCCTGCACCCG TACCCCCCAAACACCATTGTCACACTCCAGTGGTCTTTGAATAAAGTCTGAGTGGGCGGC |
| 1091 | hIL12AB_012 | TCAAGCTTTTGGACCCTCGTACAGAAGCTAATACGACTCACTATAGGGAAATAAGAGAGAA AAGAAGAGTAAGAAGAAATATAAGAGCCACCATGTGCCATCAGCAGCTGGTGATCAGCTGG TTCAGCCTCGTGTTTCTGGCCAGCCCCCTGGTGGCCATTTGGGAACTCAAGAAGGACGTGT ACGTTGTGGAACTCGACTGGTACCCTGACGCCCCAGGCGAAATGGTGGTCTTAACCTGCGA CACCCCTGAGGAGGACGGAATCACCTGGACCTTGGACCAGAGCTCCGAGGTCCTCGGCAGT GGCAAGACCCTGACCATACAGGTGAAAGAATTTGGAGACGCAGGGCAATACACATGTCACA AGGGCGGGGAGGTTCTTTCTCACTCCCTTCTGCTTCTACATAAAAAGGAAGACGGAATTTG GTCTACCGACATCCTCAAGGACCAAAAGGAGCCTAAGAATAAAACCTTCTTACGCTGTGAA GCTAAAAACTACAGCGGCAGATTCACTTGCTGGTGGCTCACCACCATTTCTACCGACCTGA CCTTCTCGGTGAAGTCTTCAAGGGGCTCTAGTGATCCACAGGGAGTGACATGCGGGGCCGC CACACTGAGCGCTGAACGGGTGAGGGGCGATAACAAGGAGTATGAATACTCTGTCGAGTGT CAGGAGGATTCAGCTTGTCCCGCAGCTGAAGAGTCACTCCCCATAGAGGTTATGGTCGATG CTGTGCATAAACTGAAGTACGAAAACTACACCAGCAGCTTCTTCATTAGAGATATTATAAA ACCTGACCCCCCCAAGAACCTGCAACTTAAACCCCTGAAAAACTCTCGGCAGGTCGAAGTT AGCTGGGAGTACCCTGATACTTGGTCCACCCCCCACTCGTACTTCTCACTGACTTTCTGTG TGCAGGTGCAGGGCAAGAGCAAGAGAGAGAAAAAAGATCGTGTATTCACAGATAAGACCTC TGCCACCGTGATCTGCAGAAAAAACGCTTCCATCAGTGTCAGAGCCCAAGACCGGTACTAT AGTAGTAGCTGGAGCGAGTGGGCAAGTGTCCCCTGCTCTGGCGGCGGAGGGGGCGGCTCTC GAAACCTCCCCGTCGCTACCCCTGATCCAGGAATGTTCCCTTGCCTGCATCACTCACAGAA TCTGCTGAGAGCGGTCAGCAACATGCTGCAGAAAGCTAGGCAAACACTGGAGTTTTATCCT TGTACCTCAGAGGAGATCGACCACGAGGATATTACCAAAGATAAGACCAGCACGGTGGAGG |

TABLE 15-continued

| SEQ ID NO | Description | Sequence |
|---|---|---|
| Sequence Optimized IL12 Polynucleotides Comprising 5' UTR, ORF, and 3' UTR | | |
| | | CCTGCTTGCCCCTGGAACTGACAAAGAATGAATCCTGCCTTAATAGCCGTGAGACCTCTTT<br>TATAACAAACGGATCCTGCCTGGCCAGCAGGAAGACCTCCTTCATGATGGCCCTCTGCCTG<br>TCCTCAATCTACGAAGACCTGAAGATGTACCAGGTGGAATTTAAAACTATGAACGCCAAGC<br>TGTTGATGGACCCCAAGCGGCAGATCTTTCTGGATCAAAATATGCTGGCTGTGATCGACGA<br>ACTGATGCAGGCCCTCAACTTTAACAGCGAGACCGTGCCACAAAAGAGCAGTCTTGAGGAG<br>CCCGACTTCTACAAGACCAAGATCAAGCTGTGCATCCTCCTTCATGCCTTCAGGATAAGAG<br>CTGTCACCATCGACAGAGTCATGAGTTACCTGAATGCATCCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1092 | hIL12AB_013 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTCATCTCCTGG<br>TTCAGTCTTGTCTTCCTGGCCTCGCCGCTGGTGGCCATCTGGGAGCTGAAGAAAGACGTTT<br>ACGTAGTAGAGTTGGATTGGTACCCAGACGCACCTGGAGAAATGGTGGTCCTCACCTGTGA<br>CACGCCAGAAGAAGACGGTATCACCTGGACGCTGGACCAGAGCAGTGAAGTTCTTGGAAGT<br>GGAAAAACGCTGACCATACAAGTAAAAGAATTTGGAGATGCTGGCCAGTACACCTGCCACA<br>AAGGAGGAGAAGTTCTCAGCCACAGTTTATTATTACTTCACAAGAAAGAAGATGGCATCTG<br>GTCCACAGATATTTTAAAAGACCAGAAGGAGCCCAAAAATAAAACATTTCTTCGATGTGAG<br>GCCAAGAACTACAGTGGTCGTTTCACCTGCTGGTGGCTGACCACCATCTCCACAGACCTCA<br>CCTTCAGTGTAAAAAGCAGCCGTGGTTCTTCTGACCCCCAAGGAGTCACCTGTGGGGCTGC<br>CACGCTCTCTGCAGAAAGAGTTCGAGGTGACAACAAAGAATATGAGTACTCGGTGGAATGT<br>CAAGAAGATTCGGCCTGCCCAGCTGCTGAGGAGAGTCTTCCCATAGAAGTCATGGTGGATG<br>CTGTTCACAAATTAAAATATGAAAACTACACCAGCAGCTTCTTCATCAGAGATATCATCAA<br>ACCTGACCCGCCCAAGAACTTACAGCTGAAGCCGCTGAAAAACAGCCGGCAGGTAGAAGTT<br>TCCTGGGAGTACCCAGATACCTGGTCCACGCCGCACTCCTACTTCTCCCTCACCTTCTGTG<br>TACAAGTACAAGGCAAGAGCAAGAGAGAGAAGAAAGATCGTGTCTTCACAGATAAAACATC<br>AGCCACGGTCATCTGCAGGAAAAATGCCAGCATCTCGGTGCGGGCCCAGGACCGCTACTAC<br>AGCAGCAGCTGGAGTGAGTGGGCATCTGTGCCCTGCAGTGGTGGTGGGGGTGGTGGCAGCA<br>GAAACCTTCCTGTGGCCACTCCAGACCCTGGCATGTTCCCGTGCCTTCACCACTCCCAAAA<br>TTTACTTCGAGCTGTTTCTAACATGCTGCAGAAAGCACGGCAAACTTTAGAATTCTACCCG<br>TGCACTTCTGAAGAAATTGACCATGAAGATATCACAAAAGATAAAACCAGCACAGTGGAGG<br>CCTGTCTTCCTTTAGAGCTGACCAAAAATGAATCCTGCCTCAACAGCAGAGAGACCAGCTT<br>CATCACCAATGGCAGCTGCCTGGCCTCCAGGAAAACCAGCTTCATGATGGCGCTCTGCCTC<br>AGCTCCATCTATGAAGATTTGAAGATGTACCAAGTAGAATTTAAAACCATGAATGCCAAAT<br>TATTAATGGACCCCAAGAGGCAGATATTTTTAGATCAAAACATGCTGGCAGTTATTGATGA<br>GCTCATGCAAGCATTAAACTTCAACAGTGAGACGGTACCTCAAAAAAGCAGCCTTGAAGAG<br>CCAGATTTCTACAAAACCAAGATCAAACTCTGCATTTTACTTCATGCCTTCCGCATCCGGG<br>CGGTCACCATTGACCGTGTCATGTCCTACTTAAATGCCTCGTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1093 | hIL12AB_014 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTTGTGATTTCTTGG<br>TTCTCTCTTGTGTTCCTTGCTTCTCCTCTTGTGGCTATTTGGGAGTTAAAAAAGGACGTGT<br>ACGTGGTGGAGCTTGACTGGTACCCTGACGCACCTGGCGAGATGGTGGTGCTTACTTGTGA<br>CACTCCTGAGGAGGACGGCATTACTTGGACGCTTGACCAGTCTTCTGAGGTGCTTGGCTCT<br>GGCAAAACACTTACTATTCAGGTGAAGGAGTTCGGGGATGCTGGCCAGTACACTTGCCACA<br>AGGGCGGCGAGGTGCTTTCTCACTCTCTTCTTCTTCTTCACAAGAAGGAGGACGGCATTTG<br>GTCTACTGACATTTTAAAAGACCAGAAGGAGCCCAAGAACAAAACATTCCTTCGTTGCGAG<br>GCCAAGAACTACTCTGGCCGTTTCACTTGCTGGTGGCTTACTACTATTTCTACTGACCTTA<br>CTTTCTCTGTGAAGTCTTCTCGTGGCTCTTCTGACCCTCAGGGCGTGACTTGTGGGGCTGC<br>TACTCTTTCTGCTGAGCGTGTGCGTGGTGACAACAAGGAGTACGAGTACTCTGTGGAGTGC<br>CAGGAAGATTCTGCTTGCCCTGCTGCTGAGGAGTCTCTTCCTATTGAGGTGATGGTGGATG<br>CTGTGCACAAGTTAAAATACGAGAACTACACTTCTTCTTTCTTCATTCGTGACATTATTAA<br>GCCTGACCCTCCCAAGAACCTTCAGTTAAAACCTTTAAAAAACTCTCGTCAGGTGGAGGTG<br>TCTTGGGAGTACCCTGACACTTGGTCTACTCCTCACTCTTACTTCTCTCTTACTTTCTGCG<br>TGCAGGTGCAGGGCAAGTCTAAGCGTGAGAAGAAGGACCGTGTGTTCACTGACAAAACATC<br>TGCTACTGTGATTTGCAGGAAGAATGCATCTATTTCTGTGCGTGCTCAGGACCGTTACTAC<br>TCTTCTTCTTGGTCTGAGTGGGCTTCTGTGCCTTGCTCTGGCGGCGGCGGCGGCGGCTCCA<br>GAAATCTTCCTGTGGCTACTCCTGACCCTGGCATGTTCCCTTGCCTTCACCACTCTCAGAA<br>CCTTCTTCGTGCTGTGAGCAACATGCTTCAGAAGGCTCGTCAAACTCTTGAGTTCTACCCT<br>TGCACTTCTGAGGAGATTGACCACGAAGATATCACCAAAGATAAAACATCTACTGTGGAGG<br>CTTGCCTTCCTCTTGAGCTTACCAAGAATGAATCTTGCTTAAATTCTCGTGAGACGTCTTT<br>CATCACCAACGGCTCTTGCCTTGCCTCGCGCAAAACATCTTTCATGATGGCTCTTTGCCTT<br>TCTTCTATTTACGAAGATTTAAAAATGTACCAGGTGGAGTTCAAAACAATGAATGCAAAGC<br>TTCTTATGGACCCCAAGCGTCAGATTTTCCTTGACCAGAACATGCTTGCTGTGATTGACGA<br>GCTTATGCAGGCTTTAAATTTCAACTCTGAGACGGTGCCTCAGAAGTCTTCTCTTGAGGAG<br>CCTGACTTCTACAAGACCAAGATTAAGCTTTGCATTCTTCTTCATGCTTTCCGTATTCGTG<br>CTGTGACTATTGACCGTGTGATGTCTTACTTAAATGCTTCTTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1094 | hIL12AB_015 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAGCAGCTGGTGATCAGCTGG<br>TTTAGCCTGGTGTTTCTGGCCAGCCCCCTGGTGGCCATCTGGGAACTGAAGAAAGACGTGT<br>ACGTGGTAGAACTGGATTGGTATCCGGACGCTCCCGGCGAAATGGTGGTGCTGACCTGTGA |

TABLE 15-continued

Sequence Optimized IL12 Polynucleotides Comprising 5' UTR, ORF, and 3' UTR

| SEQ ID NO | Description | Sequence |
|---|---|---|
| | | CACCCCCGAAGAAGACGGAATCACCTGGACCCTGGACCAGAGCAGCGAGGTGCTGGGCAGC<br>GGCAAAACCCTGACCATCCAAGTGAAAGAGTTTGGCGATGCCGGCCAGTACACCTGTCACA<br>AAGGCGGCGAGGTGCTAAGCCATTCGCTGCTGCTGCTGCACAAAAAGGAAGATGGCATCTG<br>GAGCACCGATATCCTGAAGGACCAGAAAGAACCCAAAAATAAGACCTTTCTAAGATGCGAG<br>GCCAAGAATTATAGCGGCCGTTTCACCTGCTGGTGGCTGACGACCATCAGCACCGATCTGA<br>CCTTCAGCGTGAAAAGCAGCAGAGGCAGCAGCGACCCCCAAGGCGTGACGTGCGGCGCCGC<br>CACCCTGAGCGCCGAGAGAGTGAGAGGCGACAACAAGGAGTATGAGTACAGCGTGGAGTGC<br>CAGGAAGATAGCGCCTGCCCCGCCGCCGAGGAGAGCCTGCCCATCGAGGTGATGGTGGATG<br>CCGTGCACAAGCTGAAGTATGAAAACTACACCAGCAGCTTCTTCATCAGAGATATCATCAA<br>ACCCGACCCCCCCAAGAACCTGCAGCTGAAGCCCCTGAAGAATAGCCGGCAGGTGGAGGTG<br>AGCTGGGAGTACCCCGACACCTGGAGCACCCCCCATAGCTACTTCAGCCTGACCTTCTGCG<br>TGCAGGTGCAGGGCAAGAGCAAGAGAGAAAAGAAAGATAGAGTGTTCACAGATAAGACCAG<br>CGCCACGGTGATCTGCAGAAAAAATGCCAGCATCAGCGTGAGAGCCCAAGATAGATACTAT<br>AGCAGCAGCTGGAGCGAATGGGCCAGCGTGCCCTGCAGCGGCGGCGGCGGCGGCGGCAGCA<br>GAAACCTGCCCGTGGCCACCCCCGACCCCGGCATGTTCCCCTGCCTGCACCACAGCCAAAA<br>CCTGCTGAGAGCCGTGAGCAACATGCTGCAGAAGGCCCGGCAGACCCTGGAATTTTACCCC<br>TGCACCAGCGAAGAGATCGATCATGAAGATATCACCAAAGATAAAACCAGCACCGTGGAGG<br>CCTGTCTGCCCCTGGAACTGACCAAGAATGAGAGCTGCCTAAATAGCAGAGAGACCAGCTT<br>CATAACCAATGGCAGCTGCCTGGCCAGCAGAAAGACCAGCTTTATGATGGCCCTGTGCCTG<br>AGCAGCATCTATGAAGACCTGAAGATGTACCAGGTGGAGTTCAAGACCATGAATGCCAAGC<br>TGCTGATGGATCCCAAGCGGCAGATCTTTCTGGATCAAAACATGCTGGCCGTGATCGATGA<br>GCTGATGCAGGCCCTGAATTTCAACAGCGAGACCGTGCCCCAAAAAAGCAGCCTGGAAGAA<br>CCGGATTTTTATAAAACCAAAATCAAGCTGTGCATACTGCTGCATGCCTTCAGAATCAGAG<br>CCGTGACCATCGATAGAGTGATGAGCTATCTGAATGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1095 | hIL12AB_016 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTCATCAGCTGG<br>TTCAGCCTGGTCTTCCTGGCCAGCCCCCTGGTGGCCATCTGGGAGCTGAAGAAGGACGTAT<br>ACGTAGTGGAGTTGGATTGGTACCCAGACGCTCCTGGGGAGATGGTGGTGCTGACCTGTGA<br>CACCCCAGAAGAGGACGGTATCACCTGGACCCTGGACCAGAGCTCAGAAGTGCTGGGCAGT<br>GGAAAAACCCTGACCATCCAGGTGAAGGAGTTTGGAGATGCTGGCCAGTACACCTGCCACA<br>AGGGTGGTGAAGTGCTGAGCCACAGCCTGCTGCTGCTGCACAAGAAGGAGGATGGCATCTG<br>GAGCACAGATATCCTGAAGGACCAGAAGGAGCCCAAGAACAAGACCTTCCTTCGCTGTGAA<br>GCCAAGAACTACAGTGGCCGCTTCACCTGCTGGTGGCTGACCACCATCAGCACAGACCTCA<br>CCTTCTCGGTGAAGAGCAGCAGAGGCAGCTCAGACCCCCAGGGTGTCACCTGTGGGGCGGC<br>CACGCTGTCGGCGGAGAGAGTTCGAGGTGACAACAAGGAGTATGAATACTCGGTGGAGTGC<br>CAGGAAGATTCGGCGTGCCCGGCGGCAGAAGAGAGCCTGCCCATAGAAGTGATGGTGGATG<br>CTGTGCACAAGCTGAAGTATGAAAACTACACCAGCAGCTTCTTCATCAGAGATATCATCAA<br>GCCAGACCCGCCCAAGAACCTGCAGCTGAAGCCCCTGAAGAACAGCCGGCAGGTGGAGGTT<br>TCCTGGGAGTACCCAGATACGTGGAGCACCCCCCACAGCTACTTCAGCCTGACCTTCTGTG<br>TCCAGGTGCAGGGCAAGAGCAAGAGAGAGAAGAAAGATAGAGTCTTCACAGATAAGACCTC<br>GGCCACGGTCATCTGCAGAAAGAATGCCTCCATCTCGGTTCGAGCCCAAGATAGATACTAC<br>AGCAGCAGCTGGTCAGAATGGGCCTCGGTGCCCTGCAGTGGTGGCGGCGGCGGCGGCAGCA<br>GAAACCTGCCTGTTGCCACCCCAGACCCTGGGATGTTCCCCTGCCTGCACCACAGCCAGAA<br>CTTATTACGAGCTGTTTCTAACATGCTGCAGAAGGCCCGGCAGACCCTGGAGTTCTACCCC<br>TGCACCTCAGAAGAGATTGACCATGAAGATATCACCAAAGATAAGACCAGCACTGTAGAGG<br>CCTGCCTGCCCCTGGAGCTGACCAAGAATGAAAGCTGCCTGAACAGCAGAGAGACCAGCTT<br>CATCACCAATGGAAGCTGCCTGGCCAGCAGAAAGACCAGCTTCATGATGGCCCTGTGCCTG<br>AGCAGCATCTATGAAGACCTGAAGATGTACCAGGTGGAGTTCAAGACCATGAATGCAAAGC<br>TGCTGATGGACCCCAAGCGGCAGATATTTTTGGACCAGAACATGCTGGCTGTCATTGATGA<br>GCTGATGCAGGCCCTGAACTTCAACTCAGAAACTGTACCCCAGAAGAGCAGCCTGGAGGAG<br>CCAGATTTCTACAAGACCAAGATCAAGCTGTGCATCCTGCTTCATGCTTTCAGAATCAGAG<br>CTGTCACCATTGACCGCGTGATGAGCTACTTAAATGCCTCGTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1096 | hIL12AB_017 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTAATCAGCTGG<br>TTTTCCCTCGTCTTTCTGGCATCACCCCTGGTGGCTATCTGGGAGCTGAAGAAGGACGTGT<br>ACGTGGTGGAGCTGGATTGGTACCCTGACGCCCCGGGGGAAATGGTGGTGTTAACCTGCGA<br>CACGCCTGAGGAGGACGGCATCACCTGGACGCTGGACCAGAGCAGCGAGGTGCTTGGGTCT<br>GGTAAAACTCTGACTATTCAGGTGAAAGAGTTCGGGGATGCCGGCCAATATACTTGCCACA<br>AGGGTGGCGAGGTGCTTTCTCATTCTCTGCTCCTGCTGCACAAGAAAGAAGATGGCATTTG<br>GTCTACTGATATTCTGAAAGACCAGAAGGAGCCCAAGAACAAGACCTTTCTGAGATGCGAG<br>GCTAAAAACTACAGCGGAAGATTTACCTGCTGGTGGCTGACCACAATCTCAACCGACCTGA<br>CATTTTCAGTGAAGTCCAGCAGAGGGAGCTCCGACCCTCAGGGCGTGACCTGCGGAGCCGC<br>CACTCTGTCCGCAGAAAGAGTGAGAGGTGATAATAAGGAGTACGAGTATTCAGTCGAGTGC<br>CAAGAAGATTCTGCCTGCCCAGCCGCCGAGGAGAGCCTGCCAATCGAGGTGATGGTAGATG<br>CGGTACACAAGCTGAAGTATGAGAACTACACATCCTCCTTCTTCATAAGAGATATTATCAA<br>GCCTGACCCACCTAAAAATCTGCAACTCAAGCCTTTGAAAAATTCACGGCAGGTGGAGGTG<br>AGCTGGGAGTACCCTGATACTTGGAGCACCCCCCATAGCTACTTTTCGCTGACATTCTGCG<br>TCCAGGTGCAGGGCAAGTCAAAGAGAGAGAAGAAGGATCGCGTGTTCACTGATAAAACAAG<br>CGCCACAGTGATCTGCAGAAAAAACGCTAGCATTAGCGTCAGAGCACAGGACCGGTATTAC<br>TCCAGCTCCTGGAGCGAATGGGCATCTGTGCCCTGCAGCGGTGGGGGCGGAGGCGGATCCA |

TABLE 15-continued

Sequence Optimized IL12 Polynucleotides Comprising 5' UTR, ORF, and 3' UTR

| SEQ ID NO | Description | Sequence |
|---|---|---|
| | | GAAACCTCCCCGTTGCCACACCTGATCCTGGAATGTTCCCCTGTCTGCACCACAGCCAGAA<br>CCTGCTGAGAGCAGTGTCTAACATGCTCCAGAAGGCCAGGCAGACCCTGGAGTTTTACCCC<br>TGCACCAGCGAGGAAATCGATCACGAAGATATCACCAAAGATAAAACCTCCACCGTGGAGG<br>CCTGCCTGCCCCTGGAACTGACCAAAAACGAGAGCTGCCTGAATAGCAGGGAGACCTCCTT<br>CATCACCAACGGCTCATGCCTTGCCAGCCGGAAAACTAGCTTCATGATGGCCCTGTGCCTG<br>TCTTCGATCTATGAGGACCTGAAAATGTACCAGGTCGAATTTAAGACGATGAACGCAAAGC<br>TGCTGATGGACCCCAAGCGGCAGATCTTTCTGGACCAGAACATGCTGGCAGTCATAGATGA<br>GTTGATGCAGGCATTAAACTTCAACAGCGAGACCGTGCCTCAGAAGTCCAGCCTCGAGGAG<br>CCAGATTTTTATAAGACCAAGATCAAACTATGCATCCTGCTGCATGCTTTCAGGATTAGAG<br>CCGTCACCATCGATCGAGTCATGTCTTACCTGAATGCTAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1097 | hIL12AB_018 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAACAGTTAGTAATCTCCTGG<br>TTTTCTCTGGTGTTTCTGGCCAGCCCCCTCGTGGCCATCTGGGAGCTTAAAAAGGACGTTT<br>ACGTGGTGGAGTTGGATTGGTATCCCGACGCTCCAGGCGAAATGGTCGTGCTGACCTGCGA<br>TACCCCTGAAGAAGACGGTATCACCTGGACGCTGGACCAGTCTTCCGAGGTGCTTGGATCT<br>GGCAAAACACTGACAATACAAGTTAAGGAGTTCGGGGACGCAGGGCAGTACACCTGCCACA<br>AAGGCGGCGAGGTCCTGAGTCACTCCCTGTTACTGCTCCACAAGAAAGAGGACGGCATTTG<br>GTCCACCGACATTCTGAAGGACCAGAAGGAGCCTAAGAATAAAACTTTCCTGAGATGCGAG<br>GCAAAAAACTATAGCGGCCGCTTTACTTGCTGGTGGCTTACAACAATCTCTACCGATTTAA<br>CTTTCTCCGTGAAGTCTAGCAGAGGATCCTCTGACCCGCAAGGAGTGACTTGCGGAGCCGC<br>CACCTTGAGCGCCGAAAGAGTCCGTGGCGATAACAAAGAATACGAGTACTCCGTGGAGTGC<br>CAGGAAGATTCCGCCTGCCCAGCTGCCGAGGAGTCCCTGCCCATTGAAGTGATGGTGGATG<br>CCGTCCACAAGCTGAAGTACGAAAACTATACCAGCAGCTTCTTCATCCGGGATATCATTAA<br>GCCCGACCCTCCTAAAAACCTGCAACTTAAGCCCCTAAAGAATAGTCGGCAGGTTGAGGTC<br>AGCTGGGAATATCCTGACACATGGAGCACCCCCCACTCTTATTTCTCCCTGACCTTCTGCG<br>TGCAGGTGCAGGGCAAGAGTAAACGGGAGAAAAAAGATAGGGTCTTTACCGATAAAACCAG<br>CGCTACGGTTATCTGTCGGAAGAACGCTTCCATCTCCGTCCGCGCTCAGGATCGTTACTAC<br>TCGTCCTCATGGAGCGAGTGGGCCAGCGTGCCCTGCAGCGGCGGCGGTGGAGGCGGATCCA<br>GAAATCTGCCTGTTGCCACACCAGACCCTGGCATGTTCCCCTGTCTGCATCATAGCCAGAA<br>CCTGCTCAGAGCCGTGAGCAACATGCTCCAGAAGGCCAGGCAAACTTTGGAGTTCTACCCG<br>TGTACATCTGAGGAAATCGATCACGAAGATATAACCAAAGATAAAACCTCTACAGTAGAGG<br>CTTGTTTGCCCCTGGAGTTGACCAAAAACGAGAGTTGCCTGAACAGTCGCGAGACGAGCTT<br>CATTACTAACGGCAGCTGTCTCGCCTCCAGAAAAACATCCTTCATGATGGCCCTGTGTCTT<br>TCCAGCATATACGAAGACCTGAAAATGTACCAGGTCGAGTTCAAAACAATGAACGCCAAGC<br>TGCTTATGGACCCCAAGCGGCAGATCTTCCTCGACCAAAACATGCTCGCTGTGATCGATGA<br>GCTGATGCAGGCTCTCAACTTCAATTCCGAAACAGTGCCACAGAAGTCCAGTCTGGAAGAA<br>CCCGACTTCTACAAGACCAAGATTAAGCTGTGTATTTTGCTGCATGCGTTTAGAATCAGAG<br>CCGTGACCATTGATCGGGTGATGAGCTACCTGAACGCCTCGTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1098 | hIL12AB_019 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTTGTCATCTCCTGG<br>TTTTCTCTTGTCTTCCTGGCCTCGCCGCTGGTGGCCATCTGGGAGCTGAAGAAAGACGTTT<br>ACGTAGTAGAGTTGGATTGGTACCCAGACGCACCTGGAGAAATGGTGGTTCTCACCTGTGA<br>CACTCCTGAAGAAGACGGTATCACCTGGACGCTGGACCAAAGCTCAGAAGTTCTTGGCAGT<br>GGAAAAACGCTGACCATACAAGTAAAAGAATTTGGGGATGCTGGCCAGTACACGTGCCACA<br>AAGGAGGAGAAGTTCTCAGCCACAGTTTACTTCTTCTTCACAAGAAAGAAGATGGCATCTG<br>GTCCACAGATATTTTAAAAGACCAGAAGGAGCCCAAGAACAAAACCTTCCTCCGCTGTGAG<br>GCCAAGAACTACAGTGGTCGTTTCACCTGCTGGTGGCTCACCACCATCTCCACTGACCTCA<br>CCTTCTCTGTAAAAAGCAGCCGTGGTTCTTCTGACCCCCAAGGAGTCACCTGTGGGGCTGC<br>CACGCTCTCGGCAGAAAGAGTTCGAGGTGACAACAAGGAATATGAATATTCTGTGGAATGT<br>CAAGAAGATTCTGCCTGCCCGGCGGCAGAAGAAAGTCTTCCCATAGAAGTCATGGTGGATG<br>CTGTTCACAAATTAAAATATGAAAACTACACCAGCAGCTTCTTCATTCGTGACATCATCAA<br>ACCAGACCCGCCCAAGAACCTTCAGTTAAAACCTTTAAAAAACAGCCGGCAGGTAGAAGTT<br>TCCTGGGAGTACCCAGATACGTGGTCCACGCCGCACTCCTACTTCAGTTTAACCTTCTGTG<br>TACAAGTACAAGGAAAATCAAAAAGAGAGAAGAAAGATCGTGTCTTCACTGACAAAACATC<br>TGCCACGGTCATCTGCAGGAAGAATGCCTCCATCTCGGTTCGAGCCCAGGACCGCTACTAC<br>AGCAGCAGCTGGAGTGAGTGGGCATCTGTTCCCTGCAGTGGTGGCGGCGGCGGCGGCAGCC<br>GCAACCTTCCTGTGGCCACGCCGGACCCTGGCATGTTCCCGTGCCTTCACCACTCCCAAAA<br>TCTTCTTCGTGCTGTTTCTAACATGCTGCAGAAGGCGCGCCAAACTTTAGAATTCTACCCG<br>TGCACTTCTGAAGAAATAGACCATGAAGATATCACCAAAGATAAAACCAGCACGGTGGAGG<br>CCTGCCTTCCTTTAGAGCTGACCAAGAATGAATCCTGCCTCAACAGCAGAGAGACCAGCTT<br>CATCACCAATGGCAGCTGCCTGGCCTCGCGCAAGACCAGCTTCATGATGGCGCTGTGCCTT<br>TCTTCCATCTATGAAGATTTAAAGATGTACCAAGTAGAATTTAAAACCATGAATGCCAAAT<br>TATTAATGGACCCCAAACGGCAGATATTTTTGGATCAAAACATGCTGGCTGTCATTGATGA<br>GCTCATGCAAGCATTAAACTTCAACTCAGAAACTGTTCCCCAGAAGTCATCTTTAGAAGAG<br>CCAGATTTCTACAAAACAAAAATAAAACTCTGCATTCTTCTTCATGCCTTCCGCATCCGTG<br>CTGTCACCATTGACCGTGTCATGTCCTACTTAAATGCTTCTTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |

TABLE 15-continued

| Sequence Optimized IL12 Polynucleotides Comprising 5' UTR, ORF, and 3' UTR | | |
|---|---|---|
| SEQ ID NO | Description | Sequence |
| 1099 | hIL12AB_020 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTGATCAGCTGG<br>TTCAGCCTGGTGTTCCTGGCTAGCCCTCTGGTGGCCATCTGGGAGCTGAAGAAGGACGTGT<br>ACGTGGTGGAGTTGGATTGGTACCCCGACGCTCCCGGCGAGATGGTGGTGCTGACCTGCGA<br>CACCCCCGAGGAGGACGGGATCACCTGGACCCTGGATCAGTCAAGCGAGGTGCTGGGAAGC<br>GGCAAGACCCTGACCATCCAGGTGAAGGAGTTCGGCGACGCCGGCCAATACACTTGCCACA<br>AGGGAGGCGAGGTGCTGTCCCACTCCCTCCTGCTGCTGCACAAAAAGGAAGACGGCATCTG<br>GAGCACCGACATCCTGAAAGACCAGAAGGAGCCTAAGAACAAAACATTCCTCAGATGCGAG<br>GCCAAGAATTACTCCGGGAGATTCACCTGTTGGTGGCTGACCACCATCAGCACAGACCTGA<br>CCTTCAGCGTGAAGAGCAGCAGAGGCAGCAGCGACCCCCAGGGCGTGACCTGTGGCGCCGC<br>CACCCTGAGCGCCGAAAGAGTGCGCGGCGACAACAAGGAGTACGAGTACTCCGTGGAATGC<br>CAGGAAGATAGCGCCTGCCCCGCCGCCGAGGAGAGCCTGCCCATCGAGGTGATGGTGGACG<br>CCGTCCACAAGCTGAAGTACGAGAACTACACCTCTAGCTTCTTCATCAGAGATATCATCAA<br>GCCCGATCCCCCCAAGAACCTGCAGCTGAAACCCCTGAAGAACAGCCGGCAGGTGGAGGTG<br>AGCTGGGAGTATCCCGACACCTGGTCCACCCCCCACAGCTATTTTAGCCTGACCTTCTGCG<br>TGCAAGTGCAGGGCAAGAGCAAGAGAGAGAAGAAGGACCGCGTGTTCACCGACAAAACCAG<br>CGCCACCGTGATCTGCAGAAAGAACGCCAGCATCAGCGTGAGGGCCCAGGATAGATACTAC<br>AGTTCCAGCTGGAGCGAGTGGGCCAGCGTGCCCTGCAGCGGCGGCGGCGGGGGAGGCTCGA<br>GAAACCTGCCCGTGGCTACCCCCGATCCCGGAATGTTCCCCTGCCTGCACCACAGCCAGAA<br>CCTGCTGAGGGCGGTGTCCAACATGCTTCAGAAGGCCCGGCAGACCCTGGAGTTCTACCCC<br>TGTACCTCTGAGGAGATCGATCATGAAGATATCACAAAAGATAAAACCAGCACCGTGGAGG<br>CCTGCCTGCCCCTGGAGCTGACCAAGAACGAGAGCTGCCTGAACTCCCGCGAGACCAGCTT<br>CATCACGAACGGCAGCTGCCTGGCCAGCAGGAAGACCTCCTTCATGATGGCCCTGTGCCTG<br>AGCAGCATCTACGAGGACCTGAAAATGTACCAGGTGGAGTTTAAGACCATGAACGCCAAGC<br>TGCTGATGGACCCCAAGCGGCAAATCTTCCTGGACCAGAACATGCTGGCAGTGATCGACGA<br>GCTCATGCAGGCCCTGAACTTCAATAGCGAGACGGTCCCCCAGAAGAGCAGCCTGGAGGAG<br>CCCGACTTTTACAAGACCAAGATCAAGCTGTGCATCCTGCTGCACGCCTTTAGAATCCGTG<br>CCGTGACCATTGACAGAGTGATGAGCTACCTGAATGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1100 | hIL12AB_021 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTGATCAGCTGG<br>TTCAGCCTGGTGTTCCTGGCCAGCCCTCTGGTTGCCATCTGGGAGCTGAAGAAAGACGTGT<br>ACGTCGTGGAACTGGACTGGTATCCGGACGCCCCGGGCGAGATGGTGGTGCTGACCTGTGA<br>CACCCCCGAGGAGGACGGCATCACCTGGACGCTGGACCAATCCTCCGAGGTGCTGGGAAGC<br>GGCAAGACCCTGACCATCCAGGTGAAGGAATTCGGGGACGCCGGGCAGTACACCTGCCACA<br>AGGGGGGCGAAGTGCTGTCCCACTCGCTGCTGCTCCTGCATAAGAAGGAGGATGGAATCTG<br>GTCCACCGACATCCTCAAAGATCAGAAGGAGCCCAAGAACAAGACGTTCCTGCGCTGTGAA<br>GCCAAGAATTATTCGGGGCGATTCACGTGCTGGTGGCTGACAACCATCAGCACCGACCTGA<br>CGTTTAGCGTGAAGAGCAGCAGGGGGTCCAGCGACCCCCAGGGCGTGACGTGCGGCGCCGC<br>CACCCTCTCCGCCGAGAGGGTGCGGGGGGACAATAAGGAGTACGAGTACAGCGTGGAATGC<br>CAGGAGGACAGCGCCTGCCCCGCCGCGGAGGAAAGCCTCCCGATAGAGGTGATGGTGGACG<br>CCGTGCACAAGCTCAAGTATGAGAATTACACCAGCAGCTTTTTCATCCGGGACATTATCAA<br>GCCCGACCCCCCGAAGAACCTCCAGCTGAAGCCCCTGAAGAACAGCCGGCAGGTGGAAGTC<br>TCCTGGGAGTATCCCGACACCTGGAGCACCCCGCACAGCTACTTCTCCCTGACCTTCTGTG<br>TGCAGGTGCAGGGCAAGTCCAAGAGGGAAAAGAAGGACAGGGTTTTCACCGACAAGACCAG<br>CGCGACCGTGATCTGCCGGAAGAACGCCAGCATAAGCGTCCGCGCCCAAGATAGGTACTAC<br>AGCAGCTCCTGGAGCGAGTGGGCTAGCGTGCCCTGCAGCGGGGGCGGGGGTGGGGGCTCCA<br>GGAACCTGCCAGTGGCGACCCCCGACCCCGGCATGTTCCCCTGCCTCCATCACAGCCAGAA<br>CCTGCTGAGGGCCGTCAGCAATATGCTGCAGAAGGCCAGGCAGACCCTGGAATTCTACCCC<br>TGCACGTCGGAGGAGATCGATCACGAGGATATCACAAAAGACAAGACTTCCACCGTGGAGG<br>CCTGCCTGCCCCTGGAGCTCACCAAGAATGAGTCCTGTCTGAACTCCCGGGAAACCAGCTT<br>CATCACCAACGGGTCCTGCCTGGCCAGCAGGAAGACCAGCTTTATGATGGCCCTGTGCCTG<br>TCGAGCATCTACGAGGACCTGAAGATGTACCAGGTCGAGTTCAAGACAATGAACGCCAAGC<br>TGCTGATGGACCCCAAGAGGCAAATCTTCCTGGACCAGAATATGCTTGCCGTCATCGACGA<br>GCTCATGCAGGCCCTGAACTTCAACTCCGAGACCGTGCCCCAGAAGAGCAGCCTGGAGGAG<br>CCCGACTTCTACAAGACCAAGATCAAGCTGTGCATCCTGCTGCACGCGTTCAGGATCCGGG<br>CAGTCACCATCGACCGTGTGATGTCCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1101 | hIL12AB_022 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCATCAGCAGCTGGTGATCAGCTGG<br>TTCAGCCTGGTGTTCCTCGCCTCTCCCCTGGTGGCCATCTGGGAGCTCAAAAAGGACGTGT<br>ACGTGGTGGAGCTCGACTGGTACCCAGACGCCCCCGGGGAGATGGTGGTGCTGACCTGCGA<br>CACCCCCGAAGAAGACGGCATCACGTGGACCCTCGACCAGTCCAGCGAGGTGCTGGGGAGC<br>GGGAAGACTCTGACCATCCAGGTCAAGGAGTTCGGGGACGCCGGGCAGTACACGTGCCACA<br>AGGGCGGCGAAGTCTTAAGCCACAGCCTGCTCCTGCTGCACAAGAAGGAGGACGGGATCTG<br>GTCCACAGACATACTGAAGGACCAGAAGGAGCCGAAGAATAAAACCTTTCTGAGGTGCGAG<br>GCCAAGAACTATTCCGGCAGGTTCACGTGCTGGTGGCTTACAACAATCAGCACAGACCTGA<br>CGTTCAGCGTGAAGTCCAGCCGCGGCAGCAGCGACCCCCAGGGGGTGACCTGCGGCGCCGC<br>CACCCTGAGCGCCGAGCGGGTGCGCGGGGACAACAAGGAGTACGAGTACTCCGTGGAGTGC<br>CAGGAAGACAGCGCCTGTCCCGCCGCCGAAGAGAGCCTGCCTATCGAGGTCATGGTAGATG<br>CAGTGCATAAGCTGAAGTACGAGAACTATACGAGCAGCTTTTTCATACGCGACATCATCAA<br>GCCCGACCCCCCCAAGAACCTGCAGCTTAAGCCCCTGAAGAATAGCCGGCAGGTGGAGGTC |

TABLE 15-continued

Sequence Optimized IL12 Polynucleotides Comprising 5' UTR, ORF, and 3' UTR

| SEQ ID NO | Description | Sequence |
|---|---|---|
| | | TCCTGGGAGTACCCCGACACCTGGTCAACGCCCCACAGCTACTTCTCCCTGACCTTTTGTG<br>TCCAAGTCCAGGGAAAGAGCAAGAGGGAGAAGAAAGATCGGGTGTTCACCGACAAGACCTC<br>CGCCACGGTGATCTGCAGGAAGAACGCCAGCATCTCCGTGAGGGCGCAAGACAGGTACTAC<br>TCCAGCAGCTGGTCCGAATGGGCCAGCGTGCCCTGCTCCGGCGGCGGGGGCGGCGGCAGCC<br>GAAACCTACCCGTGGCCACGCCGGATCCCGGCATGTTTCCCTGCCTGCACCACAGCCAGAA<br>CCTCCTGAGGGCCGTGTCCAACATGCTGCAGAAGGCCAGGCAGACTCTGGAGTTCTACCCC<br>TGCACGAGCGAGGAGATCGATCACGAGGACATCACCAAGGATAAGACCAGCACTGTGGAGG<br>CCTGCCTTCCCCTGGAGCTGACCAAGAACGAGAGCTGTCTGAACTCCAGGGAGACCTCATT<br>CATCACCAACGGCTCCTGCCTGGCCAGCAGGAAAACCAGCTTCATGATGGCCTTGTGTCTC<br>AGCTCCATCTACGAGGACCTGAAGATGTATCAGGTCGAGTTCAAGACAATGAACGCCAAGC<br>TGCTGATGGACCCCAAAAGGCAGATCTTCCTGGACCAGAACATGCTGGCCGTCATCGACGA<br>GCTGATGCAGGCCCTGAACTTCAACAGCGAGACGGTGCCCCAGAAAAGCTCCCTGGAGGAG<br>CCCGACTTCTACAAGACCAAGATCAAGCTGTGCATCCTGCTGCACGCCTTCAGGATCAGGG<br>CAGTGACCATCGACCGGGTGATGTCATACCTTAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1102 | hIL12AB_023 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCATCAGCAGCTGGTGATCTCCTGG<br>TTCAGCCTGGTGTTTCTGGCCTCGCCCCTGGTCGCCATCTGGGAGCTGAAGAAAGACGTGT<br>ACGTCGTCGAACTGGACTGGTACCCCGACGCCCCCGGGGAGATGGTGGTGCTGACCTGCGA<br>CACGCCGGAGGAGGACGGCATCACCTGGACCCTGGATCAAAGCAGCGAGGTGCTGGGCAGC<br>GGCAAGACCCTGACCATCCAAGTGAAGGAATTCGGCGATGCCGGCCAGTACACCTGTCACA<br>AAGGGGGCGAGGTGCTCAGCCACAGCCTGCTGCTGCTGCACAAGAAGGAGGATGGCATCTG<br>GAGCACCGATATCCTGAAGGACCAGAAAGAGCCCAAGAACAAGACGTTCCTGAGGTGCGAG<br>GCCAAGAACTACAGCGGTAGGTTCACGTGTTGGTGGCTGACCACCATCAGCACCGACCTGA<br>CGTTCAGCGTGAAGAGCTCCAGGGGCAGCTCCGACCCACAGGGGGTGACGTGCGGGGCCGC<br>AACCCTCAGCGCCGAAAGGGTGCGGGGGGACAACAAGGAGTACGAATACTCCGTGGAGTGC<br>CAGGAAGATTCGGCCTGCCCCGCCGCGGAGGAGAGCCTCCCCATCGAGGTAATGGTGGACG<br>CCGTGCATAAGCTGAAGTACGAGAACTACACCAGCTCGTTCTTCATCCGAGACATCATCAA<br>ACCCGACCCGCCCAAAAATCTGCAGCTCAAGCCCCTGAAGAACTCCAGGCAGGTGGAGGTG<br>AGCTGGGAGTACCCCGACACCTGGTCCACCCCGCACAGCTACTTCTCCCTGACATTCTGCG<br>TGCAGGTGCAGGGCAAGAGCAAGCGGGAGAAGAAGGACAGGGTGTTCACCGACAAGACGAG<br>CGCCACCGTGATCTGCCGAAAGAACGCCAGCATCTCGGTGCGCGCCCAGGATAGGTACTAT<br>TCCAGCTCCTGGAGCGAGTGGGCCTCGGTACCCTGCAGCGGCGGCGGGGGCGGCGGCAGTA<br>GGAATCTGCCCGTGGCTACCCCGGACCCGGGCATGTTCCCCTGCCTCCACCACAGCCAGAA<br>CCTGCTGAGGGCCGTGAGCAACATGCTGCAGAAGGCCAGACAGACGCTGGAGTTCTACCCC<br>TGCACGAGCGAGGAGATCGACCACGAGGACATCACCAAGGATAAAACTTCCACCGTCGAGG<br>CCTGCCTGCCCTTGGAGCTGACCAAGAATGAATCCTGTCTGAACAGCAGGGAGACCTCGTT<br>TATCACCAATGGCAGCTGCCTCGCCTCCAGGAAGACCAGCTTCATGATGGCCCTCTGTCTG<br>AGCTCCATCTATGAGGACCTGAAGATGTACCAGGTGGAGTTCAAGACCATGAACGCGAAGC<br>TGCTGATGGACCCCAAGAGGCAGATCTTCCTGGATCAGAATATGCTGGCGGTGATCGACGA<br>GCTCATGCAGGCCCTCAATTTCAATAGCGAGACAGTGCCCCAGAAGTCCTCCCTGGAGGAG<br>CCCGACTTCTACAAGACCAAGATCAAGCTGTGTATCCTGCTGCACGCCTTCCGGATCCGGG<br>CCGTCACCATCGACCGGGTCATGAGCTACCTCAATGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1103 | hIL12AB_024 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTGATCTCCTGG<br>TTCTCCCTGGTGTTCCTGGCCTCGCCCCTGGTGGCCATCTGGGAGCTGAAGAAGGACGTGT<br>ACGTCGTGGAGCTCGACTGGTACCCCGACGCCCCTGGCGAGATGGTGGTGCTGACCTGCGA<br>CACCCCAGAGGAGGATGGCATCACCTGGACCCTGGATCAGTCCTCCGAGGTGCTGGGCTCC<br>GGCAAGACGCTGACCATCCAAGTGAAGGAGTTCGGTGACGCCGGACAGTATACCTGCCATA<br>AGGGCGGCGAGGTCCTGTCCCACAGCCTCCTCCTCCTGCATAAGAAGGAGGACGGCATCTG<br>GAGCACCGACATCCTGAAGGACCAGAAGGAGCCCAAGAACAAGACCTTTCTGAGGTGCGAG<br>GCCAAGAACTACAGCGGCCGATTCACCTGCTGGTGGCTCACCACCATATCCACCGACCTGA<br>CTTTCTCCGTCAAGTCCTCCCGGGGGTCCAGCGACCCCCAGGGAGTGACCTGCGGCGCCGC<br>CACCCTCAGCGCCGAGCGGGTGCGGGGGGACAACAAGGAGTACGAATACTCCGTCGAGTGC<br>CAGGAGGACTCCGCCTGCCCGGCCGCCGAGGAGAGCCTGCCCATCGAGGTGATGGTCGACG<br>CGGTGCACAAGCTGAAGTACGAGAACTACACCAGCAGTTTCTTCATCAGGGATATCATCAA<br>GCCAGATCCCCCGAAGAATCTGCAACTGAAGCCGCTGAAAAACTCACGACAGGTGGAGGTG<br>AGCTGGGAGTACCCCGACACGTGGAGCACCCCACATTCCTACTTCAGCCTGACCTTCTGCG<br>TGCAGGTCCAGGGCAAGAGCAAGCGGGAGAAGAAGGACAGGGTGTTCACGGATAAGACCAG<br>TGCCACCGTGATCTGCAGGAAGAACGCCTCTATTAGCGTGAGGGCCCAGGATCGGTATTAC<br>TCCTCGAGCTGGAGCGAATGGGCCTCCGTGCCCTGCAGTGGGGGGGGTGGAGGCGGGAGCA<br>GGAACCTGCCCGTAGCAACCCCCGACCCCGGGATGTTCCCCTGTCTGCACCACTCGCAGAA<br>CCTGCTGCGCGCGGTGAGCAACATGCTCCAAAAAGCCCGTCAGACCTTAGAGTTCTACCCC<br>TGCACCAGCGAAGAAATCGACCACGAAGACATCACCAAGGACAAAACCAGCACCGTGGAGG<br>CGTGCCTGCCGCTGGAGCTGACCAAGAACGAGAGCTGCCTCAACTCCAGGGAGACCAGCTT<br>TATCACCAACGGCTCGTGCCTAGCCAGCCGGAAAACCAGCTTCATGATGGCCCTGTGCCTG<br>AGCTCCATTTACGAGGACCTGAAGATGTATCAGGTGGAGTTCAAGACCATGAATGCCAAAC<br>TCCTGATGGACCCCAAGAGGCAGATCTTCCTGGACCAGAACATGCTCGCGGTGATCGATGA<br>GCTGATGCAGGCCCTGAACTTTAATAGCGAGACCGTGCCCCAGAAAAGCAGCCTGGAGGAG<br>CCGGACTTCTACAAGACCAAAATCAAGCTGTGCATCCTGCTCCACGCCTTCCGCATCCGGG<br>CCGTGACCATCGACAGGGTGATGAGCTACCTGAACGCCAGCTGATAATAGGCTGGAGCCTC |

TABLE 15-continued

Sequence Optimized IL12 Polynucleotides Comprising 5' UTR, ORF, and 3' UTR

| SEQ ID NO | Description | Sequence |
|---|---|---|
| | | GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1104 | hIL12AB_025 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCATCAGCAGCTGGTGATTTCCTGG<br>TTCTCCCTGGTGTTCCTGGCCAGCCCCCTCGTGGCGATCTGGGAGCTAAAGAAGGACGTGT<br>ACGTGGTGGAGCTGGACTGGTACCCGGACGCACCCGGCGAGATGGTCGTTCTGACCTGCGA<br>TACGCCAGAGGAGGACGGCATCACCTGGACCCTCGATCAGAGCAGCGAGGTCCTGGGGAGC<br>GGAAAGACCCTGACCATCCAGGTCAAGGAGTTCGGCGACGCCGGCCAGTACACCTGCCACA<br>AAGGTGGCGAGGTCCTGAGCCACTCGCTGCTGCTCCTGCATAAGAAGGAGGACGGAATCTG<br>GAGCACAGACATCCTGAAAGACCAGAAGGAGCCCAAGAACAAGACCTTCCTGAGGTGCGAG<br>GCCAAGAACTACAGCGGGCGCTTCACGTGCTGGTGGCTGACCACCATCAGCACGGACCTCA<br>CCTTCTCCGTGAAGAGCAGCCGGGGATCCAGCGATCCCCAAGGCGTCACCTGCGGCGCGGC<br>CACCCTGAGCGCGGAGAGGGTCAGGGGCGATAATAAGGAGTATGAGTACAGCGTGGAGTGC<br>CAGGAGGACAGCGCCTGCCCGGCCGCCGAGGAGTCCCTGCCAATCGAAGTGATGGTCGACG<br>CCGTGCACAAGCTGAAGTACGAGAACTACACCAGCAGCTTCTTCATCCGGGATATCATCAA<br>GCCCGATCCCCCGAAGAACCTGCAGCTGAAGCCCCTCAAGAACAGCCGGCAGGTGGAGGTG<br>AGTTGGGAGTACCCCGACACCTGGTCAACGCCCCACAGCTACTTCTCCCTGACCTTCTGTG<br>TGCAGGTGCAGGGAAAGAGCAAGAGGGAGAAGAAAGACCGGGTCTTCACCGACAAGACCAG<br>CGCCACGGTGATCTGCAGGAAGAACGCAAGCATCTCCGTGAGGGCCCAGGACAGGTACTAC<br>AGCTCCAGCTGGTCCGAATGGGCCAGCGTGCCCTGTAGCGGCGGCGGGGGCGGTGGCAGCC<br>GCAACCTCCCAGTGGCCACCCCCGACCCCGGCATGTTCCCCTGCCTGCACCACAGCCAGAA<br>TCTGCTGAGGGCCGTGAGTAACATGCTGCAGAAGGCAAGGCAAACCCTCGAATTCTATCCC<br>TGCACCTCCGAGGAGATCGACCACGAGGATATCACCAAGGACAAGACCAGCACCGTCGAGG<br>CCTGTCTCCCCCTGGAGCTGACCAAGAATGAGAGCTGCCTGAACAGCCGGGAGACCAGCTT<br>CATCACCAACGGGAGCTGCCTGGCCTCCAGGAAGACCTCGTTCATGATGGCGCTGTGCCTC<br>TCAAGCATATACGAGGATCTGAAGATGTACCAGGTGGAGTTTAAGACGATGAACGCCAAGC<br>TGCTGATGGACCCGAAGAGGCAGATCTTCCTGGACCAGAACATGCTGGCCGTGATAGACGA<br>GCTCATGCAGGCCCTGAACTTCAACTCCGAGACCGTGCCGCAGAAGTCATCCCTCGAGGAG<br>CCCGACTTCTATAAGACCAAGATCAAGCTGTGCATCCTGCTCCACGCCTTCCGGATAAGGG<br>CCGTGACGATCGACAGGGTGATGAGCTACCTTAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1105 | hIL12AB_026 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTCGTGATCAGCTGG<br>TTCTCCCTGGTGTTTCTCGCCAGCCCCCTGGTGGCCATCTGGGAGCTGAAGAAGGACGTGT<br>ACGTGGTGGAGCTGGACTGGTACCCTGACGCCCCGGGGGAGATGGTCGTGCTGACCTGCGA<br>CACCCCCGAAGAGGACGGTATCACCTGGACCCTGGACCAGTCCAGCGAGGTGCTGGGCAGC<br>GGCAAGACCCTGACTATTCAAGTCAAGGAGTTCGGAGACGCCGGCCAGTACACCTGCCACA<br>AGGGTGGAGAGGTGTTATCACACAGCCTGCTGCTGCTGCACAAGAAGGAAGACGGGATCTG<br>GAGCACCGACATCCTGAAGGACCAGAAGGAGCCCAAAAACAAGACCTTCCTGCGGTGCGAG<br>GCCAAGAACTATTCGGGCCGCTTTACGTGCTGGTGGCTGACCACCATCAGCACTGATCTCA<br>CCTTCAGCGTGAAGTCCTCCCGGGGGTCGTCCGACCCCCAGGGGGTGACCTGCGGGGCCGC<br>CACCCTGTCCGCCGAGAGAGTGAGGGGCGATAATAAGGAGTACGAGTACAGCGTTGAGTGC<br>CAGGAAGATAGCGCCTGTCCCGCCGCCGAGGAGAGCCTGCCCATCGAGGTGATGGTGGACG<br>CCGTCCACAAGCTGAAGTATGAGAACTACACCTCAAGCTTCTTCATCAGGGACATCATCAA<br>ACCCGATCCGCCCAAGAATCTGCAGCTGAAGCCCCTGAAAAATAGCAGGCAGGTGGAGGTG<br>AGCTGGGAGTACCCCGACACCTGGTCCACCCCCCATAGCTATTTCTCCCTGACGTTCTGCG<br>TGCAGGTGCAAGGGAAGAGCAAGCGGGAGAAGAAGGACCGGGTGTTCACCGACAAGACCTC<br>CGCCACCGTGATCTGTAGGAAGAACGCGTCGATCTCGGTCAGGGCCCAGGACAGGTATTAC<br>AGCAGCAGCTGGAGCGAGTGGGCGAGCGTGCCCTGCTCGGGCGGCGGCGGCGGCGGGAGCA<br>GAAATCTGCCCGTGGCCACCCCAGACCCCGGAATGTTCCCCTGCCTGCACCATTCGCAGAA<br>CCTCCTGAGGGCCGTGAGCAACATGCTGCAGAAGGCCCGCCAGACGCTGGAGTTCTACCCC<br>TGCACGAGCGAGGAGATCGACCACGAAGACATCACCAAGGACAAAACCAGCACCGTGGAGG<br>CCTGCCTGCCCCTGGAGCTGACCAAAAACGAATCCTGCCTCAACAGCCGGGAGACCAGCTT<br>CATCACCAACGGCAGCTGCCTGGCCAGCCGAAAGACCTCCTTCATGATGGCCCTCTGCCTG<br>AGCAGCATCTATGAGGATCTGAAGATGTATCAGGTGGAGTTCAAGACCATGAATGCCAAGC<br>TGCTGATGGACCCCAAGAGGCAGATATTCCTGGACCAGAATATGCTGGCCGTGATCGACGA<br>GCTGATGCAGGCCCTGAACTTCAACAGCGAGACCGTCCCCCAGAAGTCCAGCCTGGAGGAG<br>CCGGACTTTTACAAAACGAAGATCAAGCTGTGCATACTGCTGCACGCCTTCAGGATCCGGG<br>CCGTGACAATCGACAGGGTGATGTCCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1106 | hIL12AB_027 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAGCAGCTGGTGATCAGCTGG<br>TTCTCCCTGGTGTTCCTGGCCAGCCCCCTGGTGGCCATCTGGGAGCTCAAGAAGGACGTCT<br>ACGTCGTGGAGCTGGATTGGTACCCCGACGCTCCCGGGGAGATGGTGGTGCTGACCTGCGA<br>CACCCCCGAGGAGGACGGCATCACCTGGACGCTGGACCAGAGCTCAGAGGTGCTGGGAAGC<br>GGAAAGACACTGACCATCCAGGTGAAGGAGTTCGGGGATGCCGGGCAGTATACCTGCCACA<br>AGGGCGGCGAAGTGCTGAGCCATTCCCTGCTGCTGCTGCACAAGAAGGAGGACGGCATATG<br>GTCCACCGACATCCTGAAGGATCAGAAGGAGCCGAAGAATAAAACCTTCCTGAGGTGCGAG<br>GCCAAGAATTACAGCGGCCGATTCACCTGCTGGTGGCTGACCACCATCAGCACCGACCTGA<br>CCTTCAGTGTGAAGTCCTCACGGGGCAGCTCAGATCCCCAGGGCGTGACCTGCGGGGCCGC<br>GACACTCAGCGCCGAGCGGGTGAGGGGTGATAACAAGGAGTACGAGTATTCTGTGGAGTGC |

TABLE 15-continued

Sequence Optimized IL12 Polynucleotides Comprising 5' UTR, ORF, and 3' UTR

| SEQ ID NO | Description | Sequence |
|---|---|---|
| | | CAGGAAGACTCCGCCTGTCCCGCCGCCGAGGAGTCCCTGCCCATCGAGGTGATGGTGGACG<br>CCGTGCATAAACTGAAGTACGAGAACTACACCTCCAGCTTCTTCATCCGGGATATAATCAA<br>GCCCGACCCTCCGAAAAACCTGCAGCTGAAGCCCCTTAAAAACAGCCGGCAGGTGGAGGTG<br>AGCTGGGAGTACCCCGACACCTGGAGCACCCCCCATAGCTATTTCAGCCTGACCTTCTGCG<br>TGCAGGTGCAGGGGAAGTCCAAGCGCGAGAAAAAGGACCGGGTGTTCACCGACAAGACGAG<br>CGCCACCGTGATCTGCCGGAAGAACGCCAGTATAAGCGTAAGGGCCCAGGATAGGTACTAC<br>AGCTCCAGCTGGTCGGAGTGGGCCTCCGTGCCCTGTTCCGGCGGCGGGGGGGTGGCAGCA<br>GGAACCTCCCCGTGGCCACGCCGGACCCCGGCATGTTCCCGTGCCTGCACCACTCCCAAAA<br>CCTCCTGCGGGCCGTCAGCAACATGCTGCAAAAGGCGCGGCAGACCCTGGAGTTTTACCCC<br>TGTACCTCCGAAGAGATCGACCACGAGGATATCACCAAGGATAAGACCTCCACCGTGGAGG<br>CCTGTCTCCCCCTGGAGCTGACCAAGAACGAGAGCTGTCTTAACAGCAGAGAGACCTCGTT<br>CATAACGAACGGCTCCTGCCTCGCTTCCAGGAAGACGTCGTTCATGATGGCGCTGTGCCTG<br>TCCAGCATCTACGAGGACCTGAAGATGTATCAGGTCGAGTTCAAAACCATGAACGCCAAGC<br>TGCTGATGGACCCCAAGAGGCAGATCTTCCTGGACCAGAACATGCTCGCCGTGATCGACGA<br>GCTGATGCAGGCCCTGAACTTCAACAGCGAAACCGTGCCCCAGAAGTCAAGCCTGGAGGAG<br>CCGGACTTCTATAAGACCAAGATCAAGCTGTGTATCCTGCTACACGCTTTTCGTATCCGGG<br>CCGTGACCATCGACAGGGTTATGTCGTACTTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1107 | hIL12AB_028 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAACAGCTCGTGATCAGCTGG<br>TTCAGCCTGGTGTTCCTGGCCAGCCCGCTGGTGGCCATCTGGGAGCTGAAGAAGGACGTGT<br>ACGTGGTGGAGCTGGACTGGTACCCCGACGCCCCCGGCGAGATGGTGGTCCTGACCTGCGA<br>CACGCCGGAAGAGGACGGCATCACCTGGACCCTGGATCAGTCCAGCGAGGTGCTGGGCTCC<br>GGCAAGACCCTGACCATTCAGGTGAAGGAGTTCGGCGACGCCGGTCAGTACACCTGCCACA<br>AGGGCGGCGAGGTGCTGAGCCACAGCCTACTGCTCCTGCACAAAAAGGAGGATGGAATCTG<br>GTCCACCGACATCCTCAAGGACCAGAAGGAGCCGAAGAACAAGACGTTCCTCCGGTGCGAG<br>GCCAAGAACTACAGCGGCAGGTTTACCTGCTGGTGGCTGACCACCATCAGCACCGACCTGA<br>CATTTTCCGTGAAGAGCAGCCGCGGCAGCAGCGATCCCCAGGGCGTGACCTGCGGGGCGGC<br>CACCCTGTCCGCCGAGCGTGTGAGGGGCGACAACAAGGAGTACGAGTACAGCGTGGAATGC<br>CAGGAGGACAGCGCCTGTCCCGCCGCCGAGGAGAGCCTGCCAATCGAGGTCATGGTGGACG<br>CCGTGCACAAGCTGAAGTACGAGAACTACACGAGCAGCTTCTTCATCAGGGACATCATCAA<br>ACCGGACCCGCCCAAGAACCTGCAGCTGAAACCCTTGAAAAACAGCAGGCAGGTGGAAGTG<br>TCTTGGGAGTACCCCGACACCTGGTCCACCCCCCACAGCTACTTTAGCCTGACCTTCTGTG<br>TGCAGGTCCAGGGCAAGTCCAAGAGGGAGAAGAAGGACAGGGTGTTCACCGACAAAACCAG<br>CGCCACCGTGATCTGCAGGAAGAACGCCTCCATCAGCGTGCGGGCCCAGGACAGGTATTAC<br>AGCTCGTCGTGGAGCGAGTGGGCCAGCGTGCCCTGCTCCGGGGGAGGCGGCGGCGGAAGCC<br>GGAATCTGCCCGTGGCCACCCCCGATCCCGGCATGTTCCCGTGTCTGCACCACAGCCAGAA<br>CCTGCTGCGGGCCGTGAGCAACATGCTGCAGAAGGCCCGCCAAACCCTGGAGTTCTACCCC<br>TGTACAAGCGAGGAGATCGACCATGAGGACATTACCAAGGACAAGACCAGCACCGTGGAGG<br>CCTGCCTGCCCCTCGAGCTCACAAAGAACGAATCCTGCCTGAATAGCCGCGAGACCAGCTT<br>TATCACGAACGGGTCCTGCCTCGCCAGCCGGAAGACAAGCTTCATGATGGCCCTGTGCCTG<br>AGCAGCATCTACGAGGACCTGAAAATGTACCAAGTGGAGTTCAAAACGATGAACGCCAAGC<br>TGCTGATGGACCCCAAGCGCCAGATCTTCCTGGACCAGAACATGCTGGCCGTCATCGACGA<br>GCTCATGCAGGCCCTGAACTTCAACAGCGAGACCGTGCCCCAGAAGAGCAGCCTGGAGGAG<br>CCCGACTTCTACAAGACGAAGATCAAGCTCTGCATCCTGCTGCACGCTTTCCGCATCCGCG<br>CGGTGACCATCGACCGGGTGATGAGCTACCTCAACGCCAGTTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1108 | hIL12AB_029 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAACAGCTGGTGATCAGCTGG<br>TTCAGCCTGGTGTTTCTGGCCTCCCCTCTGGTGGCCATCTGGGAGCTGAAGAAGGACGTGT<br>ACGTGGTGGAGCTGGACTGGTACCCTGACGCCCCCGGCGAAATGGTGGTGCTGACGTGCGA<br>CACCCCCGAGGAGGATGGCATCACCTGGACCCTGGACCAAAGCAGCGAGGTCCTCGGAAGC<br>GGCAAGACCCTCACTATCCAAGTGAAGGAGTTCGGGGATGCGGGCCAGTACACCTGCCACA<br>AGGGCGGCGAGGTGCTGTCTCATAGCCTGCTGCTCCTGCATAAGAAGGAAGACGGCATCTG<br>GAGCACCGACATACTGAAGGATCAGAAGGAGCCCAAGAACAAGACCTTCCTGAGGTGCGAG<br>GCCAAGAACTACTCCGGGCGCTTCACCTGTTGGTGGCTGACCACCATCTCCACCGACCTGA<br>CCTTCAGCGTGAAGAGCAGCAGGGGGAGCAGCGACCCCCAGGGGGTGACCTGCGGAGCCGC<br>GACCTTGTCGGCCGAGCGGGTGAGGGGCGACAATAAGGAGTACGAGTACTCGGTCGAATGC<br>CAGGAGGACTCCGCCTGCCCCGCCGCCGAGGAGTCCCTCCCCATCGAAGTGATGGTGGACG<br>CCGTCCACAAGCTGAAGTACGAGAACTACACCAGCAGCTTCTTCATACGGGATATCATCAA<br>GCCCGACCCCCCGAAGAACCTGCAGCTGAAACCCTTGAAGAACTCCAGGCAGGTGGAGGTG<br>AGCTGGGAGTACCCCGACACCTGGTCCACCCCGCACTCATACTTCAGCCTGACCTTCTGTG<br>TACAGGTCCAGGGCAAGAGCAAGAGGGAAAAGAAGGATAGGGTGTTCACCGACAAGACCTC<br>CGCCACGGTGATCTGTCGGAAAAACGCCAGCATCTCCGTGCGGGCCCAGGACAGGTACTAT<br>TCCAGCAGCTGGAGCGAGTGGGCCTCCGTCCCCTGCTCCGGCGGCGGTGGCGGGGGCAGCA<br>GGAACCTCCCCGTGGCCACCCCCGATCCCGGGATGTTCCCATGCCTGCACCACAGCCAAAA<br>CCTGCTGAGGGCCGTCTCCAATATGCTGCAGAAGGCGAGGCAGACCCTGGAGTTCTACCCC<br>TGTACCTCCGAGGAGATCGACCACGAGGATATCACCAAGGACAAGACCTCCACGGTCGAGG<br>CGTGCCTGCCCCTGGAGCTCACGAAGAACGAGAGCTGCCTTAACTCCAGGGAAACCTCGTT<br>TATCACGAACGGCAGCTGCCTGGCGTCACGGAAGACCTCCTTTATGATGGCCCTATGTCTG<br>TCCTCGATCTACGAGGACCTGAAGATGTACCAGGTGGAGTTCAAGACCATGAACGCCAAGC<br>TGCTGATGGATCCCAAGAGGCAGATTTTCCTGGACCAGAACATGCTGGCCGTGATTGACGA |

TABLE 15-continued

Sequence Optimized IL12 Polynucleotides Comprising 5' UTR, ORF, and 3' UTR

| SEQ ID NO | Description | Sequence |
|---|---|---|
| | | GCTGATGCAGGCGCTGAACTTCAACAGCGAGACAGTGCCGCAGAAGAGCTCCCTGGAGGAG<br>CCGGACTTTTACAAGACCAAGATAAAGCTGTGCATCCTGCTCCACGCCTTCAGAATACGGG<br>CCGTCACCATCGATAGGGTGATGTCTTACCTGAACGCCTCCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1109 | hIL12AB_030 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTGGTGATTAGCTGG<br>TTTAGCCTGGTGTTCCTGGCAAGCCCCCTGGTGGCCATCTGGGAACTGAAAAAGGACGTGT<br>ACGTGGTCGAGCTGGATTGGTACCCCGACGCCCCCGGCGAAATGGTGGTGCTGACGTGTGA<br>TACCCCCGAGGAGGACGGGATCACCTGGACCCTGGATCAGAGCAGCGAGGTGCTGGGGAGC<br>GGGAAGACCCTGACGATCCAGGTCAAGGAGTTCGGCGACGCTGGGCAGTACACCTGTCACA<br>AGGGCGGGGAGGTGCTGTCCCACTCCCTGCTGCTCCTGCATAAGAAAGAGGACGGCATCTG<br>GTCCACCGACATCCTCAAGGACCAGAAGGAGCCCAAGAACAAGACCTTCCTGCGGTGTGAG<br>GCGAAGAACTACAGCGGCCGTTTCACCTGCTGGTGGCTGACGACAATCAGCACCGACTTGA<br>CGTTCTCCGTGAAGTCCTCCAGAGGCAGCTCCGACCCCCAAGGGGTGACGTGCGGCGCGGC<br>CACCCTGAGCGCCGAGCGGGTGCGGGGGGACAACAAGGAGTACGAGTACTCCGTGGAGTGC<br>CAGGAGGACAGCGCCTGTCCCGCAGCCGAGGAGTCCCTGCCCATCGAAGTCATGGTGGACG<br>CCGTCCACAAGCTGAAGTACGAGAACTACACCAGCAGCTTCTTCATCCGCGATATCATCAA<br>GCCCGATCCCCCCAAAAACCTGCAACTGAAGCCGCTGAAGAATAGCAGGCAGGTGGAGGTG<br>TCCTGGGAGTACCCGGACACCTGGAGCACGCCCCACAGCTATTTCAGCCTGACCTTTTGCG<br>TGCAGGTCCAGGGGAAGAGCAAGCGGGAGAAGAAGGACCGCGTGTTTACGGACAAAACCAG<br>CGCCACCGTGATCTGCAGGAAGAACGCCAGCATCAGCGTGAGGGCCCAGGACAGGTACTAC<br>AGCAGCTCCTGGAGCGAGTGGGCCTCCGTGCCCTGTTCCGGAGGCGGCGGGGGCGGTTCCC<br>GGAACCTCCCGGTGGCCACCCCCGACCCGGGCATGTTCCCGTGCCTGCACCACTCACAGAA<br>TCTGCTGAGGGCCGTGAGCAATATGCTGCAGAAGGCAAGGCAGACCCTGGAGTTTTATCCC<br>TGCACCAGCGAGGAGATCGACCACGAAGACATCACCAAGGACAAGACCAGCACAGTGGAGG<br>CCTGCCTGCCCCTGGAACTGACCAAGAACGAGTCCTGTCTGAACTCCCGGGAAACCAGCTT<br>CATAACCAACGGCTCCTGTCTCGCCAGCAGGAAGACCAGCTTCATGATGGCCCTGTGCCTC<br>AGCTCCATCTACGAGGACCTCAAGATGTACCAGGTTGAGTTCAAGACCATGAACGCCAAGC<br>TCCTGATGGACCCCAAGAGGCAGATCTTCCTGGACCAGAATATGCTGGCCGTGATCGATGA<br>GTTAATGCAGGCGCTGAACTTCAACAGCGAGACGGTGCCCCAAAAGTCCTCGCTGGAGGAG<br>CCCGACTTCTACAAGACCAAGATCAAGCTGTGCATCCTCCTGCACGCCTTCCGAATCCGGG<br>CCGTAACCATCGACAGGGTGATGAGCTATCTCAACGCCTCCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1110 | hIL12AB_031 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAGCAGCTCGTGATCAGCTGG<br>TTCTCGCTTGTGTTCCTGGCCTCCCCCCTCGTCGCCATCTGGGAGCTGAAGAAAGACGTGT<br>ACGTGGTGGAGCTGGACTGGTATCCCGACGCCCCGGGGGAGATGGTGGTGCTGACCTGCGA<br>CACCCCGGAAGAGGACGGCATCACCTGGACGCTCGACCAGTCGTCCGAAGTGCTGGGGTCG<br>GGCAAGACCCTCACCATCCAGGTGAAGGAGTTCGGAGACGCCGGCCAGTACACCTGTCATA<br>AGGGGGGGGAGGTGCTGAGCCACAGCCTCCTGCTCCTGCACAAAAAGGAGGACGGCATCTG<br>GAGCACCGATATCCTCAAGGACCAGAAGGAGCCCAAGAACAAGACGTTCCTGAGGTGTGAG<br>GCCAAGAACTACAGCGGGCGGTTCACGTGTTGGTGGCTCACCACCATCTCCACCGACCTCA<br>CCTTCTCCGTGAAGTCAAGCAGGGGCAGCTCCGACCCCCAAGGCGTCACCTGCGGCGCCGC<br>CACCCTGAGCGCCGAGAGGGTCAGGGGGGATAACAAGGAATACGAGTACAGTGTGGAGTGC<br>CAAGAGGATAGCGCCTGTCCCGCCGCCGAAGAGAGCCTGCCCATCGAAGTGATGGTGGACG<br>CCGTGCACAAGCTGAAGTACGAGAACTACACCTCCAGCTTCTTCATCAGGGATATCATCAA<br>GCCCGATCCCCCCAAGAACCTGCAGCTGAAGCCCCTGAAGAACAGCAGGCAGGTGGAGGTG<br>AGCTGGGAGTATCCCGACACGTGGAGCACCCCGCACAGCTACTTCTCGCTGACCTTCTGCG<br>TGCAGGTGCAAGGGAAGTCCAAGAGGGAGAAGAAGGATAGGGTGTTCACCGACAAAACGAG<br>CGCCACCGTGATCTGCCGGAAGAATGCCAGCATCTCTGTGAGGGCCCAGGACAGGTACTAT<br>TCCAGCTCCTGGTCGGAGTGGGCCAGCGTGCCCTGTAGCGGCGGGGGCGGGGGCGGCAGCA<br>GGAACCTCCCGGTTGCCACCCCCGACCCCGGCATGTTTCCGTGCCTGCACCACTCGCAAAA<br>CCTGCTGCGCGCGGTCTCCAACATGCTGCAAAAAGCGCGCCAGACGCTGGAGTTCTACCCC<br>TGCACCAGCGAGGAGATCGATCATGAAGATATCACCAAAGACAAGACCTCGACCGTGGAGG<br>CCTGCCTGCCCCTGGAGCTCACCAAGAACGAAAGCTGCCTGAACAGCAGGGAGACAAGCTT<br>CATCACCAACGGCAGCTGCCTGGCCTCCCGGAAGACCAGCTTCATGATGGCCCTGTGCCTG<br>TCCAGCATCTACGAGGATCTGAAGATGTACCAAGTGGAGTTTAAGACCATGAACGCCAAGC<br>TGTTAATGGACCCCAAAAGGCAGATCTTCCTGGATCAGAACATGCTGGCCGTCATCGACGA<br>GCTGATGCAAGCCCTGAACTTCAACAGCGAGACGGTGCCCCAGAAGAGCAGCCTCGAGGAG<br>CCCGACTTCTATAAGACCAAGATAAAGCTGTGCATTCTGCTGCACGCCTTCAGAATCAGGG<br>CCGTGACCATCGATAGGGTGATGAGCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1111 | hIL12AB_032 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGTCACCAGCAGCTGGTGATTTCCTGG<br>TTCAGTCTGGTGTTTCTTGCCAGCCCCCTGGTGGCCATCTGGGAGCTGAAGAAAGACGTAT<br>ACGTCGTGGAGCTGGACTGGTATCCCGACGCTCCCGGCGAGATGGTGGTCCTCACCTGCGA<br>CACCCCAGAGGAGGACGGCATCACCTGGACCCTGGACCAGAGCTCCGAGGTCCTGGGCAGC<br>GGTAAGACCCTCACCATCCAGGTGAAGGAGTTTGGTGATGCCGGGCAGTATACCTGCCACA<br>AGGGCGGCGAGGTGCTGTCCCACAGCCTCCTGTTACTGCATAAGAAGGAGGATGGCATCTG<br>GAGCACCGACATCCTCAAGGACCAGAAAGAGCCCAAGAACAAGACCTTTCTGCGGTGCGAG |

TABLE 15-continued

Sequence Optimized IL12 Polynucleotides Comprising 5' UTR, ORF, and 3' UTR

| SEQ ID NO | Description | Sequence |
|---|---|---|
| | | GCGAAAAATTACTCCGGCCGGTTCACCTGCTGGTGGCTGACCACCATCAGCACGGACCTGA |
| | | CGTTCTCCGTGAAGTCGAGCAGGGGGAGCTCCGATCCCCAGGGCGTGACCTGCGGCGCGGC |
| | | CACCCTGAGCGCCGAGCGCGTCCGCGGGGACAATAAGGAATACGAATATAGCGTGGAGTGC |
| | | CAGGAGGACAGCGCCTGCCCCGCGGCCGAGGAGAGCCTCCCGATCGAGGTGATGGTGGATG |
| | | CCGTCCACAAGCTCAAATACGAAAACTACACCAGCAGCTTCTTCATTAGGGACATCATCAA |
| | | GCCCGACCCCCCCAAAAACCTGCAGCTGAAGCCCCTGAAGAACAGCCGCCAGGTCGAGGTG |
| | | TCATGGGAGTACCCAGACACCTGGAGCACCCCCCACTCCTACTTCAGCCTGACCTTCTGCG |
| | | TCCAGGTGCAGGGAAAGTCCAAACGGGAGAAGAAGGATAGGGTCTTTACCGATAAGACGTC |
| | | GGCCACCGTCATCTGCAGGAAGAACGCCAGCATAAGCGTGCGGGCGCAGGATCGGTACTAC |
| | | AGCTCGAGCTGGTCCGAATGGGCCTCCGTGCCCTGTAGCGGAGGGGGTGGCGGGGGCAGCA |
| | | GGAACCTGCCCGTGGCCACCCCGGACCCGGGCATGTTTCCCTGCCTGCATCACAGTCAGAA |
| | | CCTGCTGAGGGCCGTGAGCAACATGCTCCAGAAGGCCCGCCAGACCCTGGAGTTTTACCCC |
| | | TGCACCAGCGAAGAGATCGATCACGAAGACATCACCAAAGACAAGACCTCCACCGTGGAGG |
| | | CCTGTCTGCCCCTGGAGCTGACCAAGAACGAGAGCTGTCTGAACAGCAGGGAGACCTCCTT |
| | | CATCACCAACGGCTCCTGCCTGGCATCCCGGAAGACCAGCTTCATGATGGCCCTGTGTCTG |
| | | AGCTCTATCTACGAGGACCTGAAGATGTACCAGGTCGAGTTCAAGACCATGAACGCCAAGC |
| | | TGCTGATGGACCCCAAGCGACAGATATTCCTGGACCAGAACATGCTCGCCGTGATCGATGA |
| | | ACTGATGCAAGCCCTGAACTTCAATAGCGAGACCGTGCCCCAGAAAAGCAGCCTGGAGGAG |
| | | CCCGACTTCTACAAGACCAAGATCAAACTGTGCATACTGCTGCACGCGTTCAGGATCCGGG |
| | | CCGTCACCATCGACCGGGTGATGTCCTATCTGAATGCCAGCTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1112 | hIL12AB_033 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAGCAGCTCGTGATTAGCTGG |
| | | TTTTCGCTGGTGTTCCTGGCCAGCCCTCTCGTGGCCATCTGGGAGCTGAAAAAAGACGTGT |
| | | ACGTGGTGGAGCTGGACTGGTACCCGGACGCCCCCGGCGAGATGGTGGTGCTGACGTGCGA |
| | | CACCCCGGAAGAGGACGGCATCACCTGGACCCTGGACCAGTCATCCGAGGTCCTGGGCAGC |
| | | GGCAAGACGCTCACCATCCAGGTGAAGGAGTTCGGCGACGCCGGCCAGTACACATGCCATA |
| | | AGGGCGGGGAGGTGCTGAGCCACAGCCTGCTCCTCCTGCACAAGAAGGAGGATGGCATCTG |
| | | GTCTACAGACATCCTGAAGGACCAGAAAGAGCCCAAGAACAAGACCTTCCTCCGGTGCGAG |
| | | GCCAAGAACTACTCCGGGCGGTTTACTTGTTGGTGGCTGACCACCATCAGCACCGACCTCA |
| | | CCTTCAGCGTGAAGAGCTCCCGAGGGAGCTCCGACCCCCAGGGGGTCACCTGCGGCGCCGC |
| | | CACCCTGAGCGCCGAGCGGGTGAGGGGCGACAACAAGGAGTATGAATACAGCGTGGAATGC |
| | | CAAGAGGACAGCGCCTGTCCCGCGGCCGAGGAAAGCCTGCCCATCGAGGTGATGGTGGACG |
| | | CCGTCCACAAACTCAAGTACGAGAACTACACCAGCAGTTTCTTCATTCGCGACATCATCAA |
| | | GCCGGACCCCCCCAAAAACCTGCAGCTCAAACCCCTGAAGAACAGCAGGCAGGTGGAGGTC |
| | | AGCTGGGAGTACCCGGACACCTGGAGCACCCCCCATAGCTACTTCAGCCTGACCTTCTGCG |
| | | TGCAGGTGCAGGGCAAGAGCAAACGCGAGAAGAAGGACCGGGTGTTTACCGACAAGACCAG |
| | | CGCCACGGTGATCTGCCGAAAGAATGCAAGCATCTCCGTGAGGGCGCAGGACCGCTACTAC |
| | | TCTAGCAGCTGGAGCGAGTGGGCCAGCGTGCCCTGCAGCGGTGGCGGCGGAGGCGGCAGCC |
| | | GTAACCTCCCCGTGGCCACCCCCGACCCCGGCATGTTCCCGTGTCTGCACCACTCCCAGAA |
| | | CCTGCTGAGGGCCGTCAGCAATATGCTGCAGAAGGCCCGGCAGACGCTGGAGTTCTACCCC |
| | | TGCACCTCCGAGGAGATCGACCATGAGGACATTACCAAGGACAAGACGAGCACTGTGGAGG |
| | | CCTGCCTGCCCCTGGAGCTCACCAAAAACGAGAGCTGCCTGAATAGCAGGGAGACGTCCTT |
| | | CATCACCAACGGCAGCTGTCTGGCCAGCAGGAAGACCAGCTTCATGATGGCCCTGTGCCTC |
| | | TCCTCCATATATGAGGATCTGAAGATGTACCAGGTGGAGTTCAAGACCATGAACGCCAAGC |
| | | TGCTGATGGATCCCAAGAGGCAGATCTTCCTGGACCAGAATATGCTGGCCGTGATTGACGA |
| | | GCTGATGCAGGCCCTGAACTTTAATAGCGAGACCGTCCCCCAGAAGAGCAGCCTGGAGGAG |
| | | CCCGACTTCTATAAGACCAAGATCAAGCTGTGCATACTGCTGCACGCGTTTAGGATAAGGG |
| | | CCGTCACCATCGACAGGGTGATGAGCTACCTGAATGCCAGCTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1113 | hIL12AB_034 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAACAGCTGGTGATCTCCTGG |
| | | TTCAGCCTGGTGTTCCTCGCCAGCCCCCTGGTGGCCATCTGGGAGCTGAAGAAAGACGTGT |
| | | ACGTGGTGGAGCTGGACTGGTATCCCGACGCCCCCGGCGAGATGGTCGTGCTGACCTGCGA |
| | | CACCCCGGAGGAGGACGGCATCACCTGGACCCTGGATCAGTCCTCCGAGGTGCTGGGCAGC |
| | | GGGAAGACCCTGACCATCCAGGTGAAAGAGTTCGGAGATGCCGGCCAGTATACCTGTCACA |
| | | AGGGGGGTGAGGTGCTGAGCCATAGCCTCTTGCTTCTGCACAAGAAGGAGGACGGCATCTG |
| | | GTCCACCGACATCCTCAAGGACCAAAAGGAGCCGAAGAATAAAACGTTCCTGAGGTGCGAA |
| | | GCCAAGAACTATTCCGGACGGTTCACCTGCTGGTGGCTGACCACCATCAGCACCGACCTCA |
| | | CCTTCTCCGTAAAGTCAAGCAGGGGCAGCTCCGACCCCCAGGGCGTGACCTGCGGAGCCGC |
| | | CACCCTGAGCGCAGAGAGGGTGAGGGGCGACAACAAGGAGTACGAATACTCCGTCGAGTGC |
| | | CAGGAGGACAGCGCCTGCCCCGCCGCCGAGGAAAGTCTGCCCATCGAGGTGATGGTGGACG |
| | | CCGTGCACAAGCTCAAATACGAGAACTACACCAGCAGCTTCTTCATCCGGGATATCATCAA |
| | | GCCCGACCCTCCAAAGAATCTGCAGCTGAAACCCCTTAAGAACAGCAGGCAGGTGGAGGTC |
| | | AGCTGGGAGTACCCCGACACCTGGAGCACGCCCCACTCCTACTTTAGCCTGACCTTTTGCG |
| | | TGCAGGTGCAGGGGAAAAGCAAGCGGGAGAAGAAGGACAGGGTGTTCACCGATAAGACCTC |
| | | CGCTACCGTGATCTGCAGGAAGAACGCCTCAATCAGCGTGAGGGCCCAGGATCGGTACTAC |
| | | TCCAGCTCCTGGAGCGAGTGGGCCAGCGTGCCCTGCTCTGGCGGTGGCGGCGGGGGCAGCC |
| | | GGAACCTGCCGGTGGCCACTCCCGACCCGGGCATGTTCCCGTGCCTCCACCATTCCCAGAA |
| | | CCTGCTGCGGGCCGTGTCCAATATGCTCCAGAAGGCAAGGCAGACCCTGGAGTTCTACCCC |
| | | TGCACCAGCGAGGAGATCGATCACGAGGACATCACCAAAGACAAAACCAGCACGGTCGAGG |
| | | CCTGCCTGCCCCTGGAACTCACCAAGAACGAAAGCTGTCTCAACAGCCGCGAGACCAGCTT |

TABLE 15-continued

| Sequence Optimized IL12 Polynucleotides Comprising 5' UTR, ORF, and 3' UTR | | |
|---|---|---|
| SEQ ID NO | Description | Sequence |
| | | CATAACCAACGGTTCCTGTCTGGCCTCCCGCAAGACCAGCTTTATGATGGCCCTCTGTCTG<br>AGCTCCATCTATGAAGACCTGAAAATGTACCAGGTGGAGTTCAAAACCATGAACGCCAAGC<br>TTCTGATGGACCCCAAGAGGCAGATCTTCCTGGATCAGAACATGCTGGCCGTGATCGACGA<br>GCTGATGCAGGCCCTGAACTTTAACTCCGAGACCGTGCCCCAGAAAAGCAGCCTGGAAGAG<br>CCCGATTTCTACAAAACGAAGATCAAGCTGTGCATCCTGCTGCACGCCTTCCGGATCCGTG<br>CGGTGACCATCGATAGGGTGATGAGCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1114 | hIL12AB_035 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAACAGCTGGTAATCAGCTGG<br>TTCAGCCTGGTTTTCCTCGCGTCGCCCCTGGTGGCCATCTGGGAGTTAAAGAAGGACGTGT<br>ACGTGGTGGAGCTGGATTGGTACCCCGACGCCCCGGGCGAGATGGTCGTGCTCACCTGCGA<br>TACCCCCGAGGAGGACGGGATCACCTGGACCCTGGACCAATCCAGCGAGGTGCTGGGCAGC<br>GGCAAGACCCTGACCATACAGGTGAAGGAATTTGGGGACGCCGGGCAGTACACCTGCCACA<br>AGGGCGGGGAAGTGCTGTCCCACTCCCTCCTGCTGCTGCATAAGAAGGAGGACGGCATCTG<br>GAGCACCGACATCCTGAAGGACCAAAAGGAGCCCAAGAACAAGACCTTCCTGAGGTGCGAG<br>GCCAAAAACTATTCCGGCCGCTTTACCTGTTGGTGGCTGACCACCATCTCCACCGATCTGA<br>CCTTCAGCGTGAAGTCGTCTAGGGGCTCCTCCGACCCCCAGGGCGTAACCTGCGGCGCCGC<br>GACCCTGAGCGCCGAGAGGGTGCGGGGCGATAACAAAGAGTACGAGTACTCGGTGGAGTGC<br>CAGGAGGACAGCGCCTGTCCGGCGGCCGAGGAGAGCCTGCCCATCGAGGTGATGGTGGACG<br>CCGTCCACAAGCTGAAGTACGAGAACTACACCAGTTCGTTCTTCATCAGGGACATCATCAA<br>GCCGGACCCCCCCAAGAACCTCCAGCTGAAGCCCCTGAAGAACAGCAGGCAGGTGGAAGTG<br>TCCTGGGAGTATCCCGACACCTGGAGCACCCCCCACAGCTACTTCAGCCTGACCTTTTGCG<br>TGCAGGTGCAGGGCAAAAGCAAGAGGGAAAAGAAGGACCGGGTGTTCACCGATAAGACGAG<br>CGCCACCGTTATCTGCAGGAAGAACGCCTCCATAAGCGTGAGGGCGCAGGACCGTTACTAC<br>AGCAGCAGCTGGAGTGAGTGGGCAAGCGTGCCCTGTAGCGGCGGGGGCGGGGGCGGGTCCC<br>GCAACCTCCCCGTCGCCACCCCCGACCCAGGCATGTTTCCGTGCCTGCACCACAGCCAGAA<br>CCTGCTGCGGGCCGTTAGCAACATGCTGCAGAAGGCCAGGCAGACCCTCGAGTTCTATCCC<br>TGCACATCTGAGGAGATCGACCACGAAGACATCACTAAGGATAAGACCTCCACCGTGGAGG<br>CCTGTCTGCCCCTCGAGCTGACCAAGAATGAATCCTGCCTGAACAGCCGAGAGACCAGCTT<br>TATCACCAACGGCTCCTGCCTGGCCAGCAGGAAGACCTCCTTCATGATGGCCCTGTGCCTC<br>TCCAGCATCTACGAGGATCTGAAGATGTACCAGGTAGAGTTCAAGACGATGAACGCCAAGC<br>TCCTGATGGACCCCAAGAGGCAGATATTCCTGGACCAGAACATGCTGGCGGTGATCGACGA<br>GCTGATGCAGGCCCTGAATTTCAACAGCGAGACGGTGCCACAGAAGTCCAGCCTGGAGGAG<br>CCAGACTTCTACAAGACCAAGATCAAACTGTGCATCCTCCTGCACGCGTTCAGGATCCGCG<br>CCGTCACCATAGACAGGGTGATGAGTTATCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1115 | hIL12AB_036 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCATCAGCAGCTGGTAATCAGCTGG<br>TTTAGCCTGGTGTTCCTGGCCAGCCCACTGGTGGCCATCTGGGAGCTGAAGAAGGACGTGT<br>ACGTGGTGGAACTGGACTGGTACCCCGACGCCCCTGGCGAGATGGTGGTACTGACCTGTGA<br>CACCCCGGAGGAAGACGGTATCACCTGGACCCTGGATCAGAGCTCCGAGGTGCTGGGCTCC<br>GGCAAGACACTGACCATCCAAGTTAAGGAATTTGGGGACGCCGGCCAGTACACCTGCCACA<br>AGGGGGGCGAGGTGCTGTCCCACTCCCTGCTGCTTCTGCATAAGAAGGAGGATGGCATCTG<br>GTCCACCGACATACTGAAGGACCAGAAGGAGCCCAAGAATAAGACCTTCCTGAGATGCGAG<br>GCCAAGAACTACTCGGGAAGGTTCACCTGCTGGTGGCTGACCACCATCAGCACCGACCTGA<br>CCTTCTCCGTGAAGAGCTCCCGGGGCAGCTCCGACCCCCAGGGCGTAACCTGTGGGGCCGC<br>TACCCTGTCCGCCGAGAGGGTCCGGGGCGACAACAAGGAATACGAGTACAGCGTGGAGTGC<br>CAGGAGGACTCCGCCTGCCCCGCCGCCGAGGAGTCGCTGCCCATAGAGGTGATGGTGGACG<br>CCGTGCACAAGCTCAAGTACGAGAATTACACCAGCAGCTTCTTTATCAGGGACATAATTAA<br>GCCGGACCCCCCCAAGAATCTGCAGCTGAAGCCCCTGAAGAATAGCCGGCAGGTGGAAGTG<br>TCCTGGGAGTACCCCGACACCTGGAGCACCCCCCACTCCTATTTCTCACTGACATTCTGCG<br>TGCAGGTGCAAGGGAAAAGCAAGAGGGAGAAGAAGGATAGGGTGTTCACCGACAAGACAAG<br>CGCCACCGTGATCTGCCGAAAAAATGCCAGCATCAGCGTGAGGGCCCAGGATCGGTATTAC<br>AGCAGCTCCTGGAGCGAGTGGGCCAGCGTGCCCTGTTCCGGCGGGGGAGGGGGCGGCTCCC<br>GGAACCTGCCGGTGGCCACCCCCGACCCTGGCATGTTCCCCTGCCTGCATCACAGCCAGAA<br>CCTGCTCCGGGCCGTGTCGAACATGCTGCAGAAGGCCCGGCAGACCCTCGAGTTTTACCCC<br>TGCACCAGCGAAGAGATCGACCACGAAGACATAACCAAGGACAAGACCAGCACGGTGGAGG<br>CCTGCCTGCCCCTGGAGCTTACCAAAAACGAGTCCTGCCTGAACAGCCGGGAAACCAGCTT<br>CATAACGAACGGGAGCTGCCTGGCCTCCAGGAAGACCAGCTTCATGATGGCGCTGTGTCTG<br>TCCAGCATATACGAGGATCTGAAGATGTATCAGGTGGAATTCAAAACTATGAATGCCAAGC<br>TCCTGATGGACCCCAAGAGGCAGATCTTCCTGGACCAGAACATGCTAGCCGTGATCGACGA<br>GCTGATGCAGGCCCTCAACTTCAACTCGGAGACGGTGCCCCAGAAGTCCAGCCTCGAGGAG<br>CCCGACTTCTACAAGACCAAGATCAAGCTGTGCATACTGCTGCATGCCTTCAGGATAAGGG<br>CGGTGACTATCGACAGGGTCATGTCCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1116 | hIL12AB_037 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCACCAACAACTGGTGATCAGCTGG<br>TTCTCCCTGGTGTTCCTGGCCAGCCCCCTGGTGGCCATCTGGGAGCTCAAAAAAGACGTGT<br>ACGTGGTGGAGCTCGATTGGTACCCAGACGCGCCGGGGGAAATGGTGGTGCTGACCTGCGA<br>CACCCCAGAGGAGGATGGCATCACGTGGACGCTGGATCAGTCCAGCGAGGTGCTGGGGAGC |

TABLE 15-continued

Sequence Optimized IL12 Polynucleotides Comprising 5' UTR, ORF, and 3' UTR

| SEQ ID NO | Description | Sequence |
|---|---|---|
| | | GGCAAGACGCTCACCATCCAGGTGAAGGAATTTGGCGACGCGGGCCAGTATACCTGTCACA |
| | | AGGGCGGCGAGGTGCTGAGCCACTCCCTGCTGCTGCTGCACAAGAAGGAGGATGGGATCTG |
| | | GTCAACCGATATCCTGAAAGACCAGAAGGAGCCCAAGAACAAGACCTTCCTGCGCTGCGAG |
| | | GCCAAGAACTATAGCGGCAGGTTCACCTGCTGGTGGCTGACCACCATCAGCACCGACCTGA |
| | | CCTTCAGCGTGAAATCCTCCAGGGGCAGCAGCGACCCCCAGGGCGTGACCTGCGGTGCCGC |
| | | CACGCTCTCCGCCGAGCGAGTGAGGGGTGACAACAAGGAGTACGAGTACAGCGTGGAATGT |
| | | CAGGAGGACAGCGCCTGTCCCGCCGCCGAGGAGTCGCTGCCCATCGAGGTGATGGTCGACG |
| | | CGGTGCACAAGCTCAAATACGAGAATTACACCAGCAGCTTCTTCATCAGGGACATCATCAA |
| | | GCCCGACCCCCCCAAGAACCTGCAGCTGAAGCCCTTGAAGAACAGCAGGCAGGTGGAGGTG |
| | | AGCTGGGAGTACCCGGACACCTGGAGCACCCCCCACTCCTACTTCAGCCTGACGTTCTGTG |
| | | TGCAGGTGCAGGGGAAGTCCAAGAGGGAGAAGAAGGACCGGGTGTTCACCGACAAGACCAG |
| | | CGCCACCGTGATATGCCGCAAGAACGCGTCCATCAGCGTTCGCGCCCAGGACCGCTACTAC |
| | | AGCAGCTCCTGGTCCGAATGGGCCAGCGTGCCCTGCAGCGGTGGAGGGGGCGGGGGCTCCA |
| | | GGAATCTGCCGGTGGCCACCCCCGACCCCGGGATGTTCCCGTGTCTGCATCACTCCCAGAA |
| | | CCTGCTGCGGGCCGTGAGCAATATGCTGCAGAAGGCCAGGCAGACGCTCGAGTTCTACCCC |
| | | TGCACCTCCGAAGAGATCGACCATGAGGACATCACCAAGGACAAGACCAGCACCGTGGAGG |
| | | CCTGCCTCCCCCTGGAGCTGACCAAAAACGAGAGCTGCCTGAACTCCAGGGAGACCAGCTT |
| | | TATAACCAACGGCAGCTGCCTCGCCTCCAGGAAGACCTCGTTTATGATGGCCCTCTGCCTG |
| | | TCCAGCATCTACGAGGACCTGAAGATGTACCAGGTGGAGTTCAAGACCATGAACGCGAAGT |
| | | TGCTCATGGACCCCAAGAGGCAGATCTTCCTGGACCAGAACATGCTCGCGGTGATCGACGA |
| | | GCTGATGCAAGCCCTGAACTTCAACAGCGAGACCGTGCCCCAGAAGAGCAGCCTGGAAGAG |
| | | CCCGACTTCTACAAGACCAAGATCAAGCTGTGCATCCTGCTGCACGCCTTCCGGATCCGGG |
| | | CCGTGACCATCGACAGGGTGATGAGCTACCTCAACGCCTCCTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1117 | hIL12AB_038 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAGCAGCTCGTGATCAGCTGG |
| | | TTCTCCCTCGTCTTCCTGGCCTCCCCGCTGGTGGCCATCTGGGAGCTGAAGAAGGACGTGT |
| | | ACGTGGTGGAGCTGGACTGGTATCCCGACGCCCCCGGCGAGATGGTGGTGCTGACGTGCGA |
| | | CACACCAGAAGAGGACGGGATCACATGGACCCTGGATCAGTCGTCCGAGGTGCTGGGGAGC |
| | | GGCAAGACCCTCACCATCCAAGTGAAGGAGTTCGGGGACGCCGGCCAGTACACCTGCCACA |
| | | AGGGCGGGGAGGTGCTCTCCCATAGCCTGCTCCTCCTGCACAAAAAGGAGGATGGCATCTG |
| | | GAGCACCGACATCCTGAAGGACCAGAAGGAGCCCAAGAACAAGACATTTCTCAGGTGTGAG |
| | | GCCAAGAACTATTCGGGCAGGTTTACCTGTTGGTGGCTCACCACCATCTCTACCGACCTGA |
| | | CGTTCTCCGTCAAGTCAAGCAGGGGGAGCTCGGACCCCCAGGGGGTGACATGTGGGGCCGC |
| | | CACCCTGAGCGCGGAGCGTGTCCGCGGCGACAACAAGGAGTACGAGTATTCCGTGGAGTGC |
| | | CAGGAGGACAGCGCCTGCCCCGCCGCCGAGGAGTCCCTGCCCATAGAGGTGATGGTGGACG |
| | | CCGTCCACAAGTTGAAGTACGAAAATTATACCTCCTCGTTCTTCATTAGGGACATCATCAA |
| | | GCCTGACCCCCCGAAGAACCTACAACTCAAGCCCCTCAAGAACTCCCGCCAGGTGGAGGTG |
| | | TCCTGGGAGTACCCCGACACCTGGTCCACCCCGCACAGCTACTTCAGCCTGACCTTCTGCG |
| | | TGCAGGTCCAGGGGAAGAGCAAGCGTGAAAAGAAAGACAGGGTGTTCACCGACAAGACGAG |
| | | CGCCACCGTGATCTGCAGGAAAAACGCCTCCATCTCCGTGCGCGCCCAGGACAGGTACTAC |
| | | AGTAGCTCCTGGAGCGAATGGGCCAGCGTGCCGTGCAGCGGCGGGGGAGGAGGCGGCAGTC |
| | | GCAACCTGCCCGTGGCCACCCCCGACCCCGGCATGTTCCCATGCCTGCACCACAGCCAGAA |
| | | CCTGCTGAGGGCAGTCAGCAATATGCTGCAGAAGGCCAGGCAGACCCTGGAGTTTTATCCC |
| | | TGCACCAGCGAGGAGATCGACCACGAGGACATCACCAAGGACAAGACCTCCACCGTCGAGG |
| | | CCTGCCTGCCACTGGAGCTGACCAAAAACGAGAGCTGCCTGAACTCCAGGGAGACCTCCTT |
| | | CATCACCAACGGGAGCTGCCTGGCCAGCCGGAAGACCAGCTTCATGATGGCGCTGTGCCTC |
| | | AGCAGCATCTACGAGGATCTCAAGATGTACCAGGTGGAGTTCAAGACCATGAACGCGAAGC |
| | | TGCTGATGGACCCCAAGCGGCAGATCTTCCTGGACCAGAACATGCTGGCCGTGATTGACGA |
| | | GCTCATGCAGGCCCTGAACTTCAATAGCGAGACCGTCCCCCAAAAGAGCAGCCTGGAGGAA |
| | | CCCGACTTCTACAAAACGAAGATCAAGCTCTGCATCCTGCTGCACGCCTTCCGGATCCGGG |
| | | CCGTGACCATCGATCGTGTGATGAGCTACCTGAACGCCTCGTGATAATAGGCTGGAGCCTC |
| | | GGTGGCCATGCTTCTTGCCCCTTGGGCCTCCCCCCAGCCCCTCCTCCCCTTCCTGCACCCG |
| | | TACCCCCCAAACACCATTGTCACACTCCAGTGGTCTTTGAATAAAGTCTGAGTGGGCGGC |
| 1118 | hIL12AB_039 | TCAAGCTTTTGGACCCTCGTACAGAAGCTAATACGACTCACTATAGGGAAATAAGAGAGAA |
| | | AAGAAGAGTAAGAAGAAATATAAGAGCCACCATGTGCCACCAGCAGCTCGTCATCTCCTGG |
| | | TTTAGCCTGGTGTTTCTGGCCTCCCCCCTGGTCGCCATCTGGGAGCTGAAGAAAGACGTGT |
| | | ACGTGGTGGAGCTGGACTGGTACCCGGACGCTCCCGGGGAGATGGTGGTGCTGACCTGCGA |
| | | CACCCCCGAGGAGGACGGCATCACCTGGACCCTGGACCAGAGCTCCGAGGTGCTGGGGAGC |
| | | GGCAAGACCCTGACCATTCAGGTGAAAGAGTTCGGCGACGCCGGCCAATATACCTGCCACA |
| | | AGGGGGGGGAGGTCCTGTCGCATTCCCTGCTGCTGCTTCACAAAAAGGAGGATGGCATCTG |
| | | GAGCACCGACATCCTGAAGGACCAGAAAGAACCCAAGAACAAGACGTTCCTGCGCTGCGAG |
| | | GCCAAGAACTACAGCGGCCGGTTCACCTGTTGGTGGCTGACCACCATCTCCACCGACCTGA |
| | | CTTTCTCGGTGAAGAGCAGCCGCGGGAGCAGCGACCCCCAGGGAGTGACCTGCGGCGCCGC |
| | | CACCCTGAGCGCCGAAAGGGTGAGGGGCGACAATAAAGAGTACGAGTATTCCGTGGAGTGC |
| | | CAGGAGGACAGCGCCTGTCCCGCCGCCGAGGAGTCCCTGCCTATCGAGGTGATGGTCGACG |
| | | CGGTGCACAAGCTCAAGTACGAAAACTACACCAGCAGCTTTTTCATCAGGGATATCATCAA |
| | | ACCAGACCCCCCCAAGAACCTGCAGCTGAAGCCCCTGAAAAACAGCAGGCAGGTGGAAGTG |
| | | AGCTGGGAATACCCCGATACCTGGTCCACCCCCCACAGCTACTTCAGCCTGACCTTCTGCG |
| | | TGCAGGTGCAGGGGAAGTCCAAGCGGGAGAAGAAAGATCGGGTGTTCACGGACAAGACCAG |
| | | CGCCACCGTGATTTGCAGGAAAAACGCCAGCATCTCCGTGAGGGCTCAGGACAGGTACTAC |
| | | AGCTCCAGCTGGAGCGAGTGGGCCTCCGTGCCTTGCAGCGGGGGAGGAGGCGGCGGCAGCA |
| | | GGAATCTGCCCGTCGCAACCCCCGACCCCGGCATGTTCCCCTGCCTGCACCACAGCCAGAA |

TABLE 15-continued

| Sequence Optimized IL12 Polynucleotides Comprising 5' UTR, ORF, and 3' UTR | | |
|---|---|---|
| SEQ ID NO | Description | Sequence |
| | | TCTGCTGCGAGCCGTGAGCAACATGCTCCAGAAGGCCCGGCAGACGCTGGAGTTCTACCCC<br>TGCACCTCCGAGGAGATCGACCACGAGGACATCACCAAGGATAAGACGAGCACCGTCGAGG<br>CCTGTCTCCCCCTGGAGCTCACCAAGAACGAGTCCTGCCTGAATAGCAGGGAGACGTCCTT<br>CATAACCAACGGCAGCTGTCTGGCGTCCAGGAAGACCAGCTTCATGATGGCCCTCTGCCTG<br>AGCTCCATCTACGAGGACCTCAAGATGTACCAGGTCGAGTTCAAGACCATGAACGCAAAAC<br>TGCTCATGGATCCAAAGAGGCAGATCTTTCTGGACCAGAACATGCTGGCCGTGATCGATGA<br>ACTCATGCAGGCCCTGAATTTCAATTCCGAGACCGTGCCCCAGAAGAGCTCCCTGGAGGAA<br>CCCGACTTCTACAAAACAAAGATCAAGCTGTGTATCCTCCTGCACGCCTTCCGGATCAGGG<br>CCGTCACCATTGACCGGGTGATGTCCTACCTGAACGCCAGCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |
| 1119 | hIL12AB_040 | TCAAGCTTTTGGACCCTCGTACAGAAGCTAATACGACTCACTATAGGGAAATAAGAGAGAA<br>AAGAAGAGTAAGAAGAAATATAAGAGCCACCATGTGCCATCAGCAGCTGGTGATCAGCTGG<br>TTCAGCCTCGTGTTCCTCGCCAGCCCCCTCGTGGCCATCTGGGAGCTGAAAAAGGACGTGT<br>ACGTGGTGGAGCTGGACTGGTATCCCGACGCCCCGGGCGAGATGGTGGTGCTGACCTGCGA<br>CACCCCCGAGGAGGACGGCATTACCTGGACACTGGACCAGAGCAGCGAGGTCCTGGGCAGC<br>GGGAAGACCCTGACAATTCAGGTGAAGGAGTTCGGCGACGCCGGACAGTACACGTGCCACA<br>AGGGGGGGGAGGTGCTGTCCCACAGCCTCCTCCTGCTGCACAAGAAGGAGGATGGCATCTG<br>GAGCACCGACATCCTGAAGGATCAGAAGGAGCCCAAGAACAAGACCTTTCTGAGATGCGAG<br>GCCAAGAATTACAGCGGCCGTTTCACCTGCTGGTGGCTCACCACCATCAGCACCGACCTGA<br>CCTTCAGCGTGAAATCCTCCAGGGGCTCCTCCGACCCGCAGGGAGTGACCTGCGGCGCCGC<br>CACACTGAGCGCCGAGCGGGTCAGAGGGGACAACAAGGAGTACGAGTACAGCGTTGAGTGC<br>CAGGAGGACAGCGCCTGTCCCGCGGCCGAGGAATCCCTGCCCATCGAGGTGATGGTGGACG<br>CAGTGCACAAGCTGAAGTACGAGAACTATACCTCGAGCTTCTTCATCCGGGATATCATTAA<br>GCCCGATCCCCCGAAGAACCTGCAGCTCAAACCCCTGAAGAACAGCAGGCAGGTGGAGGTC<br>TCCTGGGAGTACCCCGACACATGGTCCACCCCCCATTCCTATTTCTCCCTGACCTTTTGCG<br>TGCAGGTGCAGGGCAAGAGCAAGAGGGAGAAAAAGGACAGGGTGTTCACCGACAAGACCTC<br>CGCCACCGTGATCTGCCGTAAGAACGCTAGCATCAGCGTCAGGGCCCAGGACAGGTACTAT<br>AGCAGCTCCTGGTCCGAGTGGGCCAGCGTCCCGTGCAGCGGCGGGGGCGGTGGAGGCTCCC<br>GGAACCTCCCCGTGGCCACCCCGGACCCCGGGATGTTTCCCTGCCTGCATCACAGCCAGAA<br>CCTGCTGAGGGCCGTGTCCAACATGCTGCAGAAGGCCAGGCAGACACTCGAGTTTTACCCC<br>TGCACCAGCGAGGAGATCGACCACGAAGACATCACCAAGGACAAGACCTCCACCGTGGAGG<br>CATGCCTGCCCCTGGAGCTGACCAAAAACGAAAGCTGTCTGAACTCCAGGGAGACCTCCTT<br>TATCACGAACGGCTCATGCCTGGCCTCCAGAAAGACCAGCTTCATGATGGCCCTGTGCCTG<br>AGCTCCATCTACGAGGACTTGAAAATGTACCAGGTCGAGTTCAAGACCATGAACGCCAAGC<br>TGCTCATGGACCCCAAAAGGCAGATCTTTCTGGACCAGAATATGCTGGCCGTGATCGACGA<br>GCTCATGCAAGCCCTGAATTTCAACAGCGAGACCGTGCCCCAGAAGTCCTCCCTGGAGGAG<br>CCCGACTTCTACAAGACCAAGATCAAGCTGTGCATACTCCTGCACGCGTTTAGGATCAGGG<br>CGGTGACCATCGATAGGGTGATGAGCTACCTGAATGCCTCCTGATAATAGGCTGGAGCCTC<br>GGTGGCCATGCTTCTTGCCCCTTGGGCCTCCCCCCAGCCCCTCCTCCCCTTCCTGCACCCG<br>TACCCCCCAAACACCATTGTCACACTCCAGTGGTCTTTGAATAAAGTCTGAGTGGGCGGC |

TABLE 16A

| mRNA Sequences (with T100 tail) | | |
|---|---|---|
| SEQ ID NO | Description | Sequence |
| 1120 | hIL12AB_001 | G*GGGAAATAAGAGAGAAAAGAAGAGTAAGAAGAAATATAAGAGCCACCATGTGTCACCAG<br>CAGCTGGTCATTAGCTGGTTTAGCCTTGTGTTCCTGGCCTCCCCCCTTGTCGCTATTTGGG<br>AGCTCAAGAAGGACGTGTACGTGGTGGAGTTGGATTGGTACCCAGACGCGCCCGGAGAGAT<br>GGTAGTTCTGACCTGTGATACCCCAGAGGAGGACGGCATCACCTGGACGCTGGACCAAAGC<br>AGCGAGGTTTTGGGCTCAGGGAAAACGCTGACCATCCAGGTGAAGGAATTCGGCGACGCCG<br>GGCAGTACACCTGCCATAAGGGAGGAGAGGTGCTGAGCCATTCCCTTCTTCTGCTGCACAA<br>GAAAGAGGACGGCATCTGGTCTACCGACATCCTGAAAGACCAGAAGGAGCCCAAGAACAAA<br>ACCTTCCTGAGGTGCGAGGCCAAGAACTACTCCGGCAGGTTCACTTGTTGGTGGCTGACCA<br>CCATCAGTACAGACCTGACTTTTAGTGTAAAAAGCTCCAGAGGCTCGTCCGATCCCCAAGG<br>GGTGACCTGCGGCGCAGCCACTCTGAGCGCTGAGCGCGTGCGCGGTGACAATAAAGAGTAC<br>GAGTACAGCGTTGAGTGTCAAGAAGATAGCGCTTGCCCTGCCGCCGAGGAGAGCCTGCCTA<br>TCGAGGTGATGGTTGACGCAGTGCACAAGCTTAAGTACGAGAATTACACCAGCTCATTCTT<br>CATTAGAGATATAATCAAGCCTGACCCACCCAAGAACCTGCAGCTGAAGCCACTGAAAAAC<br>TCACGGCAGGTCGAAGTGAGCTGGGAGTACCCCGACACCTGGAGCACTCCTCATTCCTATT<br>TCTCTCTTACATTCTGCGTCCAGGTGCAGGGCAAGAGCAAGCGGGAAAAGAAGGATCGAGT<br>CTTCACCGACAAAACAAGCGCGACCGTGATTTGCAGGAAGAACGCCAGCATCTCCGTCAGA<br>GCCCAGGATAGATACTATAGTAGCAGCTGGAGCGAGTGGGCAAGCGTGCCCTGTTCCGGCG<br>GCGGGGGCGGGGGCAGCCGAAACTTGCCTGTCGCTACCCCGGACCCTGGAATGTTTCCGTG<br>TCTGCACCACAGCCAGAACCTGCTGAGAGCCGTGTCGAATATGCTCCAGAAGGCCCGGCAG<br>ACCCTTGAGTTCTACCCCTGTACCAGCGAAGAGATCGATCATGAAGATATCACGAAAGATA<br>AAACATCCACCGTCGAGGCTTGTCTCCCGCTGGAGCTGACCAAGAACGAGAGCTGTCTGAA<br>TAGCCGGGAGACGTCTTTCATCACGAATGGTAGCTGTCTGGCCAGCAGGAAAACTTCCTTC<br>ATGATGGCTCTCTGCCTGAGCTCTATCTATGAAGATCTGAAGATGTATCAGGTGGAGTTTA<br>AAACAATGAACGCCAAACTCCTGATGGACCCAAAAAGGCAAATCTTTCTGGACCAGAATAT |

TABLE 16A-continued mRNA Sequences (with T100 tail)

| SEQ ID NO | Description | Sequence |
|---|---|---|
| | | GCTGGCCGTGATAGACGAGCTGATGCAGGCACTGAACTTCAACAGCGAGACGGTGCCACAG<br>AAATCCAGCCTGGAGGAGCCTGACTTTTACAAAACTAAGATCAAGCTGTGTATCCTGCTGC<br>ACGCCTTTAGAATCCGTGCCGTGACTATCGACAGGGTGATGTCATACCTCAACGCTTCATG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1121 | hIL12AB_002 | G*GGGAAATAAGAGAGAAAAGAAGAGTAAGAAGAAATATAAGAGCCACCATGTGCCACCAG<br>CAGCTGGTGATCAGCTGGTTCAGCCTGGTGTTCCTGGCCAGCCCCCTGGTGGCCATCTGGG<br>AGCTGAAGAAGGACGTGTACGTGGTGGAGTTGGATTGGTACCCCGACGCCCCCGGCGAGAT<br>GGTGGTGCTGACCTGCGACACCCCCGAGGAGGACGGCATCACCTGGACCCTGGACCAGAGC<br>AGCGAGGTGCTGGGCAGCGGCAAGACCCTGACCATCCAGGTGAAGGAGTTCGGCGACGCCG<br>GCCAGTACACCTGCCACAAGGGCGGCGAGGTGCTGAGCCACAGCCTGCTGCTGCTGCACAA<br>GAAGGAGGACGGCATCTGGAGCACCGACATCCTGAAGGACCAGAAGGAGCCCAAGAACAAG<br>ACCTTCCTGAGATGCGAGGCCAAGAACTACAGCGGCAGATTCACCTGCTGGTGGCTGACCA<br>CCATCAGCACCGACCTGACCTTCAGCGTGAAGAGCAGCAGAGGCAGCAGCGACCCCCAGGG<br>CGTGACCTGCGGCGCCGCCACCCTGAGCGCCGAGAGAGTGAGAGGCGACAACAAGGAGTAC<br>GAGTACAGCGTGGAGTGCCAGGAAGATAGCGCCTGCCCCGCCGCCGAGGAGAGCCTGCCCA<br>TCGAGGTGATGGTGGACGCCGTGCACAAGCTGAAGTACGAGAACTACACCAGCAGCTTCTT<br>CATCAGAGATATCATCAAGCCCGACCCCCCCAAGAACCTGCAGCTGAAGCCCCTGAAGAAC<br>AGCCGGCAGGTGGAGGTGAGCTGGGAGTACCCCGACACCTGGAGCACCCCCCACAGCTACT<br>TCAGCCTGACCTTCTGCGTGCAGGTGCAGGGCAAGAGCAAGAGAGAGAAGAAAGATAGAGT<br>GTTCACCGACAAGACCAGCGCCACCGTGATCTGCAGAAAGAACGCCAGCATCAGCGTGAGA<br>GCCCAAGATAGATACTACAGCAGCAGCTGGAGCGAGTGGGCCAGCGTGCCCTGCAGCGGCG<br>GCGGCGGCGGCGGCAGCAGAAACCTGCCCGTGGCCACCCCCGACCCCGGCATGTTCCCCTG<br>CCTGCACCACAGCCAGAACCTGCTGAGAGCCGTGAGCAACATGCTGCAGAAGGCCCGGCAG<br>ACCCTGGAGTTCTACCCCTGCACCAGCGAGGAGATCGACCACGAAGATATCACCAAAGATA<br>AGACCAGCACCGTGGAGGCCTGCCTGCCCCTGGAGCTGACCAAGAACGAGAGCTGCCTGAA<br>CAGCAGAGAGACCAGCTTCATCACCAACGGCAGCTGCCTGGCCAGCAGAAAGACCAGCTTC<br>ATGATGGCCCTGTGCCTGAGCAGCATCTACGAGGACCTGAAGATGTACCAGGTGGAGTTCA<br>AGACCATGAACGCCAAGCTGCTGATGGACCCCAAGCGGCAGATCTTCCTGGACCAGAACAT<br>GCTGGCCGTGATCGACGAGCTGATGCAGGCCCTGAACTTCAACAGCGAGACCGTGCCCCAG<br>AAGAGCAGCCTGGAGGAGCCCGACTTCTACAAGACCAAGATCAAGCTGTGCATCCTGCTGC<br>ACGCCTTCAGAATCAGAGCCGTGACCATCGACAGAGTGATGAGCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1122 | hIL12AB_003 | G*GGGAAATAAGAGAGAAAAGAAGAGTAAGAAGAAATATAAGAGCCACCATGTGTCACCAG<br>CAGTTGGTCATCTCTTGGTTTTCCCTGGTTTTTCTGGCATCTCCCCTCGTGGCCATCTGGG<br>AACTGAAGAAAGACGTTTACGTTGTAGAATTGGATTGGTATCCGGACGCTCCTGGAGAAAT<br>GGTGGTCCTCACCTGTGACACCCCTGAAGAAGACGGAATCACCTGGACCTTGGACCAGAGC<br>AGTGAGGTCTTAGGCTCTGGCAAAACCCTGACCATCCAAGTCAAAGAGTTTGGAGATGCTG<br>GCCAGTACACCTGTCACAAAGGAGGCGAGGTTCTAAGCCATTCGCTCCTGCTGCTTCACAA<br>AAAGGAAGATGGAATTTGGTCCACTGATATTTTAAAGGACCAGAAAGAACCCAAAAATAAG<br>ACCTTTCTAAGATGCGAGGCCAAGAATTATTCTGGACGTTTCACCTGCTGGTGGCTGACGA<br>CAATCAGTACTGATTTGACATTCAGTGTCAAAAGCAGCAGAGGCTCTTCTGACCCCCAAGG<br>GGTGACGTGCGGAGCTGCTACACTCTCTGCAGAGAGAGTCAGAGGTGACAACAAGGAGTAT<br>GAGTACTCAGTGGAGTGCCAGGAAGATAGTGCCTGCCCAGCTGCTGAGGAGAGTCTGCCCA<br>TTGAGGTCATGGTGGATGCCGTTCACAAGCTCAAGTATGAAAACTACACCAGCAGCTTCTT<br>CATCAGAGATATCATCAAACCTGACCCACCCAAGAACTTGCAGCTGAAGCCATTAAAGAAT<br>TCTCGGCAGGTGGAGGTCAGCTGGGAGTACCCTGACACCTGGAGTACTCCACATTCCTACT<br>TCTCCCTGACATTCTGCGTTCAGGTCCAGGGCAAGAGCAAGAGAGAAAAGAAAGATAGAGT<br>CTTCACAGATAAGACCTCAGCCACGGTCATCTGCCGCAAAAATGCCAGCATTAGCGTGCGG<br>GCCCAGGACCGCTACTATAGCTCATCTTGGAGCGAATGGGCATCTGTGCCCTGCAGTGGCG<br>GAGGGGGCGGAGGGAGCAGAAACCTCCCCGTGGCCACTCCAGACCCAGGAATGTTCCCATG<br>CCTTCACCACTCCCAAAACCTGCTGAGGGCCGTCAGCAACATGCTCCAGAAGGCCCGGCAA<br>ACTTTAGAATTTTACCCTTGCACTTCTGAAGAGATTGATCATGAAGATATCACAAAAGATA<br>AAACCAGCACAGTGGAGGCCTGTTTACCATTGGAATTAACCAAGAATGAGAGTTGCCTAAA<br>TTCCAGAGAGACCTCTTTCATAACTAATGGGAGTTGCCTGGCCTCCAGAAAGACCTCTTTT<br>ATGATGGCCCTGTGCCTTAGTAGTATTTATGAAGATTTGAAGATGTACCAGGTGGAGTTCA<br>AGACCATGAATGCAAAGCTTCTGATGGATCCTAAGAGGCAGATCTTTTTAGATCAAAACAT<br>GCTGGCAGTTATTGATGAGCTGATGCAGGCCCTGAATTTCAACAGTGAGACGGTGCCACAA<br>AAATCCTCCCTTGAAGAACCAGATTTCTACAAGACCAAGATCAAGCTCTGCATACTTCTTC<br>ATGCTTTCAGAATTCGGGCAGTGACTATTGATAGAGTGATGAGCTATCTGAATGCTTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1123 | hIL12AB_005 | G*GGGAAATAAGAGAGAAAAGAAGAGTAAGAAGAAATATAAGAGCCACCATGTGCCACCAG<br>CAGCTGGTCATCAGCTGGTTCTCCCTGGTCTTCCTGGCCAGCCCCCTGGTGGCCATCTGGG<br>AGCTGAAGAAAGACGTCTACGTAGTAGAGTTGGATTGGTACCCAGACGCACCTGGAGAAAT<br>GGTGGTTCTCACCTGTGACACGCCAGAAGAAGACGGTATCACCTGGACGCTGGACCAGAGC |

TABLE 16A-continued mRNA Sequences (with T100 tail)

| SEQ ID NO | Description | Sequence |
| --- | --- | --- |
| | | TCAGAAGTTCTTGGCAGTGGAAAAACGCTGACCATACAAGTAAAAGAATTTGGGGATGCTG<br>GCCAGTACACCTGCCACAAAGGAGGAGAAGTTCTCAGCCACAGCCTGCTGCTGCTGCACAA<br>GAAAGAAGATGGCATCTGGAGCACAGATATTTTAAAAGACCAGAAGGAGCCCAAGAACAAA<br>ACCTTCCTTCGATGTGAGGCCAAGAACTACAGTGGCCGCTTCACCTGCTGGTGGCTCACCA<br>CCATCAGCACAGACCTCACCTTCTCGGTGAAGAGCAGCCGTGGCAGCTCAGACCCCCAAGG<br>AGTCACCTGTGGGGCGGCCACGCTGTCGGCAGAAAGAGTTCGAGGTGACAACAAGGAATAT<br>GAATACTCGGTGGAATGTCAAGAAGATTCGGCCTGCCCGGCGGCAGAAGAAAGTCTTCCCA<br>TAGAAGTCATGGTGGATGCTGTTCACAAATTAAAATATGAAAACTACACCAGCAGCTTCTT<br>CATCAGAGATATCATCAAGCCAGACCCGCCCAAGAACCTGCAGCTGAAGCCCCTGAAGAAC<br>AGCCGGCAGGTGGAAGTTTCCTGGGAGTACCCAGATACGTGGAGCACGCCGCACAGCTACT<br>TCAGCCTCACCTTCTGTGTACAAGTACAAGGCAAGAGCAAGAGAGAGAAGAAAGATCGTGT<br>CTTCACAGATAAAACCTCGGCGACGGTCATCTGCAGGAAGAATGCCTCCATCTCGGTTCGA<br>GCCCAGGACCGCTACTACAGCAGCAGCTGGAGTGAGTGGGCCTCGGTGCCCTGCAGTGGTG<br>GCGGCGGCGGCGGCAGCAGAAACCTTCCTGTGGCCACGCCGGACCCTGGCATGTTCCCGTG<br>CCTGCACCACAGCCAAAATTTACTTCGAGCTGTTTCTAACATGCTGCAGAAAGCACGGCAA<br>ACTTTAGAATTCTACCCCTGCACCTCAGAAGAAATAGACCATGAAGATATCACCAAAGATA<br>AAACCAGCACTGTAGAGGCCTGCCTGCCCCTGGAGCTCACCAAGAATGAATCCTGCCTCAA<br>CAGCAGAGAGACCAGCTTCATCACCAATGGCAGCTGCCTGGCCAGCAGGAAAACCAGCTTC<br>ATGATGGCGCTCTGCCTGAGCAGCATCTATGAAGATTTGAAGATGTACCAAGTAGAATTTA<br>AAACCATGAATGCCAAGCTGCTCATGGACCCCAAGCGGCAGATATTTTTGGATCAAAACAT<br>GCTGGCTGTCATTGATGAGCTCATGCAAGCATTAAACTTCAACTCAGAGACGGTGCCCCAG<br>AAGAGCAGCCTGGAGGAGCCAGATTTCTACAAAACCAAGATCAAGCTCTGCATCTTATTAC<br>ATGCCTTCCGCATCCGGGCGGTCACCATTGACCGTGTCATGTCCTACTTAAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1124 | hIL12AB_006 | G*GGGAAATAAGAGAGAAAAGAAGAGTAAGAAGAAATATAAGAGCCACCATGTGCCACCAG<br>CAGCTGGTGATCAGCTGGTTCAGCCTGGTGTTCCTGGCCAGCCCCCTGGTGGCCATCTGGG<br>AGCTGAAGAAGGACGTGTACGTGGTGGAGTTGGATTGGTACCCCGACGCCCCCGGCGAGAT<br>GGTGGTGCTGACCTGTGACACCCCCGAGGAGGACGGCATCACCTGGACCCTGGACCAGAGC<br>AGCGAGGTGCTGGGCAGCGGCAAGACCCTGACCATCCAGGTGAAGGAGTTCGGGGACGCCG<br>GCCAGTACACCTGCCACAAGGGCGGCGAGGTGCTGAGCCACAGCCTGCTGCTGCTGCACAA<br>GAAGGAGGACGGCATCTGGAGCACAGATATCCTGAAGGACCAGAAGGAGCCCAAGAACAAG<br>ACCTTCCTGAGATGCGAGGCCAAGAACTACAGCGGCAGATTCACCTGCTGGTGGCTGACCA<br>CCATCAGCACAGATTTGACCTTCAGCGTGAAGAGCAGCAGAGGCAGCAGCGACCCCCAGGG<br>CGTGACCTGCGGCGCCGCCACCCTGAGCGCCGAGAGAGTGAGAGGTGACAACAAGGAGTAC<br>GAGTACAGCGTGGAGTGCCAGGAAGATAGCGCCTGCCCCGCCGCCGAGGAGAGCCTGCCCA<br>TCGAGGTGATGGTGGACGCCGTGCACAAGCTGAAGTACGAGAACTACACCAGCAGCTTCTT<br>CATCAGAGATATCATCAAGCCCGACCCGCCGAAGAACCTGCAGCTGAAGCCCCTGAAGAAC<br>AGCCGGCAGGTGGAGGTGAGCTGGGAGTACCCCGACACCTGGAGCACCCCCCACAGCTACT<br>TCAGCCTGACCTTCTGCGTGCAGGTGCAGGGCAAGAGCAAGAGAGAGAAGAAAGATAGAGT<br>GTTCACAGATAAGACCAGCGCCACCGTGATCTGCAGAAAGAACGCCAGCATCAGCGTGAGA<br>GCCCAAGATAGATACTACAGCAGCAGCTGGAGCGAGTGGGCCAGCGTGCCCTGCAGCGGCG<br>GCGGCGGCGGCGGCAGCAGAAACCTGCCCGTGGCCACCCCCGACCCCGGCATGTTCCCCTG<br>CCTGCACCACAGCCAGAACCTGCTGAGAGCCGTGAGCAACATGCTGCAGAAGGCCCGGCAG<br>ACCCTGGAGTTCTACCCCTGCACCAGCGAGGAGATCGACCACGAAGATATCACCAAAGATA<br>AGACCAGCACCGTGGAGGCCTGCCTGCCCCTGGAGCTGACCAAGAATGAAAGCTGCCTGAA<br>CAGCAGAGAGACCAGCTTCATCACCAACGGCAGCTGCCTGGCCAGCAGAAAGACCAGCTTC<br>ATGATGGCCCTGTGCCTGAGCAGCATCTACGAGGACCTGAAGATGTACCAGGTGGAGTTCA<br>AGACCATGAACGCCAAGCTGCTGATGGACCCCAAGCGGCAGATCTTCCTGGACCAGAACAT<br>GCTGGCCGTGATCGACGAGCTGATGCAGGCCCTGAACTTCAACAGCGAGACCGTGCCCCAG<br>AAGAGCAGCCTGGAGGAGCCCGACTTCTACAAGACCAAGATCAAGCTGTGCATCCTGCTGC<br>ACGCCTTCAGAATCAGAGCCGTGACCATCGACAGAGTGATGAGCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1125 | hIL12AB_007 | G*GGGAAATAAGAGAGAAAAGAAGAGTAAGAAGAAATATAAGAGCCACCATGTGCCACCAG<br>CAGCTTGTCATCTCCTGGTTCTCTCTTGTCTTCCTTGCTTCTCCTCTTGTGGCCATCTGGG<br>AGCTGAAGAAGGACGTTTACGTAGTGGAGTTGGATTGGTACCCTGACGCACCTGGAGAAAT<br>GGTGGTTCTCACCTGTGACACTCCTGAGGAGGACGGTATCACCTGGACGTTGGACCAGTCT<br>TCTGAGGTTCTTGGCAGTGGAAAAACTCTTACTATTCAGGTGAAGGAGTTTGGAGATGCTG<br>GCCAGTACACCTGCCACAAGGGTGGTGAAGTTCTCAGCCACAGTTTACTTCTTCTTCACAA<br>GAAGGAGGATGGCATCTGGTCTACTGACATTTTAAAAGACCAGAAGGAGCCCAAGAACAAA<br>ACATTCCTTCGTTGTGAAGCCAAGAACTACAGTGGTCGTTTCACCTGCTGGTGGCTTACTA<br>CTATTTCTACTGACCTTACTTTCTCTGTGAAGTCTTCTCGTGGCTCTTCTGACCCTCAGGG<br>TGTCACCTGTGGGGCTGCTACTCTTTCTGCTGAGCGTGTGCGTGGTGACAACAAGGAGTAT<br>GAATACTCGGTGGAGTGCCAGGAAGATTCTGCCTGCCCTGCTGCTGAGGAGTCTCTTCCTA<br>TTGAGGTGATGGTGGATGCTGTGCACAAGTTAAAATATGAAAACTACACTTCTTCTTTCTT<br>CATTCGTGACATTATAAAACCTGACCCTCCCAAGAACCTTCAGTTAAAACCTTTAAAAAAC<br>TCTCGTCAGGTGGAGGTGTCCTGGGAGTACCCTGACACGTGGTCTACTCCTCACTCCTACT<br>TCTCTCTTACTTTCTGTGTCCAGGTGCAGGGCAAGTCCAAGCGTGAGAAGAAGGACCGTGT<br>CTTCACTGACAAAACATCTGCTACTGTCATCTGCAGGAAGAATGCATCCATCTCTGTGCGT |

TABLE 16A-continued

| SEQ ID NO | Description | Sequence |
| --- | --- | --- |
| | | mRNA Sequences (with T100 tail) |
| | | GCTCAGGACCGTTACTACAGCTCTTCCTGGTCTGAGTGGGCTTCTGTGCCCTGCTCTGGCG<br>GCGGCGGCGGCAGCAGAAATCTTCCTGTGGCTACTCCTGACCCTGGCATGTTCCCCTG<br>CCTTCACCACTCGCAGAACCTTCTTCGTGCTGTGAGCAACATGCTTCAGAAGGCTCGTCAA<br>ACTTTAGAATTCTACCCCTGCACTTCTGAGGAGATTGACCATGAAGATATCACCAAAGATA<br>AAACATCTACTGTGGAGGCCTGCCTTCCTTTAGAGCTGACCAAGAATGAATCCTGCTTAAA<br>TTCTCGTGAGACGTCTTTCATCACCAATGGCAGCTGCCTTGCCTCGCGCAAAACATCTTTC<br>ATGATGGCTCTTTGCCTTTCTTCCATCTATGAAGATTTAAAAATGTACCAGGTGGAGTTCA<br>AGACCATGAATGCAAAGCTTCTCATGGACCCCAAGCGTCAGATATTTTTGGACCAGAACAT<br>GCTTGCTGTCATTGATGAGCTCATGCAGGCTTTAAACTTCAACTCTGAGACGGTGCCTCAG<br>AAGTCTTCTTTAGAAGAGCCTGACTTCTACAAGACCAAGATAAAACTTTGCATTCTTCTTC<br>ATGCTTTCCGCATCCGTGCTGTGACTATTGACCGTGTGATGTCCTACTTAAATGCTTCTTG<br>ATAATAGGCTGGAGCCTCGGTGGCCAAGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1126 | hIL12AB_008 | G*GGGAAATAAGAGAGAAAAGAAGAGTAAGAAGAAATATAAGAGCCACCATGTGTCATCAA<br>CAACTCGTGATTAGCTGGTTCAGTCTCGTGTTCCTGGCCTCTCCGCTGGTGGCCATCTGGG<br>AGCTTAAGAAGGACGTGTACGTGGTGGAGCTCGATTGGTACCCCGACGCACCTGGCGAGAT<br>GGTGGTGCTAACCTGCGATACCCCCGAGGAGGACGGGATCACTTGGACCCTGGATCAGAGT<br>AGCGAAGTCCTGGGCTCTGGCAAAACACTCACAATCCAGGTGAAGGAATTCGGAGACGCTG<br>GTCAGTACACTTGCCACAAGGGGGGTGAAGTGCTGTCTCACAGCCTGCTGTTACTGCACAA<br>GAAGGAGGATGGGATCTGGTCAACCGACATCCTGAAGGATCAGAAGGAGCCTAAGAACAAG<br>ACCTTTCTGAGGTGTGAAGCTAAGAACTATTCCGGAAGATTCACTTGCTGGTGGTTGACCA<br>CAATCAGCACTGACCTGACCTTTTCCGTGAAGTCCAGCAGAGGAAGCAGCGATCCTCAGGG<br>CGTAACGTGCGGCGCGGCTACCCTGTCAGCTGAGCGGGTTAGAGGCGACAACAAAGAGTAT<br>GAGTACTCCGTGGAGTGTCAGGAAGATAGCGCCTGCCCCGCAGCCGAGGAGAGTCTGCCCA<br>TCGAGGTGATGGTGGACGCTGTCCATAAGTTAAAATACGAAAATTACACAAGTTCCTTTTT<br>CATCCGCGATATTATCAAACCCGATCCCCCCAAGAACCTGCAGCTGAAGCCCCTGAAGAAT<br>AGCCGACAGGTGGAAGTCTCTTGGGAGTATCCTGACACCTGGTCCACGCCTCACAGCTACT<br>TTAGTCTGACTTTCTGTGTCCAGGTCCAGGGCAAGAGCAAGAGAGAGAAAAAGGATAGAGT<br>GTTTACTGACAAAACATCTGCTACAGTCATCTGCAGAAAGAACGCCAGTATCTCAGTGAGG<br>GCGCAAGATAGATACTACAGTAGTAGCTGGAGCGAATGGGCTAGCGTGCCCTGTTCAGGGG<br>GCGGCGGAGGGGGCTCCAGGAATCTGCCCGTGGCCACCCCCGACCCTGGGATGTTCCCTTG<br>CCTCCATCACTCACAGAACCTGCTCAGAGCAGTGAGCAACATGCTCCAAAAGGCCCGCCAG<br>ACCCTGGAGTTTTACCCTTGTACTTCAGAAGAGATCGATCACGAAGATATAACAAAGGATA<br>AAACCAGCACCGTGGAGGCCTGTCTGCCTCTGGAACTCACAAAGAATGAAAGCTGTCTGAA<br>TTCCAGGGAAACCTCCTTCATTACTAACGGAAGCTGTCTCGCATCTCGCAAAACATCATTC<br>ATGATGGCCCTCTGCCTGTCTTCTATCTATGAAGATCTCAAGATGTATCAGGTGGAGTTCA<br>AAACAATGAACGCCAAGCTGCTGATGGACCCCAAGCGGCAGATCTTCCTGGACCAGAACAT<br>GCTGGCAGTGATCGATGAGCTGATGCAAGCCTTGAACTTCAACTCAGAGACGGTGCCGCAA<br>AAGTCCTCGTTGGAGGAACCAGATTTTTACAAAACCAAAATCAAGCTGTGTATCCTTCTTC<br>ACGCCTTTCGGATCAGAGCCGTGACTATCGACCGGGTGATGTCATACCTGAATGCTTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1127 | hIL12AB_009 | G*GGGAAATAAGAGAGAAAAGAAGAGTAAGAAGAAATATAAGAGCCACCATGTGCCACCAG<br>CAGCTGGTCATCAGCTGGTTTAGCCTGGTCTTCCTGGCCAGCCCCCTGGTGGCCATCTGGG<br>AGCTGAAGAAAGACGTCTACGTAGTAGAGTTGGATTGGTACCCAGACGCACCTGGAGAAAT<br>GGTGGTTCTCACCTGCGACACGCCAGAAGAAGACGGTATCACCTGGACGCTGGACCAGAGC<br>AGCGAAGTACTGGGCAGTGGAAAAACGCTGACCATACAAGTAAAAGAATTTGGCGATGCTG<br>GCCAGTACACCTGCCACAAAGGAGGAGAAGTACTGAGCCACAGCCTGCTGCTGCTGCACAA<br>GAAAGAAGATGGCATCTGGAGCACCGACATTTTAAAAGACCAGAAGGAGCCCAAGAACAAA<br>ACCTTCCTTCGATGTGAGGCGAAGAACTACAGTGGCCGCTTCACCTGCTGGTGGCTCACCA<br>CCATCAGCACCGACCTCACCTTCTCGGTGAAGAGCAGCCGTGGTAGCTCAGACCCCCAAGG<br>AGTCACCTGTGGGGCGGCCACGCTGTCGGCAGAAAGAGTTCGAGGCGACAACAAGGAATAT<br>GAATACTCGGTGGAATGTCAAGAAGATTCGGCCTGCCCGGCGGCAGAAGAAAGTCTGCCCA<br>TAGAAGTCATGGTGGATGCTGTTCACAAATTAAAATATGAAAACTACACCAGCAGCTTCTT<br>CATCAGAGATATCATCAAGCCAGACCCCCCCAAGAACCTGCAGCTGAAGCCCCTGAAGAAC<br>AGCCGGCAGGTGGAAGTTTCCTGGGAGTACCCAGATACGTGGAGCACGCCGCACAGCTACT<br>TCAGCCTCACCTTCTGTGTACAAGTACAAGGCAAGAGCAAGAGAGAGAAGAAAGATCGTGT<br>CTTCACCGACAAAACCTCGGCGACGGTCATCTGCAGGAAGAATGCAAGCATCTCGGTTCGA<br>GCCCAGGACCGCTACTACAGCAGCAGCTGGAGTGAGTGGGCCTCGGTGCCCTGCAGTGGTG<br>GCGGCGGCGGCGGCAGCAGAAACCTTCCTGTGGCCACGCCGGACCCTGGCATGTTTCCGTG<br>CCTGCACCACAGCCAAAATTTATTACGAGCTGTTAGCAACATGCTGCAGAAAGCACGGCAA<br>ACTTTAGAATTCTACCCCTGCACCTCAGAAGAAATAGACCATGAAGATATCACCAAAGATA<br>AAACCAGCACTGTAGAGGCCTGCCTGCCCCTGGAGCTCACCAAGAACGAGAGCTGCCTCAA<br>TAGCAGAGAGACCAGCTTCATCACCAATGGCAGCTGCCTGGCCAGCAGGAAAACCAGCTTC<br>ATGATGGCGCTCTGCCTGAGCAGCATCTATGAAGATCTGAAGATGTACCAAGTAGAATTTA<br>AAACCATGAATGCCAAGCTGCTCATGGACCCCAAGCGGCAGATATTCCTCGACCAAAACAT<br>GCTGGCTGTCATTGATGAGCTCATGCAAGCATTAAACTTCAACTCAGAGACGGTGCCCCAG<br>AAGAGCAGCCTGGAGGAGCCAGATTTCTACAAAACCAAGATCAAGCTCTGCATCTTATTAC<br>ATGCCTTCCGCATCCGGGCGGTCACCATTGACCGTGTCATGTCCTACTTAAATGCCAGCTG<br>ATAATAGGCTGGAGCCTCGGTGGCCATGCTTCTTGCCCCTTGGGCCTCCCCCCAGCCCCTC |

TABLE 16A-continued mRNA Sequences (with T100 tail)

| SEQ ID NO | Description | Sequence |
|---|---|---|
| | | CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1128 | hIL12AB_010 | G*GGGAAATAAGAGAGAAAAGAAGAGTAAGAAGAAATATAAGAGCCACCATGTGCCACCAG<br>CAGCTTGTCATCTCCTGGTTTTCTCTTGTCTTCCTCGCTTCTCCTCTTGTGGCCATCTGGG<br>AGCTGAAGAAAGACGTCTACGTAGTAGAGTTGGATTGGTACCCGGACGCTCCTGGAGAAAT<br>GGTGGTTCTCACCTGCGACACTCCTGAAGAAGACGGTATCACCTGGACGCTGGACCAAAGC<br>AGCGAAGTTTTAGGCTCTGGAAAAACGCTGACCATACAAGTAAAAGAATTTGGCGACGCTG<br>GCCAGTACACGTGCCACAAAGGAGGAGAAGTTTTAAGCCACAGTTTACTTCTTCTTCACAA<br>GAAAGAAGATGGCATCTGGAGTACAGATATTTTAAAAGACCAGAAGGAGCCTAAGAACAAA<br>ACCTTCCTCCGCTGTGAAGCTAAGAACTACAGTGGTCGTTTCACCTGCTGGTGGCTCACCA<br>CCATCTCCACTGACCTCACCTTCTCTGTAAAATCAAGCCGTGGTTCTTCTGACCCCCAAGG<br>AGTCACCTGTGGGGCTGCCACGCTCAGCGCTGAAAGAGTTCGAGGCGACAACAAGGAATAT<br>GAATATTCTGTGGAATGTCAAGAAGATTCTGCCTGCCCGGCGGCAGAAGAAAGTCTTCCCA<br>TAGAAGTCATGGTGGACGCTGTTCACAAATTAAAATATGAAAACTACACCAGCAGCTTCTT<br>CATTCGTGACATCATCAAACCAGACCCTCCTAAGAACCTTCAGTTAAAACCGCTGAAGAAC<br>AGCCGGCAGGTGGAAGTTTCCTGGGAGTACCCAGATACGTGGAGTACGCCGCACTCCTACT<br>TCAGTTTAACCTTCTGTGTACAAGTACAAGGAAAATCAAAAAGAGAGAAGAAAGATCGTGT<br>CTTCACTGACAAAACATCTGCCACGGTCATCTGCCGTAAGAACGCTTCCATCTCGGTTCGA<br>GCCCAGGACCGCTACTACAGCAGCAGCTGGAGTGAGTGGGCATCTGTTCCCTGCAGTGGTG<br>GCGGCGGCGGCGGCAGCCGCAACCTTCCTGTGGCCACGCCGGACCCTGGCATGTTCCCGTG<br>CCTTCACCACTCGCAAAATCTTCTTCGTGCTGTTTCTAACATGCTGCAGAAGGCGCGGCAA<br>ACTTTAGAATTCTACCCGTGCACTTCTGAAGAAATAGACCATGAAGATATCACCAAAGATA<br>AAACCAGCACGGTGGAGGCCTGCCTTCCTTTAGAACTTACTAAGAACGAAAGTTGCCTTAA<br>CAGCCGTGAGACCAGCTTCATCACCAATGGCAGCTGCCTTGCTAGCAGGAAGACCAGCTTC<br>ATGATGGCGCTGTGCCTTTCTTCCATCTATGAAGATCTTAAGATGTACCAAGTAGAATTTA<br>AAACCATGAATGCCAAATTATTAATGGACCCCAAGCGGCAGATATTCCTCGACCAAAACAT<br>GCTGGCTGTCATTGATGAGCTCATGCAAGCATTAAACTTCAACTCAGAAACTGTTCCCCAG<br>AAGTCATCTTTAGAAGAACCAGATTTCTACAAAACAAAAATAAAACTCTGCATTCTTCTTC<br>ATGCCTTCCGCATCCGTGCTGTCACCATTGACCGTGTCATGTCCTACTTAAATGCTTCTTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1129 | hIL12AB_011 | G*GGGAAATAAGAGAGAAAAGAAGAGTAAGAAGAAATATAAGAGCCACCATGTGCCACCAG<br>CAGCTGGTGATCAGCTGGTTCAGCCTGGTGTTCCTGGCCAGCCCCCTGGTGGCCATCTGGG<br>AGCTGAAGAAGGACGTGTACGTGGTGGAGTTGGATTGGTACCCGGACGCGCCGGGGGAGAT<br>GGTGGTGCTGACGTGCGACACGCCGGAGGAGGACGGGATCACGTGGACGCTGGACCAGAGC<br>AGCGAGGTGCTGGGGAGCGGGAAGACGCTGACGATCCAGGTGAAGGAGTTCGGGGACGCGG<br>GGCAGTACACGTGCCACAAGGGGGGGGAGGTGCTGAGCCACAGCCTGCTGCTGCTGCACAA<br>GAAGGAGGACGGGATCTGGAGCACAGATATCCTGAAGGACCAGAAGGAGCCGAAGAACAAG<br>ACGTTCCTGAGGTGCGAGGCGAAGAACTACAGCGGGAGGTTCACGTGCTGGTGGCTGACGA<br>CGATCAGCACGGACCTGACGTTCAGCGTGAAGAGCAGCAGGGGGAGCAGCGACCCGCAGGG<br>GGTGACGTGCGGGGCGGCGACGCTGAGCGCGGAGAGGGTGAGGGGTGACAACAAGGAGTAC<br>GAGTACAGCGTGGAGTGCCAGGAAGATAGCGCGTGCCCGGCGGCGGAGGAGAGCCTGCCGA<br>TCGAGGTGATGGTGGACGCGGTGCACAAGCTGAAGTACGAGAACTACACGAGCAGCTTCTT<br>CATCAGAGATATCATCAAGCCGGACCCGCCGAAGAACCTGCAGCTGAAGCCGCTGAAGAAC<br>AGCAGGCAGGTGGAGGTGAGCTGGGAGTACCCAGATACGTGGAGCACGCCGCACAGCTACT<br>TCAGCCTGACGTTCTGCGTGCAGGTGCAGGGGAAGAGCAAGAGGGAGAAGAAAGATAGGGT<br>GTTCACAGATAAGACGAGCGCGACGGTGATCTGCAGGAAGAACGCGAGCATCAGCGTGAGG<br>GCGCAAGATAGGTACTACAGCAGCAGCTGGAGCGAGTGGGCGAGCGTGCCGTGCAGCGGGG<br>GGGGGGGGGGGGGAGCAGGAACCTGCCGGTGGCGACGCCGGACCCGGGGATGTTCCCGTG<br>CCTGCACCACAGCCAGAACCTGCTGAGGGCGGTGAGCAACATGCTGCAGAAGGCGAGGCAG<br>ACGCTGGAGTTCTACCCGTGCACGAGCGAGGAGATCGACCACGAAGATATCACGAAAGATA<br>AGACGAGCACGGTGGAGGCGTGCCTGCCGCTGGAGCTGACGAAGAACGAGAGCTGCCTGAA<br>CAGCAGGGAGACGAGCTTCATCACGAACGGGAGCTGCCTGGCGAGCAGGAAGACGAGCTTC<br>ATGATGGCGCTGTGCCTGAGCAGCATCTACGAGGACCTGAAGATGTACCAGGTGGAGTTCA<br>AGACGATGAACGCGAAGCTGCTGATGGACCCGAAGAGGCAGATCTTCCTGGACCAGAACAT<br>GCTGGCGGTGATCGACGAGCTGATGCAGGCGCTGAACTTCAACAGCGAGACGGTGCCGCAG<br>AAGAGCAGCCTGGAGGAGCCAGATTTCTACAAGACGAAGATCAAGCTGTGCATCCTGCTGC<br>ACGCGTTCAGGATCAGGGCGGTGACGATCGACAGGGTGATGAGCTACCTGAACGCGAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1130 | hIL12AB_012 | G*GGGAAATAAGAGAGAAAAGAAGAGTAAGAAGAAATATAAGAGCCACCATGTGCCATCAG<br>CAGCTGGTGATCAGCTGGTTCAGCCTCGTGTTTCTGGCCAGCCCCCTGGTGGCCATTTGGG<br>AACTCAAGAAGGACGTGTACGTTGTGGAACTCGACTGGTACCCTGACGCCCCAGGCGAAAT<br>GGTGGTCTTAACCTGCGACACCCCTGAGGAGGACGGAATCACCTGGACCTTGGACCAGAGC<br>TCCGAGGTCCTCGGCAGTGGCAAGACCCTGACCATACAGGTGAAAGAATTTGGAGACGCAG<br>GGCAATACACATGTCACAAGGGCGGGGAGGTTCTTTCTCACTCCCTTCTGCTTCTACATAA<br>AAAGGAAGACGGAATTTGGTCTACCGACATCCTCAAGGACCAAAAGGAGCCTAAGAATAAA<br>ACCTTCTTACGCTGTGAAGCTAAAAACTACAGCGGCAGATTCACTTGCTGGTGGCTCACCA |

TABLE 16A-continued mRNA Sequences (with T100 tail)

| SEQ ID NO | Description | Sequence |
| --- | --- | --- |
| | | CCATTTCTACCGACCTGACCTTCTCGGTGAAGTCTTCAAGGGGCTCTAGTGATCCACAGGG AGTGACATGCGGGGCCGCCACACTGAGCGCTGAACGGGTGAGGGGCGATAACAAGGAGTAT GAATACTCTGTCGAGTGTCAGGAGGATTCAGCTTGTCCCGCAGCTGAAGAGTCACTCCCCA TAGAGGTTATGGTCGATGCTGTGCATAAACTGAAGTACGAAAACTACACCAGCAGCTTCTT CATTAGAGATATTATAAAACCTGACCCCCCCAAGAACCTGCAACTTAAACCCCTGAAAAAC TCTCGGCAGGTCGAAGTTAGCTGGGAGTACCCTGATACTTGGTCCACCCCCCACTCGTACT TCTCACTGACTTTCTGTGTGCAGGTGCAGGGCAAGAGCAAGAGAGAGAAAAAGATCGTGT ATTCACAGATAAGACCTCTGCCACCGTGATCTGCAGAAAAAACGCTTCCATCAGTGTCAGA GCCCAAGACCGGTACTATAGTAGTAGCTGGAGCGAGTGGGCAAGTGTCCCCTGCTCTGGCG GCGGAGGGGGCGGCTCTCGAAACCTCCCCGTCGCTACCCCTGATCCAGGAATGTTCCCTTG CCTGCATCACTCACAGAATCTGCTGAGAGCGGTCAGCAACATGCTGCAGAAAGCTAGGCAA ACACTGGAGTTTTATCCTTGTACCTCAGAGGAGATCGACCACGAGGATATTACCAAAGATA AGACCAGCACGGTGGAGGCCTGCTTGCCCCTGGAACTGACAAAGAATGAATCCTGCCTTAA TAGCCGTGAGACCTCTTTTATAACAAACGGATCCTGCCTGGCCAGCAGGAAGACCTCCTTC ATGATGGCCCTCTGCCTGTCCTCAATCTACGAAGACCTGAAGATGTACCAGGTGGAATTTA AAACTATGAACGCCAAGCTGTTGATGGACCCCAAGCGGCAGATCTTTCTGGATCAAAATAT GCTGGCTGTGATCGACGAACTGATGCAGGCCCTCAACTTTAACAGCGAGACCGTGCCACAA AAGAGCAGTCTTGAGGAGCCCGACTTCTACAAGACCAAGATCAAGCTGTGCATCCTCCTTC ATGCCTTCAGGATAAGAGCTGTCACCATCGACAGAGTCATGAGTTACCTGAATGCATCCTG ATAATAGGCTGGAGCCTCGGTGGCCATGCTTCTTGCCCCTTGGGCCTCCCCCCAGCCCCTC CTCCCCTTCCTGCACCCGTACCCCCCAAACACCATTGTCACACTCCAGTGGTCTTTGAATA AAGTCTGAGTGGGCGGCAAAAAAAAAAAAAAAAAAAAAAAAAAAAAAAAAAAAAAAAAAAAA AAAAAAAAAAAAAAAAAAAAAAAAAAAAAAAAAAAAAAAAAAAAAAAAAAAAAAAATCTAG |
| 1131 | hIL12AB_013 | G*GGGAAATAAGAGAGAAAAGAAGAGTAAGAAGAAATATAAGAGCCACCATGTGCCACCAG CAGCTGGTCATCTCCTGGTTCAGTCTTGTCTTCCTGGCCTCGCCGCTGGTGGCCATCTGGG AGCTGAAGAAAGACGTTTACGTAGTAGAGTTGGATTGGTACCCAGACGCACCTGGAGAAAT GGTGGTCCTCACCTGTGACACGCCAGAAGAAGACGGTATCACCTGGACGCTGGACCAGAGC AGTGAAGTTCTTGGAAGTGGAAAAACGCTGACCATACAAGTAAAAGAATTTGGAGATGCTG GCCAGTACACCTGCCACAAAGGAGGAGAAGTTCTCAGCCACAGTTTATTATTACTTCACAA GAAAGAAGATGGCATCTGGTCCACAGATATTTTAAAAGACCAGAAGGAGCCCAAAAATAAA ACATTTCTTCGATGTGAGGCCAAGAACTACAGTGGTCGTTTCACCTGCTGGTGGCTGACCA CCATCTCCACAGACCTCACCTTCAGTGTAAAAGCAGCCGTGGTTCTTCTGACCCCCAAGG AGTCACCTGTGGGGCTGCCACGCTCTCTGCAGAAAGAGTTCGAGGTGACAACAAAGAATAT GAGTACTCGGTGGAATGTCAAGAAGATTCGGCCTGCCCAGCTGCTGAGGAGAGTCTTCCCA TAGAAGTCATGGTGGATGCTGTTCACAAATTAAAATATGAAAACTACACCAGCAGCTTCTT CATCAGAGATATCATCAAACCTGACCCGCCCAAGAACTTACAGCTGAAGCCGCTGAAAAAC AGCCGGCAGGTAGAAGTTTCCTGGGAGTACCCAGATACCTGGTCCACGCCGCACTCCTACT TCTCCCTCACCTTCTGTGTACAAGTACAAGGCAAGAGCAAGAGAGAGAAGAAAGATCGTGT CTTCACAGATAAAACATCAGCCACGGTCATCTGCAGGAAAAATGCCAGCATCTCGGTGCGG GCCCAGGACCGCTACTACAGCAGCAGCTGGAGTGAGTGGGCATCTGTGCCCTGCAGTGGTG GTGGGGGTGGTGGCAGCAGAAACCTTCCTGTGGCCACTCCAGACCCTGGCATGTTCCCGTG CCTTCACCACTCCCAAAATTTACTTCGAGCTGTTTCTAACATGCTGCAGAAAGCACGGCAA ACTTTAGAATTCTACCCGTGCACTTCTGAAGAAATTGACCATGAAGATATCACAAAAGATA AAACCAGCACAGTGGAGGCCTGTCTTCCTTTAGAGCTGACCAAAAATGAATCCTGCCTCAA CAGCAGAGAGACCAGCTTCATCACCAATGGCAGCTGCCTGGCCTCCAGGAAAACCAGCTTC ATGATGGCGCTCTGCCTCAGCTCCATCTATGAAGATTTGAAGATGTACCAAGTAGAATTTA AAACCATGAATGCCAAATTATTAATGGACCCCAAGAGGCAGATATTTTTAGATCAAAACAT GCTGGCAGTTATTGATGAGCTCATGCAAGCATTAAACTTCAACAGTGAGACGGTACCTCAA AAAAGCAGCCTTGAAGAGCCAGATTTCTACAAAACCAAGATCAAACTCTGCATTTTACTTC ATGCCTTCCGCATCCGGGCGGTCACCATTGACCGTGTCATGTCCTACTTAAATGCCTCGTG ATAATAGGCTGGAGCCTCGGTGGCCATGCTTCTTGCCCCTTGGGCCTCCCCCCAGCCCCTC CTCCCCTTCCTGCACCCGTACCCCCCAAACACCATTGTCACACTCCAGTGGTCTTTGAATA AAGTCTGAGTGGGCGGCAAAAAAAAAAAAAAAAAAAAAAAAAAAAAAAAAAAAAAAAAAAAA AAAAAAAAAAAAAAAAAAAAAAAAAAAAAAAAAAAAAAAAAAAAAAAAAAAAAAAATCTAG |
| 1132 | hIL12AB_014 | G*GGGAAATAAGAGAGAAAAGAAGAGTAAGAAGAAATATAAGAGCCACCATGTGCCACCAG CAGCTTGTGATTTCTTGGTTCTCTCTTGTGTTCCTTGCTTCTCCTCTTGTGGCTATTTGGG AGTTAAAAAAGGACGTGTACGTGGTGGAGCTTGACTGGTACCCTGACGCACCTGGCGAGAT GGTGGTGCTTACTTGTGACACTCCTGAGGAGGACGGCATTACTTGGACGCTTGACCAGTCT TCTGAGGTGCTTGGCTCTGGCAAAACACTTACTATTCAGGTGAAGGAGTTCGGGGATGCTG GCCAGTACACTTGCCACAAGGGCGGCGAGGTGCTTTCTCACTCTCTTCTTCTTCTTCACAA GAAGGAGGACGGCATTTGGTCTACTGACATTTTAAAAGACCAGAAGGAGCCCAAGAACAAA ACATTCCTTCGTTGCGAGGCCAAGAACTACTCTGGCCGTTTCACTTGCTGGTGGCTTACTA CTATTTCTACTGACCTTACTTTCTCTGTGAAGTCTTCTCGTGGCTCTTCTGACCCTCAGGG CGTGACTTGTGGGGCTGCTACTCTTTCTGCTGAGCGTGTGCGTGGTGACAACAAGGAGTAC GAGTACTCTGTGGAGTGCCAGGAAGATTCTGCTTGCCCTGCTGCTGAGGAGTCTCTTCCTA TTGAGGTGATGGTGGATGCTGTGCACAAGTTAAAATACGAGAACTACACTTCTTCTTTCTT CATTCGTGACATTATTAAGCCTGACCCTCCCAAGAACCTTCAGTTAAAACCTTTAAAAAAC TCTCGTCAGGTGGAGGTGTCTTGGGAGTACCCTGACACTTGGTCTACTCCTCACTCTTACT TCTCTCTTACTTTCTGCGTGCAGGTGCAGGGCAAGTCTAAGCGTGAGAAGAAGGACCGTGT GTTCACTGACAAAACATCTGCTACTGTGATTTGCAGGAAGAATGCATCTATTTCTGTGCGT GCTCAGGACCGTTACTACTCTTCTTCTTGGTCTGAGTGGGCTTCTGTGCCTTGCTCTGGCG GCGGCGGCGGCGGCTCCAGAAATCTTCCTGTGGCTACTCCTGACCCTGGCATGTTCCCTTG CCTTCACCACTCTCAGAACCTTCTTCGTGCTGTGAGCAACATGCTTCAGAAGGCTCGTCAA ACTCTTGAGTTCTACCCTTGCACTTCTGAGGAGATTGACCACGAAGATATCACCAAAGATA |

TABLE 16A-continued mRNA Sequences (with T100 tail)

| SEQ ID NO | Description | Sequence |
|---|---|---|
| | | AAACATCTACTGTGGAGGCTTGCCTTCCTCTTGAGCTTACCAAGAATGAATCTTGCTTAAA<br>TTCTCGTGAGACGTCTTTCATCACCAACGGCTCTTGCCTTGCCTCGCGCAAAACATCTTTC<br>ATGATGGCTCTTTGCCTTTCTTCTATTTACGAAGATTTAAAAATGTACCAGGTGGAGTTCA<br>AAACAATGAATGCAAAGCTTCTTATGGACCCCAAGCGTCAGATTTTCCTTGACCAGAACAT<br>GCTTGCTGTGATTGACGAGCTTATGCAGGCTTTAAATTTCAACTCTGAGACGGTGCCTCAG<br>AAGTCTTCTCTTGAGGAGCCTGACTTCTACAAGACCAAGATTAAGCTTTGCATTCTTCTTC<br>ATGCTTTCCGTATTCGTGCTGTGACTATTGACCGTGTGATGTCTTACTTAAATGCTTCTTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAATCTAG |
| 1133 | hIL12AB_015 | G*GGGAAATAAGAGAGAAAAGAAGAGTAAGAAGAAATATAAGAGCCACCATGTGTCACCAG<br>CAGCTGGTGATCAGCTGGTTTAGCCTGGTGTTTCTGGCCAGCCCCCTGGTGGCCATCTGGG<br>AACTGAAGAAAGACGTGTACGTGGTAGAACTGGATTGGTATCCGGACGCTCCCGGCGAAAT<br>GGTGGTGCTGACCTGTGACACCCCCGAAGAAGACGGAATCACCTGGACCCTGGACCAGAGC<br>AGCGAGGTGCTGGGCAGCGGCAAAACCCTGACCATCCAAGTGAAAGAGTTTGGCGATGCCG<br>GCCAGTACACCTGTCACAAAGGCGGCGAGGTGCTAAGCCATTCGCTGCTGCTGCTGCACAA<br>AAAGGAAGATGGCATCTGGAGCACCGATATCCTGAAGGACCAGAAAGAACCCAAAAATAAG<br>ACCTTTCTAAGATGCGAGGCCAAGAATTATAGCGGCCGTTTCACCTGCTGGTGGCTGACGA<br>CCATCAGCACCGATCTGACCTTCAGCGTGAAAAGCAGCAGAGGCAGCAGCGACCCCCAAGG<br>CGTGACGTGCGGCGCCGCCACCCTGAGCGCCGAGAGAGTGAGAGGCGACAACAAGGAGTAT<br>GAGTACAGCGTGGAGTGCCAGGAAGATAGCGCCTGCCCCGCCGCCGAGGAGAGCCTGCCCA<br>TCGAGGTGATGGTGGATGCCGTGCACAAGCTGAAGTATGAAAACTACACCAGCAGCTTCTT<br>CATCAGAGATATCATCAAACCCGACCCCCCCAAGAACCTGCAGCTGAAGCCCCTGAAGAAT<br>AGCCGGCAGGTGGAGGTGAGCTGGGAGTACCCCGACACCTGGAGCACCCCCCATAGCTACT<br>TCAGCCTGACCTTCTGCGTGCAGGTGCAGGGCAAGAGCAAGAGAGAAAAGAAAGATAGAGT<br>GTTCACAGATAAGACCAGCGCCACGGTGATCTGCAGAAAAAATGCCAGCATCAGCGTGAGA<br>GCCCAAGATAGATACTATAGCAGCAGCTGGAGCGAATGGGCCAGCGTGCCCTGCAGCGGCG<br>GCGGCGGCGGCGGCAGCAGAAACCTGCCCGTGGCCACCCCCGACCCCGGCATGTTCCCCTG<br>CCTGCACCACAGCCAAAACCTGCTGAGAGCCGTGAGCAACATGCTGCAGAAGGCCCGGCAG<br>ACCCTGGAATTTTACCCCTGCACCAGCGAAGAGATCGATCATGAAGATATCACCAAAGATA<br>AAACCAGCACCGTGGAGGCCTGTCTGCCCCTGGAACTGACCAAGAATGAGAGCTGCCTAAA<br>TAGCAGAGAGACCAGCTTCATAACCAATGGCAGCTGCCTGGCCAGCAGAAAGACCAGCTTT<br>ATGATGGCCCTGTGCCTGAGCAGCATCTATGAAGACCTGAAGATGTACCAGGTGGAGTTCA<br>AGACCATGAATGCCAAGCTGCTGATGGATCCCAAGCGGCAGATCTTTCTGGATCAAAACAT<br>GCTGGCCGTGATCGATGAGCTGATGCAGGCCCTGAATTTCAACAGCGAGACCGTGCCCCAA<br>AAAAGCAGCCTGGAAGAACCGGATTTTTATAAAACCAAAATCAAGCTGTGCATACTGCTGC<br>ATGCCTTCAGAATCAGAGCCGTGACCATCGATAGAGTGATGAGCTATCTGAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAATCTAG |
| 1134 | hIL12AB_016 | G*GGGAAATAAGAGAGAAAAGAAGAGTAAGAAGAAATATAAGAGCCACCATGTGCCACCAG<br>CAGCTGGTCATCAGCTGGTTCAGCCTGGTCTTCCTGGCCAGCCCCCTGGTGGCCATCTGGG<br>AGCTGAAGAAGGACGTATACGTAGTGGAGTTGGATTGGTACCCAGACGCTCCTGGGGAGAT<br>GGTGGTGCTGACCTGTGACACCCCAGAAGAGGACGGTATCACCTGGACCCTGGACCAGAGC<br>TCAGAAGTGCTGGGCAGTGGAAAAACCCTGACCATCCAGGTGAAGGAGTTTGGAGATGCTG<br>GCCAGTACACCTGCCACAAGGGTGGTGAAGTGCTGAGCCACAGCCTGCTGCTGCTGCACAA<br>GAAGGAGGATGGCATCTGGAGCACAGATATCCTGAAGGACCAGAAGGAGCCCAAGAACAAG<br>ACCTTCCTTCGCTGTGAAGCCAAGAACTACAGTGGCCGCTTCACCTGCTGGTGGCTGACCA<br>CCATCAGCACAGACCTCACCTTCTCGGTGAAGAGCAGCAGAGGCAGCTCAGACCCCCAGGG<br>TGTCACCTGTGGGGCGGCCACGCTGTCGGCGGAGAGAGTTCGAGGTGACAACAAGGAGTAT<br>GAATACTCGGTGGAGTGCCAGGAAGATTCGGCGTGCCCGGCGGCAGAAGAGAGCCTGCCCA<br>TAGAAGTGATGGTGGATGCTGTGCACAAGCTGAAGTATGAAAACTACACCAGCAGCTTCTT<br>CATCAGAGATATCATCAAGCCAGACCCGCCCAAGAACCTGCAGCTGAAGCCCCTGAAGAAC<br>AGCCGGCAGGTGGAGGTTTCCTGGGAGTACCCAGATACGTGGAGCACCCCCCACAGCTACT<br>TCAGCCTGACCTTCTGTGTCCAGGTGCAGGGCAAGAGCAAGAGAGAGAAGAAAGATAGAGT<br>CTTCACAGATAAGACCTCGGCCACGGTCATCTGCAGAAAGAATGCCTCCATCTCGGTTCGA<br>GCCCAAGATAGATACTACAGCAGCAGCTGGTCAGAATGGGCCTCGGTGCCCTGCAGTGGTG<br>GCGGCGGCGGCGGCAGCAGAAACCTGCCTGTTGCCACCCCAGACCCTGGGATGTTCCCCTG<br>CCTGCACCACAGCCAGAACTTATTACGAGCTGTTTCTAACATGCTGCAGAAGGCCCGGCAG<br>ACCCTGGAGTTCTACCCCTGCACCTCAGAAGAGATTGACCATGAAGATATCACCAAAGATA<br>AGACCAGCACTGTAGAGGCCTGCCTGCCCCTGGAGCTGACCAAGAATGAAAGCTGCCTGAA<br>CAGCAGAGAGACCAGCTTCATCACCAATGGAAGCTGCCTGGCCAGCAGAAAGACCAGCTTC<br>ATGATGGCCCTGTGCCTGAGCAGCATCTATGAAGACCTGAAGATGTACCAGGTGGAGTTCA<br>AGACCATGAATGCAAAGCTGCTGATGGACCCCAAGCGGCAGATATTTTTGGACCAGAACAT<br>GCTGGCTGTCATTGATGAGCTGATGCAGGCCCTGAACTTCAACTCAGAAACTGTACCCCAG<br>AAGAGCAGCCTGGAGGAGCCAGATTTCTACAAGACCAAGATCAAGCTGTGCATCCTGCTTC<br>ATGCTTTCAGAATCAGAGCTGTCACCATTGACCGCGTGATGAGCTACTTAAATGCCTCGTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAATCTAG |

TABLE 16A-continued

| mRNA Sequences (with T100 tail) | | |
|---|---|---|
| SEQ ID NO | Description | Sequence |
| 1135 | hIL12AB_017 | G*GGGAAATAAGAGAGAAAAGAAGAGTAAGAAGAAATATAAGAGCCACCATGTGCCACCAG CAGCTGGTAATCAGCTGGTTTTCCCTCGTCTTTCTGGCATCACCCCTGGTGGCTATCTGGG AGCTGAAGAAGGACGTGTACGTGGTGGAGCTGGATTGGTACCCTGACGCCCCGGGGGAAAT GGTGGTGTTAACCTGCGACACGCCTGAGGAGGACGGCATCACCTGGACGCTGGACCAGAGC AGCGAGGTGCTTGGGTCTGGTAAAACTCTGACTATTCAGGTGAAAGAGTTCGGGGATGCCG GCCAATATACTTGCCACAAGGGTGGCGAGGTGCTTTCTCATTCTCTGCTCCTGCTGCACAA GAAAGAAGATGGCATTTGGTCTACTGATATTCTGAAAGACCAGAAGGAGCCCAAGAACAAG ACCTTTCTGAGATGCGAGGCTAAAAACTACAGCGGAAGATTTACCTGCTGGTGGCTGACCA CAATCTCAACCGACCTGACATTTTCAGTGAAGTCCAGCAGAGGGAGCTCCGACCCTCAGGG CGTGACCTGCGGAGCCGCCACTCTGTCCGCAGAAAGAGTGAGAGGTGATAATAAGGAGTAC GAGTATTCAGTCGAGTGCCAAGAAGATTCTGCCTGCCCAGCCGCCGAGGAGAGCCTGCCAA TCGAGGTGATGGTAGATGCGGTACACAAGCTGAAGTATGAGAACTACACATCCTCCTTCTT CATAAGAGATATTATCAAGCCTGACCCACCTAAAAATCTGCAACTCAAGCCTTTGAAAAAT TCACGGCAGGTGGAGGTGAGCTGGGAGTACCCTGATACTTGGAGCACCCCCCATAGCTACT TTTCGCTGACATTCTGCGTCCAGGTGCAGGGCAAGTCAAAGAGAGAGAAGAAGGATCGCGT GTTCACTGATAAAACAAGCGCCACAGTGATCTGCAGAAAAAACGCTAGCATTAGCGTCAGA GCACAGGACCGGTATTACTCCAGCTCCTGGAGCGAATGGGCATCTGTGCCCTGCAGCGGTG GGGGCGGAGGCGGATCCAGAAACCTCCCCGTTGCCACACCTGATCCTGGAATGTTCCCCTG TCTGCACCACAGCCAGAACCTGCTGAGAGCAGTGTCTAACATGCTCCAGAAGGCCAGGCAG ACCCTGGAGTTTTACCCCTGCACCAGCGAGGAAATCGATCACGAAGATATCACCAAAGATA AAACCTCCACCGTGGAGGCCTGCCTGCCCCTGGAACTGACCAAAAACGAGAGCTGCCTGAA TAGCAGGGAGACCTCCTTCATCACCAACGGCTCATGCCTTGCCAGCCGGAAAACTAGCTTC ATGATGGCCCTGTGCCTGTCTTCGATCTATGAGGACCTGAAAATGTACCAGGTCGAATTTA AGACGATGAACGCAAAGCTGCTGATGGACCCCAAGCGGCAGATCTTTCTGGACCAGAACAT GCTGGCAGTCATAGATGAGTTGATGCAGGCATTAAACTTCAACAGCGAGACCGTGCCTCAG AAGTCCAGCCTCGAGGAGCCAGATTTTTATAAGACCAAGATCAAACTATGCATCCTGCTGC ATGCTTTCAGGATTAGAGCCGTCACCATCGATCGAGTCATGTCTTACCTGAATGCTAGCTG ATAATAGGCTGGAGCCTCGGTGGCCATGCTTCTTGCCCCTTGGGCCTCCCCCCAGCCCCTC CTCCCCTTCCTGCACCCGTACCCCCCAAACACCATTGTCACACTCCAGTGGTCTTTGAATA AAGTCTGAGTGGGCGGCAAAAAAAAAAAAAAAAAAAAAAAAAAAAAAAAAAAAAAAAAAAAA AAAAAAAAAAAAAAAAAAAAAAAAAAAAAAAAAAAAAAAAAAAAAAAAAAAAAAAATCTAG |
| 1136 | hIL12AB_018 | G*GGGAAATAAGAGAGAAAAGAAGAGTAAGAAGAAATATAAGAGCCACCATGTGTCACCAA CAGTTAGTAATCTCCTGGTTTTCTCTGGTGTTTCTGGCCAGCCCCCTCGTGGCCATCTGGG AGCTTAAAAAGGACGTTTACGTGGTGGAGTTGGATTGGTATCCCGACGCTCCAGGCGAAAT GGTCGTGCTGACCTGCGATACCCCTGAAGAAGACGGTATCACCTGGACGCTGGACCAGTCT TCCGAGGTGCTTGGATCTGGCAAAACACTGACAATACAAGTTAAGGAGTTCGGGGACGCAG GGCAGTACACCTGCCACAAAGGCGGCGAGGTCCTGAGTCACTCCCTGTTACTGCTCCACAA GAAAGAGGACGGCATTTGGTCCACCGACATTCTGAAGGACCAGAAGGAGCCTAAGAATAAA ACTTTCCTGAGATGCGAGGCAAAAAACTATAGCGGCCGCTTTACTTGCTGGTGGCTTACAA CAATCTCTACCGATTTAACTTTCTCCGTGAAGTCTAGCAGAGGATCCTCTGACCCGCAAGG AGTGACTTGCGGAGCCGCCACCTTGAGCGCCGAAAGAGTCCGTGGCGATAACAAAGAATAC GAGTACTCCGTGGAGTGCCAGGAAGATTCCGCCTGCCCAGCTGCCGAGGAGTCCCTGCCCA TTGAAGTGATGGTGGATGCCGTCCACAAGCTGAAGTACGAAAACTATACCAGCAGCTTCTT CATCCGGGATATCATTAAGCCCGACCCTCCTAAAAACCTGCAACTTAAGCCCCTAAAGAAT AGTCGGCAGGTTGAGGTCAGCTGGGAATATCCTGACACATGGAGCACCCCCCACTCTTATT TCTCCCTGACCTTCTGCGTGCAGGTGCAGGGCAAGAGTAAACGGGAGAAAAAAGATAGGGT CTTTACCGATAAAACCAGCGCTACGGTTATCTGTCGGAAGAACGCTTCCATCTCCGTCCGC GCTCAGGATCGTTACTACTCGTCCTCATGGAGCGAGTGGGCCAGCGTGCCCTGCAGCGGCG GCGGTGGAGGCGGATCCAGAAATCTGCCTGTTGCCACACCAGACCCTGGCATGTTCCCCTG TCTGCATCATAGCCAGAACCTGCTCAGAGCCGTGAGCAACATGCTCCAGAAGGCCAGGCAA ACTTTGGAGTTCTACCCGTGTACATCTGAGGAAATCGATCACGAAGATATAACCAAAGATA AAACCTCTACAGTAGAGGCTTGTTTGCCCCTGGAGTTGACCAAAAACGAGAGTTGCCTGAA CAGTCGCGAGACGAGCTTCATTACTAACGGCAGCTGTCTCGCCTCCAGAAAAACATCCTTC ATGATGGCCCTGTGTCTTTCCAGCATATACGAAGACCTGAAAATGTACCAGGTCGAGTTCA AAACAATGAACGCCAAGCTGCTTATGGACCCCAAGCGGCAGATCTTCCTCGACCAAAACAT GCTCGCTGTGATCGATGAGCTGATGCAGGCTCTCAACTTCAATTCCGAAACAGTGCCACAG AAGTCCAGTCTGGAAGAACCCGACTTCTACAAGACCAAGATTAAGCTGTGTATTTTGCTGC ATGCGTTTAGAATCAGAGCCGTGACCATTGATCGGGTGATGAGCTACCTGAACGCCTCGTG ATAATAGGCTGGAGCCTCGGTGGCCATGCTTCTTGCCCCTTGGGCCTCCCCCCAGCCCCTC CTCCCCTTCCTGCACCCGTACCCCCCAAACACCATTGTCACACTCCAGTGGTCTTTGAATA AAGTCTGAGTGGGCGGCAAAAAAAAAAAAAAAAAAAAAAAAAAAAAAAAAAAAAAAAAAAAA AAAAAAAAAAAAAAAAAAAAAAAAAAAAAAAAAAAAAAAAAAAAAAAAAAAAAAAATCTAG |
| 1137 | hIL12AB_019 | G*GGGAAATAAGAGAGAAAAGAAGAGTAAGAAGAAATATAAGAGCCACCATGTGCCACCAG CAGCTTGTCATCTCCTGGTTTTCTCTTGTCTTCCTGGCCTCGCCGCTGGTGGCCATCTGGG AGCTGAAGAAAGACGTTTACGTAGTAGAGTTGGATTGGTACCCAGACGCACCTGGAGAAAT GGTGGTTCTCACCTGTGACACTCCTGAAGAAGACGGTATCACCTGGACGCTGGACCAAAGC TCAGAAGTTCTTGGCAGTGGAAAAACGCTGACCATACAAGTAAAAGAATTTGGGGATGCTG GCCAGTACACGTGCCACAAAGGAGGAGAAGTTCTCAGCCACAGTTTACTTCTTCTTCACAA GAAAGAAGATGGCATCTGGTCCACAGATATTTTAAAAGACCAGAAGGAGCCCAAGAACAAA ACCTTCCTCCGCTGTGAGGCCAAGAACTACAGTGGTCGTTTCACCTGCTGGTGGCTCACCA CCATCTCCACTGACCTCACCTTCTCTGTAAAAAGCAGCCGTGGTTCTTCTGACCCCCAAGG AGTCACCTGTGGGGCTGCCACGCTCTCGGCAGAAAGAGTTCGAGGTGACAACAAGGAATAT GAATATTCTGTGGAATGTCAAGAAGATTCTGCCTGCCCGGCGGCAGAAGAAAGTCTTCCCA TAGAAGTCATGGTGGATGCTGTTCACAAATTAAAATATGAAAACTACACCAGCAGCTTCTT |

TABLE 16A-continued mRNA Sequences (with T100 tail)

| SEQ ID NO | Description | Sequence |
| --- | --- | --- |
| | | CATTCGTGACATCATCAAACCAGACCCGCCCAAGAACCTTCAGTTAAAACCTTTAAAAAAC<br>AGCCGGCAGGTAGAAGTTTCCTGGGAGTACCCAGATACGTGGTCCACGCCGCACTCCTACT<br>TCAGTTTAACCTTCTGTGTACAAGTACAAGGAAAATCAAAAAGAGAGAAGAAAGATCGTGT<br>CTTCACTGACAAAACATCTGCCACGGTCATCTGCAGGAAGAATGCCTCCATCTCGGTTCGA<br>GCCCAGGACCGCTACTACAGCAGCAGCTGGAGTGAGTGGGCATCTGTTCCCTGCAGTGGTG<br>GCGGCGGCGGCGGCAGCCGCAACCTTCCTGTGGCCACGCCGGACCCTGGCATGTTCCCGTG<br>CCTTCACCACTCCCAAAATCTTCTTCGTGCTGTTTCTAACATGCTGCAGAAGGCGCGCCAA<br>ACTTTAGAATTCTACCCGTGCACTTCTGAAGAAATAGACCATGAAGATATCACCAAAGATA<br>AAACCAGCACGGTGGAGGCCTGCCTTCCTTTAGAGCTGACCAAGAATGAATCCTGCCTCAA<br>CAGCAGAGAGACCAGCTTCATCACCAATGGCAGCTGCCTGGCCTCGCGCAAGACCAGCTTC<br>ATGATGGCGCTGTGCCTTTCTTCCATCTATGAAGATTTAAAGATGTACCAAGTAGAATTTA<br>AAACCATGAATGCCAAATTATTAATGGACCCCAAACGGCAGATATTTTTGGATCAAAACAT<br>GCTGGCTGTCATTGATGAGCTCATGCAAGCATTAAACTTCAACTCAGAAACTGTTCCCCAG<br>AAGTCATCTTTAGAAGAGCCAGATTTCTACAAAACAAAAATAAAACTCTGCATTCTTCTTC<br>ATGCCTTCCGCATCCGTGCTGTCACCATTGACCGTGTCATGTCCTACTTAAATGCTTCTTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1138 | hIL12AB_020 | G*GGGAAATAAGAGAGAAAAGAAGAGTAAGAAGAAATATAAGAGCCACCATGTGCCACCAG<br>CAGCTGGTGATCAGCTGGTTCAGCCTGGTGTTCCTGGCTAGCCCTCTGGTGGCCATCTGGG<br>AGCTGAAGAAGGACGTGTACGTGGTGGAGTTGGATTGGTACCCCGACGCTCCCGGCGAGAT<br>GGTGGTGCTGACCTGCGACACCCCCGAGGAGGACGGGATCACCTGGACCCTGGATCAGTCA<br>AGCGAGGTGCTGGGAAGCGGCAAGACCCTGACCATCCAGGTGAAGGAGTTCGGCGACGCCG<br>GCCAATACACTTGCCACAAGGGAGGCGAGGTGCTGTCCCACTCCCTCCTGCTGCTGCACAA<br>AAAGGAAGACGGCATCTGGAGCACCGACATCCTGAAAGACCAGAAGGAGCCTAAGAACAAA<br>ACATTCCTCAGATGCGAGGCCAAGAATTACTCCGGGAGATTCACCTGTTGGTGGCTGACCA<br>CCATCAGCACAGACCTGACCTTCAGCGTGAAGAGCAGCAGAGGCAGCAGCGACCCCCAGGG<br>CGTGACCTGTGGCGCCGCCACCCTGAGCGCCGAAAGAGTGCGCGGCGACAACAAGGAGTAC<br>GAGTACTCCGTGGAATGCCAGGAAGATAGCGCCTGCCCCGCCGCCGAGGAGAGCCTGCCCA<br>TCGAGGTGATGGTGGACGCCGTCCACAAGCTGAAGTACGAGAACTACACCTCTAGCTTCTT<br>CATCAGAGATATCATCAAGCCCGATCCCCCCAAGAACCTGCAGCTGAAACCCCTGAAGAAC<br>AGCCGGCAGGTGGAGGTGAGCTGGGAGTATCCCGACACCTGGTCCACCCCCCACAGCTATT<br>TTAGCCTGACCTTCTGCGTGCAAGTGCAGGGCAAGAGCAAGAGAGAGAAGAAGGACCGCGT<br>GTTCACCGACAAAACCAGCGCCACCGTGATCTGCAGAAAGAACGCCAGCATCAGCGTGAGG<br>GCCCAGGATAGATACTACAGTTCCAGCTGGAGCGAGTGGGCCAGCGTGCCCTGCAGCGGCG<br>GCGGCGGGGGAGGCTCGAGAAACCTGCCCGTGGCTACCCCCGATCCCGGAATGTTCCCCTG<br>CCTGCACCACAGCCAGAACCTGCTGAGGGCGGTGTCCAACATGCTTCAGAAGGCCCGGCAG<br>ACCCTGGAGTTCTACCCCTGTACCTCTGAGGAGATCGATCATGAAGATATCACAAAAGATA<br>AAACCAGCACCGTGGAGGCCTGCCTGCCCCTGGAGCTGACCAAGAACGAGAGCTGCCTGAA<br>CTCCCGCGAGACCAGCTTCATCACGAACGGCAGCTGCCTGGCCAGCAGGAAGACCTCCTTC<br>ATGATGGCCCTGTGCCTGAGCAGCATCTACGAGGACCTGAAAATGTACCAGGTGGAGTTTA<br>AGACCATGAACGCCAAGCTGCTGATGGACCCCAAGCGGCAAATCTTCCTGGACCAGAACAT<br>GCTGGCAGTGATCGACGAGCTCATGCAGGCCCTGAACTTCAATAGCGAGACGGTCCCCCAG<br>AAGAGCAGCCTGGAGGAGCCCGACTTTTACAAGACCAAGATCAAGCTGTGCATCCTGCTGC<br>ACGCCTTTAGAATCCGTGCCGTGACCATTGACAGAGTGATGAGCTACCTGAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1139 | hIL12AB_021 | G*GGGAAATAAGAGAGAAAAGAAGAGTAAGAAGAAATATAAGAGCCACCATGTGCCACCAG<br>CAGCTGGTGATCAGCTGGTTCAGCCTGGTGTTCCTGGCCAGCCCTCTGGTTGCCATCTGGG<br>AGCTGAAGAAAGACGTGTACGTCGTGGAACTGGACTGGTATCCGGACGCCCCGGGCGAGAT<br>GGTGGTGCTGACCTGTGACACCCCCGAGGAGGACGGCATCACCTGGACGCTGGACCAATCC<br>TCCGAGGTGCTGGGAAGCGGCAAGACCCTGACCATCCAGGTGAAGGAATTCGGGGACGCCG<br>GGCAGTACACCTGCCACAAGGGGGGCGAAGTGCTGTCCCACTCGCTGCTGCTCCTGCATAA<br>GAAGGAGGATGGAATCTGGTCCACCGACATCCTCAAAGATCAGAAGGAGCCCAAGAACAAG<br>ACGTTCCTGCGCTGTGAAGCCAAGAATTATTCGGGGCGATTCACGTGCTGGTGGCTGACAA<br>CCATCAGCACCGACCTGACGTTTAGCGTGAAGAGCAGCAGGGGGTCCAGCGACCCCCAGGG<br>CGTGACGTGCGGCGCCGCCACCCTCTCCGCCGAGAGGGTGCGGGGGGACAATAAGGAGTAC<br>GAGTACAGCGTGGAATGCCAGGAGGACAGCGCCTGCCCCGCCGCGGAGGAAAGCCTCCCGA<br>TAGAGGTGATGGTGGACGCCGTGCACAAGCTCAAGTATGAGAATTACACCAGCAGCTTTTT<br>CATCCGGGACATTATCAAGCCCGACCCCCCGAAGAACCTCCAGCTGAAGCCCCTGAAGAAC<br>AGCCGGCAGGTGGAAGTCTCCTGGGAGTATCCCGACACCTGGAGCACCCCGCACAGCTACT<br>TCTCCCTGACCTTCTGTGTGCAGGTGCAGGGCAAGTCCAAGAGGGAAAAGAAGGACAGGGT<br>TTTCACCGACAAGACCAGCGCGACCGTGATCTGCCGGAAGAACGCCAGCATAAGCGTCCGC<br>GCCCAAGATAGGTACTACAGCAGCTCCTGGAGCGAGTGGGCTAGCGTGCCCTGCAGCGGGG<br>GCGGGGGTGGGGGCTCCAGGAACCTGCCAGTGGCGACCCCCGACCCCGGCATGTTCCCCTG<br>CCTCCATCACAGCCAGAACCTGCTGAGGGCCGTCAGCAATATGCTGCAGAAGGCCAGGCAG<br>ACCCTGGAATTCTACCCCTGCACGTCGGAGGAGATCGATCACGAGGATATCACAAAAGACA<br>AGACTTCCACCGTGGAGGCCTGCCTGCCCCTGGAGCTCACCAAGAATGAGTCCTGTCTGAA<br>CTCCCGGGAAACCAGCTTCATCACCAACGGGTCCTGCCTGGCCAGCAGGAAGACCAGCTTT<br>ATGATGGCCCTGTGCCTGTCGAGCATCTACGAGGACCTGAAGATGTACCAGGTCGAGTTCA<br>AGACAATGAACGCCAAGCTGCTGATGGACCCCAAGAGGCAAATCTTCCTGGACCAGAATAT |

TABLE 16A-continued mRNA Sequences (with T100 tail)

| SEQ ID NO | Description | Sequence |
| --- | --- | --- |
| | | GCTTGCCGTCATCGACGAGCTCATGCAGGCCCTGAACTTCAACTCCGAGACCGTGCCCCAG<br>AAGAGCAGCCTGGAGGAGCCCGACTTCTACAAGACCAAGATCAAGCTGTGCATCCTGCTGC<br>ACGCGTTCAGGATCCGGGCAGTCACCATCGACCGTGTGATGTCCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAAATCTAG |
| 1140 | hIL12AB_022 | G*GGGAAATAAGAGAGAAAAGAAGAGTAAGAAGAAATATAAGAGCCACCATGTGCCATCAG<br>CAGCTGGTGATCAGCTGGTTCAGCCTGGTGTTCCTCGCCTCTCCCCTGGTGGCCATCTGGG<br>AGCTCAAAAAGGACGTGTACGTGGTGGAGCTCGACTGGTACCCAGACGCCCCCGGGGAGAT<br>GGTGGTGCTGACCTGCGACACCCCCGAAGAAGACGGCATCACGTGGACCCTCGACCAGTCC<br>AGCGAGGTGCTGGGGAGCGGGAAGACTCTGACCATCCAGGTCAAGGAGTTCGGGGACGCCG<br>GGCAGTACACGTGCCACAAGGGCGGCGAAGTCTTAAGCCACAGCCTGCTCCTGCTGCACAA<br>GAAGGAGGACGGGATCTGGTCCACAGACATACTGAAGGACCAGAAGGAGCCGAAGAATAAA<br>ACCTTTCTGAGGTGCGAGGCCAAGAACTATTCCGGCAGGTTCACGTGCTGGTGGCTTACAA<br>CAATCAGCACAGACCTGACGTTCAGCGTGAAGTCCAGCCGCGGCAGCAGCGACCCCCAGGG<br>GGTGACCTGCGGCGCCGCCACCCTGAGCGCCGAGCGGGTGCGCGGGGACAACAAGGAGTAC<br>GAGTACTCCGTGGAGTGCCAGGAAGACAGCGCCTGTCCCGCCGCCGAAGAGAGCCTGCCTA<br>TCGAGGTCATGGTAGATGCAGTGCATAAGCTGAAGTACGAGAACTATACGAGCAGCTTTTT<br>CATACGCGACATCATCAAGCCCGACCCCCCCAAGAACCTGCAGCTTAAGCCCCTGAAGAAT<br>AGCCGGCAGGTGGAGGTCTCCTGGGAGTACCCCGACACCTGGTCAACGCCCCACAGCTACT<br>TCTCCCTGACCTTTTGTGTCCAAGTCCAGGGAAAGAGCAAGAGGGAGAAGAAAGATCGGGT<br>GTTCACCGACAAGACCTCCGCCACGGTGATCTGCAGGAAGAACGCCAGCATCTCCGTGAGG<br>GCGCAAGACAGGTACTACTCCAGCAGCTGGTCCGAATGGGCCAGCGTGCCCTGCTCCGGCG<br>GCGGGGGCGGCGGCAGCCGAAACCTACCCGTGGCCACGCCGGATCCCGGCATGTTTCCCTG<br>CCTGCACCACAGCCAGAACCTCCTGAGGGCCGTGTCCAACATGCTGCAGAAGGCCAGGCAG<br>ACTCTGGAGTTCTACCCCTGCACGAGCGAGGAGATCGATCACGAGGACATCACCAAGGATA<br>AGACCAGCACTGTGGAGGCCTGCCTTCCCCTGGAGCTGACCAAGAACGAGAGCTGTCTGAA<br>CTCCAGGGAGACCTCATTCATCACCAACGGCTCCTGCCTGGCCAGCAGGAAAACCAGCTTC<br>ATGATGGCCTTGTGTCTCAGCTCCATCTACGAGGACCTGAAGATGTATCAGGTCGAGTTCA<br>AGACAATGAACGCCAAGCTGCTGATGGACCCCAAAAGGCAGATCTTCCTGGACCAGAACAT<br>GCTGGCCGTCATCGACGAGCTGATGCAGGCCCTGAACTTCAACAGCGAGACGGTGCCCCAG<br>AAAAGCTCCCTGGAGGAGCCCGACTTCTACAAGACCAAGATCAAGCTGTGCATCCTGCTGC<br>ACGCCTTCAGGATCAGGGCAGTGACCATCGACCGGGTGATGTCATACCTTAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAAATCTAG |
| 1141 | hIL12AB_023 | G*GGGAAATAAGAGAGAAAAGAAGAGTAAGAAGAAATATAAGAGCCACCATGTGCCATCAG<br>CAGCTGGTGATCTCCTGGTTCAGCCTGGTGTTTCTGGCCTCGCCCCTGGTCGCCATCTGGG<br>AGCTGAAGAAAGACGTGTACGTCGTCGAACTGGACTGGTACCCCGACGCCCCCGGGGAGAT<br>GGTGGTGCTGACCTGCGACACGCCGGAGGAGGACGGCATCACCTGGACCCTGGATCAAAGC<br>AGCGAGGTGCTGGGCAGCGGCAAGACCCTGACCATCCAAGTGAAGGAATTCGGCGATGCCG<br>GCCAGTACACCTGTCACAAAGGGGGCGAGGTGCTCAGCCACAGCCTGCTGCTGCTGCACAA<br>GAAGGAGGATGGCATCTGGAGCACCGATATCCTGAAGGACCAGAAAGAGCCCAAGAACAAG<br>ACGTTCCTGAGGTGCGAGGCCAAGAACTACAGCGGTAGGTTCACGTGTTGGTGGCTGACCA<br>CCATCAGCACCGACCTGACGTTCAGCGTGAAGAGCTCCAGGGGCAGCTCCGACCCACAGGG<br>GGTGACGTGCGGGGCCGCAACCCTCAGCGCCGAAAGGGTGCGGGGGGACAACAAGGAGTAC<br>GAATACTCCGTGGAGTGCCAGGAAGATTCGGCCTGCCCCGCCGCGGAGGAGAGCCTCCCCA<br>TCGAGGTAATGGTGGACGCCGTGCATAAGCTGAAGTACGAGAACTACACCAGCTCGTTCTT<br>CATCCGAGACATCATCAAACCCGACCCGCCCAAAAATCTGCAGCTCAAGCCCCTGAAGAAC<br>TCCAGGCAGGTGGAGGTGAGCTGGGAGTACCCCGACACCTGGTCCACCCCGCACAGCTACT<br>TCTCCCTGACATTCTGCGTGCAGGTGCAGGGCAAGAGCAAGCGGGAGAAGAAGGACAGGGT<br>GTTCACCGACAAGACGAGCGCCACCGTGATCTGCCGAAAGAACGCCAGCATCTCGGTGCGC<br>GCCCAGGATAGGTACTATTCCAGCTCCTGGAGCGAGTGGGCCTCGGTACCCTGCAGCGGCG<br>GCGGGGGCGGCGGCAGTAGGAATCTGCCCGTGGCTACCCCGGACCCGGGCATGTTCCCCTG<br>CCTCCACCACAGCCAGAACCTGCTGAGGGCCGTGAGCAACATGCTGCAGAAGGCCAGACAG<br>ACGCTGGAGTTCTACCCCTGCACGAGCGAGGAGATCGACCACGAGGACATCACCAAGGATA<br>AAACTTCCACCGTCGAGGCCTGCCTGCCCTTGGAGCTGACCAAGAATGAATCCTGTCTGAA<br>CAGCAGGGAGACCTCGTTTATCACCAATGGCAGCTGCCTCGCCTCCAGGAAGACCAGCTTC<br>ATGATGGCCCTCTGTCTGAGCTCCATCTATGAGGACCTGAAGATGTACCAGGTGGAGTTCA<br>AGACCATGAACGCGAAGCTGCTGATGGACCCCAAGAGGCAGATCTTCCTGGATCAGAATAT<br>GCTGGCGGTGATCGACGAGCTCATGCAGGCCCTCAATTTCAATAGCGAGACAGTGCCCCAG<br>AAGTCCTCCCTGGAGGAGCCCGACTTCTACAAGACCAAGATCAAGCTGTGTATCCTGCTGC<br>ACGCCTTCCGGATCCGGGCCGTCACCATCGACCGGGTCATGAGCTACCTCAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAAATCTAG |
| 1142 | hIL12AB_024 | G*GGGAAATAAGAGAGAAAAGAAGAGTAAGAAGAAATATAAGAGCCACCATGTGCCACCAG<br>CAGCTGGTGATCTCCTGGTTCTCCCTGGTGTTCCTGGCCTCGCCCCTGGTGGCCATCTGGG<br>AGCTGAAGAAGGACGTGTACGTCGTGGAGCTCGACTGGTACCCCGACGCCCCTGGCGAGAT<br>GGTGGTGCTGACCTGCGACACCCCAGAGGAGGATGGCATCACCTGGACCCTGGATCAGTCC |

TABLE 16A-continued mRNA Sequences (with T100 tail)

| SEQ ID NO | Description | Sequence |
|---|---|---|
| | | TCCGAGGTGCTGGGCTCCGGCAAGACGCTGACCATCCAAGTGAAGGAGTTCGGTGACGCCG<br>GACAGTATACCTGCCATAAGGGCGGCGAGGTCCTGTCCCACAGCCTCCTCCTCCTGCATAA<br>GAAGGAGGACGGCATCTGGAGCACCGACATCCTGAAGGACCAGAAGGAGCCCAAGAACAAG<br>ACCTTTCTGAGGTGCGAGGCCAAGAACTACAGCGGCCGATTCACCTGCTGGTGGCTCACCA<br>CCATATCCACCGACCTGACTTTCTCCGTCAAGTCCTCCCGGGGGTCCAGCGACCCCCAGGG<br>AGTGACCTGCGGCGCCGCCACCCTCAGCGCCGAGCGGGTGCGGGGGGACAACAAGGAGTAC<br>GAATACTCCGTCGAGTGCCAGGAGGACTCCGCCTGCCCGGCCGCCGAGGAGAGCCTGCCCA<br>TCGAGGTGATGGTCGACGCGGTGCACAAGCTGAAGTACGAGAACTACACCAGCAGTTTCTT<br>CATCAGGGATATCATCAAGCCAGATCCCCCGAAGAATCTGCAACTGAAGCCGCTGAAAAAC<br>TCACGACAGGTGGAGGTGAGCTGGGAGTACCCCGACACGTGGAGCACCCCACATTCCTACT<br>TCAGCCTGACCTTCTGCGTGCAGGTCCAGGGCAAGAGCAAGCGGGAGAAGAAGGACAGGGT<br>GTTCACGGATAAGACCAGTGCCACCGTGATCTGCAGGAAGAACGCCTCTATTAGCGTGAGG<br>GCCCAGGATCGGTATTACTCCTCGAGCTGGAGCGAATGGGCCTCCGTGCCCTGCAGTGGGG<br>GGGGTGGAGGCGGAGCAGGAACCTGCCCGTAGCAACCCCCGACCCCGGGATGTTCCCCTG<br>TCTGCACCACTCGCAGAACCTGCTGCGCGCGGTGAGCAACATGCTCCAAAAAGCCCGTCAG<br>ACCTTAGAGTTCTACCCCTGCACCAGCGAAGAAATCGACCACGAAGACATCACCAAGGACA<br>AAACCAGCACCGTGGAGGCGTGCCTGCCGCTGGAGCTGACCAAGAACGAGAGCTGCCTCAA<br>CTCCAGGGAGACCAGCTTTATCACCAACGGCTCGTGCCTAGCCAGCCGGAAAACCAGCTTC<br>ATGATGGCCCTGTGCCTGAGCTCCATTTACGAGGACCTGAAGATGTATCAGGTGGAGTTCA<br>AGACCATGAATGCCAAACTCCTGATGGACCCCAAGAGGCAGATCTTCCTGGACCAGAACAT<br>GCTCGCGGTGATCGATGAGCTGATGCAGGCCCTGAACTTTAATAGCGAGACCGTGCCCCAG<br>AAAAGCAGCCTGGAGGAGCCGGACTTCTACAAGACCAAAATCAAGCTGTGCATCCTGCTCC<br>ACGCCTTCCGCATCCGGGCCGTGACCATCGACAGGGTGATGAGCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAATCTAG |
| 1143 | hIL12AB_025 | G*GGGAAATAAGAGAGAAAAGAAGAGTAAGAAGAAATATAAGAGCCACCATGTGCCATCAG<br>CAGCTGGTGATTTCCTGGTTCTCCCTGGTGTTCCTGGCCAGCCCCCTCGTGGCGATCTGGG<br>AGCTAAAGAAGGACGTGTACGTGGTGGAGCTGGACTGGTACCCGGACGCACCCGGCGAGAT<br>GGTCGTTCTGACCTGCGATACGCCAGAGGAGGACGGCATCACCTGGACCCTCGATCAGAGC<br>AGCGAGGTCCTGGGGAGCGGAAAGACCCTGACCATCCAGGTCAAGGAGTTCGGCGACGCCG<br>GCCAGTACACCTGCCACAAAGGTGGCGAGGTCCTGAGCCACTCGCTGCTGCTCCTGCATAA<br>GAAGGAGGACGGAATCTGGAGCACAGACATCCTGAAAGACCAGAAGGAGCCCAAGAACAAG<br>ACCTTCCTGAGGTGCGAGGCCAAGAACTACAGCGGGCGCTTCACGTGCTGGTGGCTGACCA<br>CCATCAGCACGGACCTCACCTTCTCCGTGAAGAGCAGCCGGGGATCCAGCGATCCCCAAGG<br>CGTCACCTGCGGCGCGGCCACCCTGAGCGCGGAGAGGGTCAGGGGCGATAATAAGGAGTAT<br>GAGTACAGCGTGGAGTGCCAGGAGGACAGCGCCTGCCCGGCCGCCGAGGAGTCCCTGCCAA<br>TCGAAGTGATGGTCGACGCCGTGCACAAGCTGAAGTACGAGAACTACACCAGCAGCTTCTT<br>CATCCGGGATATCATCAAGCCCGATCCCCCGAAGAACCTGCAGCTGAAGCCCCTCAAGAAC<br>AGCCGGCAGGTGGAGGTGAGTTGGGAGTACCCCGACACCTGGTCAACGCCCCACAGCTACT<br>TCTCCCTGACCTTCTGTGTGCAGGTGCAGGGAAAGAGCAAGAGGGAGAAGAAAGACCGGGT<br>CTTCACCGACAAGACCAGCGCCACGGTGATCTGCAGGAAGAACGCAAGCATCTCCGTGAGG<br>GCCCAGGACAGGTACTACAGCTCCAGCTGGTCCGAATGGGCCAGCGTGCCCTGTAGCGGCG<br>GCGGGGGCGGTGGCAGCCGCAACCTCCCAGTGGCCACCCCCGACCCCGGCATGTTCCCCTG<br>CCTGCACCACAGCCAGAATCTGCTGAGGGCCGTGAGTAACATGCTGCAGAAGGCAAGGCAA<br>ACCCTCGAATTCTATCCCTGCACCTCCGAGGAGATCGACCACGAGGATATCACCAAGGACA<br>AGACCAGCACCGTCGAGGCCTGTCTCCCCCTGGAGCTGACCAAGAATGAGAGCTGCCTGAA<br>CAGCCGGGAGACCAGCTTCATCACCAACGGGAGCTGCCTGGCCTCCAGGAAGACCTCGTTC<br>ATGATGGCGCTGTGCCTCTCAAGCATATACGAGGATCTGAAGATGTACCAGGTGGAGTTTA<br>AGACGATGAACGCCAAGCTGCTGATGGACCCGAAGAGGCAGATCTTCCTGGACCAGAACAT<br>GCTGGCCGTGATAGACGAGCTCATGCAGGCCCTGAACTTCAACTCCGAGACCGTGCCGCAG<br>AAGTCATCCCTCGAGGAGCCCGACTTCTATAAGACCAAGATCAAGCTGTGCATCCTGCTCC<br>ACGCCTTCCGGATAAGGGCCGTGACGATCGACAGGGTGATGAGCTACCTTAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAATCTAG |
| 1144 | hIL12AB_026 | G*GGGAAATAAGAGAGAAAAGAAGAGTAAGAAGAAATATAAGAGCCACCATGTGCCACCAG<br>CAGCTCGTGATCAGCTGGTTCTCCCTGGTGTTTCTCGCCAGCCCCCTGGTGGCCATCTGGG<br>AGCTGAAGAAGGACGTGTACGTGGTGGAGCTGGACTGGTACCCTGACGCCCCGGGGGAGAT<br>GGTCGTGCTGACCTGCGACACCCCCGAAGAGGACGGTATCACCTGGACCCTGGACCAGTCC<br>AGCGAGGTGCTGGGCAGCGGCAAGACCCTGACTATTCAAGTCAAGGAGTTCGGAGACGCCG<br>GCCAGTACACCTGCCACAAGGGTGGAGAGGTGTTATCACACAGCCTGCTGCTGCTGCACAA<br>GAAGGAAGACGGGATCTGGAGCACCGACATCCTGAAGGACCAGAAGGAGCCCAAAAACAAG<br>ACCTTCCTGCGGTGCGAGGCCAAGAACTATTCGGGCCGCTTTACGTGCTGGTGGCTGACCA<br>CCATCAGCACTGATCTCACCTTCAGCGTGAAGTCCTCCCGGGGGTCGTCCGACCCCCAGGG<br>GGTGACCTGCGGGGCCGCCACCCTGTCCGCCGAGAGAGTGAGGGGCGATAATAAGGAGTAC<br>GAGTACAGCGTTGAGTGCCAGGAAGATAGCGCCTGTCCCGCCGCCGAGGAGAGCCTGCCCA<br>TCGAGGTGATGGTGGACGCCGTCCACAAGCTGAAGTATGAGAACTACACCTCAAGCTTCTT<br>CATCAGGGACATCATCAAACCCGATCCGCCCAAGAATCTGCAGCTGAAGCCCCTGAAAAAT<br>AGCAGGCAGGTGGAGGTGAGCTGGGAGTACCCCGACACCTGGTCCACCCCCCATAGCTATT<br>TCTCCCTGACGTTCTGCGTGCAGGTGCAAGGGAAGAGCAAGCGGGAGAAGAAGGACCGGGT<br>GTTCACCGACAAGACCTCCGCCACCGTGATCTGTAGGAAGAACGCGTCGATCTCGGTCAGG |

TABLE 16A-continued

| mRNA Sequences (with T100 tail) | | |
|---|---|---|
| SEQ ID NO | Description | Sequence |
| | | GCCCAGGACAGGTATTACAGCAGCAGCTGGAGCGAGTGGGCGAGCGTGCCCTGCTCGGGCG<br>GCGGCGGCGGCGGGAGCAGAAATCTGCCCGTGGCCACCCCAGACCCCGGAATGTTCCCCTG<br>CCTGCACCATTCGCAGAACCTCCTGAGGGCCGTGAGCAACATGCTGCAGAAGGCCCGCCAG<br>ACGCTGGAGTTCTACCCCTGCACGAGCGAGGAGATCGACCACGAAGACATCACCAAGGACA<br>AAACCAGCACCGTGGAGGCCTGCCTGCCCCTGGAGCTGACCAAAAACGAATCCTGCCTCAA<br>CAGCCGGGAGACCAGCTTCATCACCAACGGCAGCTGCCTGGCCAGCCGAAAGACCTCCTTC<br>ATGATGGCCCTCTGCCTGAGCAGCATCTATGAGGATCTGAAGATGTATCAGGTGGAGTTCA<br>AGACCATGAATGCCAAGCTGCTGATGGACCCCAAGAGGCAGATATTCCTGGACCAGAATAT<br>GCTGGCCGTGATCGACGAGCTGATGCAGGCCCTGAACTTCAACAGCGAGACCGTCCCCCAG<br>AAGTCCAGCCTGGAGGAGCCGGACTTTTACAAAACGAAGATCAAGCTGTGCATACTGCTGC<br>ACGCCTTCAGGATCCGGGCCGTGACAATCGACAGGGTGATGTCCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1145 | hIL12AB_027 | G*GGGAAATAAGAGAGAAAAGAAGAGTAAGAAGAAATATAAGAGCCACCATGTGTCACCAG<br>CAGCTGGTGATCAGCTGGTTCTCCCTGGTGTTCCTGGCCAGCCCCCTGGTGGCCATCTGGG<br>AGCTCAAGAAGGACGTCTACGTCGTGGAGCTGGATTGGTACCCCGACGCTCCCGGGGAGAT<br>GGTGGTGCTGACCTGCGACACCCCCGAGGAGGACGGCATCACCTGGACGCTGGACCAGAGC<br>TCAGAGGTGCTGGGAAGCGGAAAGACACTGACCATCCAGGTGAAGGAGTTCGGGGATGCCG<br>GGCAGTATACCTGCCACAAGGGCGGCGAAGTGCTGAGCCATTCCCTGCTGCTGCTGCACAA<br>GAAGGAGGACGGCATATGGTCCACCGACATCCTGAAGGATCAGAAGGAGCCGAAGAATAAA<br>ACCTTCCTGAGGTGCGAGGCCAAGAATTACAGCGGCCGATTCACCTGCTGGTGGCTGACCA<br>CCATCAGCACCGACCTGACCTTCAGTGTGAAGTCCTCACGGGGCAGCTCAGATCCCCAGGG<br>CGTGACCTGCGGGGCCGCGACACTCAGCGCCGAGCGGGTGAGGGGTGATAACAAGGAGTAC<br>GAGTATTCTGTGGAGTGCCAGGAAGACTCCGCCTGTCCCGCCGCCGAGGAGTCCCTGCCCA<br>TCGAGGTGATGGTGGACGCCGTGCATAAACTGAAGTACGAGAACTACACCTCCAGCTTCTT<br>CATCCGGGATATAATCAAGCCCGACCCTCCGAAAAACCTGCAGCTGAAGCCCCTTAAAAAC<br>AGCCGGCAGGTGGAGGTGAGCTGGGAGTACCCCGACACCTGGAGCACCCCCCATAGCTATT<br>TCAGCCTGACCTTCTGCGTGCAGGTGCAGGGGAAGTCCAAGCGCGAGAAAAAGGACCGGGT<br>GTTCACCGACAAGACGAGCGCCACCGTGATCTGCCGGAAGAACGCCAGTATAAGCGTAAGG<br>GCCCAGGATAGGTACTACAGCTCCAGCTGGTCGGAGTGGGCCTCCGTGCCCTGTTCCGGCG<br>GCGGGGGGGGTGGCAGCAGGAACCTCCCCGTGGCCACGCCGGACCCCGGCATGTTCCCGTG<br>CCTGCACCACTCCCAAAACCTCCTGCGGGCCGTCAGCAACATGCTGCAAAAGGCGCGGCAG<br>ACCCTGGAGTTTTACCCCTGTACCTCCGAAGAGATCGACCACGAGGATATCACCAAGGATA<br>AGACCTCCACCGTGGAGGCCTGTCTCCCCCTGGAGCTGACCAAGAACGAGAGCTGTCTTAA<br>CAGCAGAGAGACCTCGTTCATAACGAACGGCTCCTGCCTCGCTTCCAGGAAGACGTCGTTC<br>ATGATGGCGCTGTGCCTGTCCAGCATCTACGAGGACCTGAAGATGTATCAGGTCGAGTTCA<br>AAACCATGAACGCCAAGCTGCTGATGGACCCCAAGAGGCAGATCTTCCTGGACCAGAACAT<br>GCTCGCCGTGATCGACGAGCTGATGCAGGCCCTGAACTTCAACAGCGAAACCGTGCCCCAG<br>AAGTCAAGCCTGGAGGAGCCGGACTTCTATAAGACCAAGATCAAGCTGTGTATCCTGCTAC<br>ACGCTTTTCGTATCCGGGCCGTGACCATCGACAGGGTTATGTCGTACTTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1146 | hIL12AB_028 | G*GGGAAATAAGAGAGAAAAGAAGAGTAAGAAGAAATATAAGAGCCACCATGTGCCACCAA<br>CAGCTCGTGATCAGCTGGTTCAGCCTGGTGTTCCTGGCCAGCCCGCTGGTGGCCATCTGGG<br>AGCTGAAGAAGGACGTGTACGTGGTGGAGCTGGACTGGTACCCCGACGCCCCCGGCGAGAT<br>GGTGGTCCTGACCTGCGACACGCCGGAAGAGGACGGCATCACCTGGACCCTGGATCAGTCC<br>AGCGAGGTGCTGGGCTCCGGCAAGACCCTGACCATTCAGGTGAAGGAGTTCGGCGACGCCG<br>GTCAGTACACCTGCCACAAGGGCGGCGAGGTGCTGAGCCACAGCCTACTGCTCCTGCACAA<br>AAAGGAGGATGGAATCTGGTCCACCGACATCCTCAAGGACCAGAAGGAGCCGAAGAACAAG<br>ACGTTCCTCCGGTGCGAGGCCAAGAACTACAGCGGCAGGTTTACCTGCTGGTGGCTGACCA<br>CCATCAGCACCGACCTGACATTTTCCGTGAAGAGCAGCCGCGGCAGCAGCGATCCCCAGGG<br>CGTGACCTGCGGGGCGGCCACCCTGTCCGCCGAGCGTGTGAGGGGCGACAACAAGGAGTAC<br>GAGTACAGCGTGGAATGCCAGGAGGACAGCGCCTGTCCCGCCGCCGAGGAGAGCCTGCCAA<br>TCGAGGTCATGGTGGACGCCGTGCACAAGCTGAAGTACGAGAACTACACGAGCAGCTTCTT<br>CATCAGGGACATCATCAAACCGGACCCGCCCAAGAACCTGCAGCTGAAACCCTTGAAAAAC<br>AGCAGGCAGGTGGAAGTGTCTTGGGAGTACCCCGACACCTGGTCCACCCCCCACAGCTACT<br>TTAGCCTGACCTTCTGTGTGCAGGTCCAGGGCAAGTCCAAGAGGGAGAAGAAGGACAGGGT<br>GTTCACCGACAAAACCAGCGCCACCGTGATCTGCAGGAAGAACGCCTCCATCAGCGTGCGG<br>GCCCAGGACAGGTATTACAGCTCGTCGTGGAGCGAGTGGGCCAGCGTGCCCTGCTCCGGGG<br>GAGGCGGCGGCGGAAGCCGGAATCTGCCCGTGGCCACCCCCGATCCCGGCATGTTCCCGTG<br>TCTGCACCACAGCCAGAACCTGCTGCGGGCCGTGAGCAACATGCTGCAGAAGGCCCGCCAA<br>ACCCTGGAGTTCTACCCCTGTACAAGCGAGGAGATCGACCATGAGGACATTACCAAGGACA<br>AGACCAGCACCGTGGAGGCCTGCCTGCCCCTCGAGCTCACAAAGAACGAATCCTGCCTGAA<br>TAGCCGCGAGACCAGCTTTATCACGAACGGGTCCTGCCTCGCCAGCCGGAAGACAAGCTTC<br>ATGATGGCCCTGTGCCTGAGCAGCATCTACGAGGACCTGAAAATGTACCAAGTGGAGTTCA<br>AAACGATGAACGCCAAGCTGCTGATGGACCCCAAGCGCCAGATCTTCCTGGACCAGAACAT<br>GCTGGCCGTCATCGACGAGCTCATGCAGGCCCTGAACTTCAACAGCGAGACCGTGCCCCAG<br>AAGAGCAGCCTGGAGGAGCCCGACTTCTACAAGACGAAGATCAAGCTCTGCATCCTGCTGC<br>ACGCTTTCCGCATCCGCGCGGTGACCATCGACCGGGTGATGAGCTACCTCAACGCCAGTTG<br>ATAATAGGCTGGAGCCTCGGTGGCCATGCTTCTTGCCCCTTGGGCCTCCCCCCAGCCCCTC |

TABLE 16A-continued mRNA Sequences (with T100 tail)

| SEQ ID NO | Description | Sequence |
|---|---|---|
| | | CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1147 | hIL12AB_029 | G*GGGAAATAAGAGAGAAAAGAAGAGTAAGAAGAAATATAAGAGCCACCATGTGCCACCAA<br>CAGCTGGTGATCAGCTGGTTCAGCCTGGTGTTTCTGGCCTCCCCTCTGGTGGCCATCTGGG<br>AGCTGAAGAAGGACGTGTACGTGGTGGAGCTGGACTGGTACCCTGACGCCCCCGGCGAAAT<br>GGTGGTGCTGACGTGCGACACCCCCGAGGAGGATGGCATCACCTGGACCCTGGACCAAAGC<br>AGCGAGGTCCTCGGAAGCGGCAAGACCCTCACTATCCAAGTGAAGGAGTTCGGGGATGCGG<br>GCCAGTACACCTGCCACAAGGGCGGCGAGGTGCTGTCTCATAGCCTGCTGCTCCTGCATAA<br>GAAGGAAGACGGCATCTGGAGCACCGACATACTGAAGGATCAGAAGGAGCCCAAGAACAAG<br>ACCTTCCTGAGGTGCGAGGCCAAGAACTACTCCGGGCGCTTCACCTGTTGGTGGCTGACCA<br>CCATCTCCACCGACCTGACCTTCAGCGTGAAGAGCAGCAGGGGGAGCAGCGACCCCCAGGG<br>GGTGACCTGCGGAGCCGCGACCTTGTCGGCCGAGCGGGTGAGGGGCGACAATAAGGAGTAC<br>GAGTACTCGGTCGAATGCCAGGAGGACTCCGCCTGCCCCGCCGCCGAGGAGTCCCTCCCCA<br>TCGAAGTGATGGTGGACGCCGTCCACAAGCTGAAGTACGAGAACTACACCAGCAGCTTCTT<br>CATACGGGATATCATCAAGCCCGACCCCCCGAAGAACCTGCAGCTGAAACCCTTGAAGAAC<br>TCCAGGCAGGTGGAGGTGAGCTGGGAGTACCCCGACACCTGGTCCACCCCGCACTCATACT<br>TCAGCCTGACCTTCTGTGTACAGGTCCAGGGCAAGAGCAAGAGGGAAAAGAAGGATAGGGT<br>GTTCACCGACAAGACCTCCGCCACGGTGATCTGTCGGAAAAACGCCAGCATCTCCGTGCGG<br>GCCCAGGACAGGTACTATTCCAGCAGCTGGAGCGAGTGGGCCTCCGTCCCCTGCTCCGGCG<br>GCGGTGGCGGGGGCAGCAGGAACCTCCCCGTGGCCACCCCCGATCCCGGGATGTTCCCATG<br>CCTGCACCACAGCCAAAACCTGCTGAGGGCCGTCTCCAATATGCTGCAGAAGGCGAGGCAG<br>ACCCTGGAGTTCTACCCCTGTACCTCCGAGGAGATCGACCACGAGGATATCACCAAGGACA<br>AGACCTCCACGGTCGAGGCGTGCCTGCCCCTGGAGCTCACGAAGAACGAGAGCTGCCTTAA<br>CTCCAGGGAAACCTCGTTTATCACGAACGGCAGCTGCCTGGCGTCACGGAAGACCTCCTTT<br>ATGATGGCCCTATGTCTGTCCTCGATCTACGAGGACCTGAAGATGTACCAGGTGGAGTTCA<br>AGACCATGAACGCCAAGCTGCTGATGGATCCCAAGAGGCAGATTTTCCTGGACCAGAACAT<br>GCTGGCCGTGATTGACGAGCTGATGCAGGCGCTGAACTTCAACAGCGAGACAGTGCCGCAG<br>AAGAGCTCCCTGGAGGAGCCGGACTTTTACAAGACCAAGATAAAGCTGTGCATCCTGCTCC<br>ACGCCTTCAGAATACGGGCCGTCACCATCGATAGGGTGATGTCTTACCTGAACGCCTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1148 | hIL12AB_030 | G*GGGAAATAAGAGAGAAAAGAAGAGTAAGAAGAAATATAAGAGCCACCATGTGCCACCAG<br>CAGCTGGTGATTAGCTGGTTTAGCCTGGTGTTCCTGGCAAGCCCCCTGGTGGCCATCTGGG<br>AACTGAAAAAGGACGTGTACGTGGTCGAGCTGGATTGGTACCCCGACGCCCCCGGCGAAAT<br>GGTGGTGCTGACGTGTGATACCCCCGAGGAGGACGGGATCACCTGGACCCTGGATCAGAGC<br>AGCGAGGTGCTGGGGAGCGGGAAGACCCTGACGATCCAGGTCAAGGAGTTCGGCGACGCTG<br>GGCAGTACACCTGTCACAAGGGCGGGGAGGTGCTGTCCCACTCCCTGCTGCTCCTGCATAA<br>GAAAGAGGACGGCATCTGGTCCACCGACATCCTCAAGGACCAGAAGGAGCCCAAGAACAAG<br>ACCTTCCTGCGGTGTGAGGCGAAGAACTACAGCGGCCGTTTCACCTGCTGGTGGCTGACGA<br>CAATCAGCACCGACTTGACGTTCTCCGTGAAGTCCTCCAGAGGCAGCTCCGACCCCCAAGG<br>GGTGACGTGCGGCGCGGCCACCCTGAGCGCCGAGCGGGTGCGGGGGGACAACAAGGAGTAC<br>GAGTACTCCGTGGAGTGCCAGGAGGACAGCGCCTGTCCCGCAGCCGAGGAGTCCCTGCCCA<br>TCGAAGTCATGGTGGACGCCGTCCACAAGCTGAAGTACGAGAACTACACCAGCAGCTTCTT<br>CATCCGCGATATCATCAAGCCCGATCCCCCCAAAAACCTGCAACTGAAGCCGCTGAAGAAT<br>AGCAGGCAGGTGGAGGTGTCCTGGGAGTACCCGGACACCTGGAGCACGCCCCACAGCTATT<br>TCAGCCTGACCTTTTGCGTGCAGGTCCAGGGGAAGAGCAAGCGGGAGAAGAAGGACCGCGT<br>GTTTACGGACAAAACCAGCGCCACCGTGATCTGCAGGAAGAACGCCAGCATCAGCGTGAGG<br>GCCCAGGACAGGTACTACAGCAGCTCCTGGAGCGAGTGGGCCTCCGTGCCCTGTTCCGGAG<br>GCGGCGGGGGCGGTTCCCGGAACCTCCCGGTGGCCACCCCCGACCCGGGCATGTTCCCGTG<br>CCTGCACCACTCACAGAATCTGCTGAGGGCCGTGAGCAATATGCTGCAGAAGGCAAGGCAG<br>ACCCTGGAGTTTTATCCCTGCACCAGCGAGGAGATCGACCACGAAGACATCACCAAGGACA<br>AGACCAGCACAGTGGAGGCCTGCCTGCCCCTGGAACTGACCAAGAACGAGTCCTGTCTGAA<br>CTCCCGGGAAACCAGCTTCATAACCAACGGCTCCTGTCTCGCCAGCAGGAAGACCAGCTTC<br>ATGATGGCCCTGTGCCTCAGCTCCATCTACGAGGACCTCAAGATGTACCAGGTTGAGTTCA<br>AGACCATGAACGCCAAGCTCCTGATGGACCCCAAGAGGCAGATCTTCCTGGACCAGAATAT<br>GCTGGCCGTGATCGATGAGTTAATGCAGGCGCTGAACTTCAACAGCGAGACGGTGCCCCAA<br>AAGTCCTCGCTGGAGGAGCCCGACTTCTACAAGACCAAGATCAAGCTGTGCATCCTCCTGC<br>ACGCCTTCCGAATCCGGGCCGTAACCATCGACAGGGTGATGAGCTATCTCAACGCCTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1149 | hIL12AB_031 | G*GGGAAATAAGAGAGAAAAGAAGAGTAAGAAGAAATATAAGAGCCACCATGTGCCACCAG<br>CAGCTCGTGATCAGCTGGTTCTCGCTTGTGTTCCTGGCCTCCCCCCTCGTCGCCATCTGGG<br>AGCTGAAGAAAGACGTGTACGTGGTGGAGCTGGACTGGTATCCCGACGCCCCGGGGGAGAT<br>GGTGGTGCTGACCTGCGACACCCCGGAAGAGGACGGCATCACCTGGACGCTCGACCAGTCG<br>TCCGAAGTGCTGGGGTCGGGCAAGACCCTCACCATCCAGGTGAAGGAGTTCGGAGACGCCG<br>GCCAGTACACCTGTCATAAGGGGGGGGAGGTGCTGAGCCACAGCCTCCTGCTCCTGCACAA<br>AAAGGAGGACGGCATCTGGAGCACCGATATCCTCAAGGACCAGAAGGAGCCCAAGAACAAG<br>ACGTTCCTGAGGTGTGAGGCCAAGAACTACAGCGGGCGGTTCACGTGTTGGTGGCTCACCA |

TABLE 16A-continued mRNA Sequences (with T100 tail)

| SEQ ID NO | Description | Sequence |
|---|---|---|
| | | CCATCTCCACCGACCTCACCTTCTCCGTGAAGTCAAGCAGGGGCAGCTCCGACCCCCAAGG<br>CGTCACCTGCGGCGCCGCCACCCTGAGCGCCGAGAGGGTCAGGGGGGATAACAAGGAATAC<br>GAGTACAGTGTGGAGTGCCAAGAGGATAGCGCCTGTCCCGCCGCCGAAGAGAGCCTGCCCA<br>TCGAAGTGATGGTGGACGCCGTGCACAAGCTGAAGTACGAGAACTACACCTCCAGCTTCTT<br>CATCAGGGATATCATCAAGCCCGATCCCCCCAAGAACCTGCAGCTGAAGCCCCTGAAGAAC<br>AGCAGGCAGGTGGAGGTGAGCTGGGAGTATCCCGACACGTGGAGCACCCCGCACAGCTACT<br>TCTCGCTGACCTTCTGCGTGCAGGTGCAAGGGAAGTCCAAGAGGGAGAAGAAGGATAGGGT<br>GTTCACCGACAAAACGAGCGCCACCGTGATCTGCCGGAAGAATGCCAGCATCTCTGTGAGG<br>GCCCAGGACAGGTACTATTCCAGCTCCTGGTCGGAGTGGGCCAGCGTGCCCTGTAGCGGCG<br>GGGGCGGGGGCGGCAGCAGGAACCTCCCGGTTGCCACCCCCGACCCCGGCATGTTTCCGTG<br>CCTGCACCACTCGCAAAACCTGCTGCGCGCGGTCTCCAACATGCTGCAAAAAGCGCGCCAG<br>ACGCTGGAGTTCTACCCCTGCACCAGCGAGGAGATCGATCATGAAGATATCACCAAAGACA<br>AGACCTCGACCGTGGAGGCCTGCCTGCCCCTGGAGCTCACCAAGAACGAAAGCTGCCTGAA<br>CAGCAGGGAGACAAGCTTCATCACCAACGGCAGCTGCCTGGCCTCCCGGAAGACCAGCTTC<br>ATGATGGCCCTGTGCCTGTCCAGCATCTACGAGGATCTGAAGATGTACCAAGTGGAGTTTA<br>AGACCATGAACGCCAAGCTGTTAATGGACCCCAAAAGGCAGATCTTCCTGGATCAGAACAT<br>GCTGGCCGTCATCGACGAGCTGATGCAAGCCCTGAACTTCAACAGCGAGACGGTGCCCCAG<br>AAGAGCAGCCTCGAGGAGCCCGACTTCTATAAGACCAAGATAAAGCTGTGCATTCTGCTGC<br>ACGCCTTCAGAATCAGGGCCGTGACCATCGATAGGGTGATGAGCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1150 | hIL12AB_032 | G*GGGAAATAAGAGAGAAAAGAAGAGTAAGAAGAAATATAAGAGCCACCATGTGTCACCAG<br>CAGCTGGTGATTTCCTGGTTCAGTCTGGTGTTTCTTGCCAGCCCCCTGGTGGCCATCTGGG<br>AGCTGAAGAAAGACGTATACGTCGTGGAGCTGGACTGGTATCCCGACGCTCCCGGCGAGAT<br>GGTGGTCCTCACCTGCGACACCCCAGAGGAGGACGGCATCACCTGGACCCTGGACCAGAGC<br>TCCGAGGTCCTGGGCAGCGGTAAGACCCTCACCATCCAGGTGAAGGAGTTTGGTGATGCCG<br>GGCAGTATACCTGCCACAAGGGCGGCGAGGTGCTGTCCCACAGCCTCCTGTTACTGCATAA<br>GAAGGAGGATGGCATCTGGAGCACCGACATCCTCAAGGACCAGAAAGAGCCCAAGAACAAG<br>ACCTTTCTGCGGTGCGAGGCGAAAAATTACTCCGGCCGGTTCACCTGCTGGTGGCTGACCA<br>CCATCAGCACGGACCTGACGTTCTCCGTGAAGTCGAGCAGGGGGAGCTCCGATCCCCAGGG<br>CGTGACCTGCGGCGCGGCCACCCTGAGCGCCGAGCGCGTCCGCGGGGACAATAAGGAATAC<br>GAATATAGCGTGGAGTGCCAGGAGGACAGCGCCTGCCCCGCGGCCGAGGAGAGCCTCCCGA<br>TCGAGGTGATGGTGGATGCCGTCCACAAGCTCAAATACGAAAACTACACCAGCAGCTTCTT<br>CATTAGGGACATCATCAAGCCCGACCCCCCCAAAAACCTGCAGCTGAAGCCCCTGAAGAAC<br>AGCCGCCAGGTCGAGGTGTCATGGGAGTACCCAGACACCTGGAGCACCCCCCACTCCTACT<br>TCAGCCTGACCTTCTGCGTCCAGGTGCAGGGAAAGTCCAAACGGGAGAAGAAGGATAGGGT<br>CTTTACCGATAAGACGTCGGCCACCGTCATCTGCAGGAAGAACGCCAGCATAAGCGTGCGG<br>GCGCAGGATCGGTACTACAGCTCGAGCTGGTCCGAATGGGCCTCCGTGCCCTGTAGCGGAG<br>GGGGTGGCGGGGGCAGCAGGAACCTGCCCGTGGCCACCCCGGACCCGGGCATGTTTCCCTG<br>CCTGCATCACAGTCAGAACCTGCTGAGGGCCGTGAGCAACATGCTCCAGAAGGCCCGCCAG<br>ACCCTGGAGTTTTACCCCTGCACCAGCGAAGAGATCGATCACGAAGACATCACCAAAGACA<br>AGACCTCCACCGTGGAGGCCTGTCTGCCCCTGGAGCTGACCAAGAACGAGAGCTGTCTGAA<br>CAGCAGGGAGACCTCCTTCATCACCAACGGCTCCTGCCTGGCATCCCGGAAGACCAGCTTC<br>ATGATGGCCCTGTGTCTGAGCTCTATCTACGAGGACCTGAAGATGTACCAGGTCGAGTTCA<br>AGACCATGAACGCCAAGCTGCTGATGGACCCCAAGCGACAGATATTCCTGGACCAGAACAT<br>GCTCGCCGTGATCGATGAACTGATGCAAGCCCTGAACTTCAATAGCGAGACCGTGCCCCAG<br>AAAAGCAGCCTGGAGGAGCCCGACTTCTACAAGACCAAGATCAAACTGTGCATACTGCTGC<br>ACGCGTTCAGGATCCGGGCCGTCACCATCGACCGGGTGATGTCCTATCTGAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1151 | hIL12AB_033 | G*GGGAAATAAGAGAGAAAAGAAGAGTAAGAAGAAATATAAGAGCCACCATGTGCCACCAG<br>CAGCTCGTGATTAGCTGGTTTTCGCTGGTGTTCCTGGCCAGCCCTCTCGTGGCCATCTGGG<br>AGCTGAAAAAAGACGTGTACGTGGTGGAGCTGGACTGGTACCCGGACGCCCCCGGCGAGAT<br>GGTGGTGCTGACGTGCGACACCCCGGAAGAGGACGGCATCACCTGGACCCTGGACCAGTCA<br>TCCGAGGTCCTGGGCAGCGGCAAGACGCTCACCATCCAGGTGAAGGAGTTCGGCGACGCCG<br>GCCAGTACACATGCCATAAGGGCGGGGAGGTGCTGAGCCACAGCCTGCTCCTCCTGCACAA<br>GAAGGAGGATGGCATCTGGTCTACAGACATCCTGAAGGACCAGAAAGAGCCCAAGAACAAG<br>ACCTTCCTCCGGTGCGAGGCCAAGAACTACTCCGGGCGGTTTACTTGTTGGTGGCTGACCA<br>CCATCAGCACCGACCTCACCTTCAGCGTGAAGAGCTCCCGAGGGAGCTCCGACCCCCAGGG<br>GGTCACCTGCGGCGCCGCCACCCTGAGCGCCGAGCGGGTGAGGGGCGACAACAAGGAGTAT<br>GAATACAGCGTGGAATGCCAAGAGGACAGCGCCTGTCCCGCGGCCGAGGAAAGCCTGCCCA<br>TCGAGGTGATGGTGGACGCCGTCCACAAACTCAAGTACGAGAACTACACCAGCAGTTTCTT<br>CATTCGCGACATCATCAAGCCGGACCCCCCCAAAAACCTGCAGCTCAAACCCCTGAAGAAC<br>AGCAGGCAGGTGGAGGTCAGCTGGGAGTACCCGGACACCTGGAGCACCCCCCATAGCTACT<br>TCAGCCTGACCTTCTGCGTGCAGGTGCAGGGCAAGAGCAAACGCGAGAAGAAGGACCGGGT<br>GTTTACCGACAAGACCAGCGCCACGGTGATCTGCCGAAAGAATGCAAGCATCTCCGTGAGG<br>GCGCAGGACCGCTACTACTCTAGCAGCTGGAGCGAGTGGGCCAGCGTGCCCTGCAGCGGTG<br>GCGGCGGAGGCGGCAGCCGTAACCTCCCCGTGGCCACCCCCGACCCCGGCATGTTCCCGTG<br>TCTGCACCACTCCCAGAACCTGCTGAGGGCCGTCAGCAATATGCTGCAGAAGGCCCGGCAG<br>ACGCTGGAGTTCTACCCCTGCACCTCCGAGGAGATCGACCATGAGGACATTACCAAGGACA |

TABLE 16A-continued mRNA Sequences (with T100 tail)

| SEQ ID NO | Description | Sequence |
|---|---|---|
| | | AGACGAGCACTGTGGAGGCCTGCCTGCCCCTGGAGCTCACCAAAAACGAGAGCTGCCTGAA<br>TAGCAGGGAGACGTCCTTCATCACCAACGGCAGCTGTCTGGCCAGCAGGAAGACCAGCTTC<br>ATGATGGCCCTGTGCCTCTCCTCCATATATGAGGATCTGAAGATGTACCAGGTGGAGTTCA<br>AGACCATGAACGCCAAGCTGCTGATGGATCCCAAGAGGCAGATCTTCCTGGACCAGAATAT<br>GCTGGCCGTGATTGACGAGCTGATGCAGGCCCTGAACTTTAATAGCGAGACCGTCCCCCAG<br>AAGAGCAGCCTGGAGGAGCCCGACTTCTATAAGACCAAGATCAAGCTGTGCATACTGCTGC<br>ACGCGTTTAGGATAAGGGCCGTCACCATCGACAGGGTGATGAGCTACCTGAATGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1152 | hIL12AB_034 | G*GGGAAATAAGAGAGAAAAGAAGAGTAAGAAGAAATATAAGAGCCACCATGTGCCACCAA<br>CAGCTGGTGATCTCCTGGTTCAGCCTGGTGTTCCTCGCCAGCCCCCTGGTGGCCATCTGGG<br>AGCTGAAGAAAGACGTGTACGTGGTGGAGCTGGACTGGTATCCCGACGCCCCCGGCGAGAT<br>GGTCGTGCTGACCTGCGACACCCCGGAGGAGGACGGCATCACCTGGACCCTGGATCAGTCC<br>TCCGAGGTGCTGGGCAGCGGGAAGACCCTGACCATCCAGGTGAAAGAGTTCGGAGATGCCG<br>GCCAGTATACCTGTCACAAGGGGGGTGAGGTGCTGAGCCATAGCCTCTTGCTTCTGCACAA<br>GAAGGAGGACGGCATCTGGTCCACCGACATCCTCAAGGACCAAAAGGAGCCGAAGAATAAA<br>ACGTTCCTGAGGTGCGAAGCCAAGAACTATTCCGGACGGTTCACCTGCTGGTGGCTGACCA<br>CCATCAGCACCGACCTCACCTTCTCCGTAAAGTCAAGCAGGGGCAGCTCCGACCCCCAGGG<br>CGTGACCTGCGGAGCCGCCACCCTGAGCGCAGAGAGGGTGAGGGGCGACAACAAGGAGTAC<br>GAATACTCCGTCGAGTGCCAGGAGGACAGCGCCTGCCCCGCCGCCGAGGAAAGTCTGCCCA<br>TCGAGGTGATGGTGGACGCCGTGCACAAGCTCAAATACGAGAACTACACCAGCAGCTTCTT<br>CATCCGGGATATCATCAAGCCCGACCCTCCAAAGAATCTGCAGCTGAAACCCCTTAAGAAC<br>AGCAGGCAGGTGGAGGTCAGCTGGGAGTACCCCGACACCTGGAGCACGCCCCACTCCTACT<br>TTAGCCTGACCTTTTGCGTGCAGGTGCAGGGGAAAAGCAAGCGGGAGAAGAAGGACAGGGT<br>GTTCACCGATAAGACCTCCGCTACCGTGATCTGCAGGAAGAACGCCTCAATCAGCGTGAGG<br>GCCCAGGATCGGTACTACTCCAGCTCCTGGAGCGAGTGGGCCAGCGTGCCCTGCTCTGGCG<br>GTGGCGGCGGGGGCAGCCGGAACCTGCCGGTGGCCACTCCCGACCCGGGCATGTTCCCGTG<br>CCTCCACCATTCCCAGAACCTGCTGCGGGCCGTGTCCAATATGCTCCAGAAGGCAAGGCAG<br>ACCCTGGAGTTCTACCCCTGCACCAGCGAGGAGATCGATCACGAGGACATCACCAAAGACA<br>AAACCAGCACGGTCGAGGCCTGCCTGCCCCTGGAACTCACCAAGAACGAAAGCTGTCTCAA<br>CAGCCGCGAGACCAGCTTCATAACCAACGGTTCCTGTCTGGCCTCCCGCAAGACCAGCTTT<br>ATGATGGCCCTCTGTCTGAGCTCCATCTATGAAGACCTGAAAATGTACCAGGTGGAGTTCA<br>AAACCATGAACGCCAAGCTTCTGATGGACCCCAAGAGGCAGATCTTCCTGGATCAGAACAT<br>GCTGGCCGTGATCGACGAGCTGATGCAGGCCCTGAACTTTAACTCCGAGACCGTGCCCCAG<br>AAAAGCAGCCTGGAAGAGCCCGATTTCTACAAAACGAAGATCAAGCTGTGCATCCTGCTGC<br>ACGCCTTCCGGATCCGTGCGGTGACCATCGATAGGGTGATGAGCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1153 | hIL12AB_035 | G*GGGAAATAAGAGAGAAAAGAAGAGTAAGAAGAAATATAAGAGCCACCATGTGCCACCAA<br>CAGCTGGTAATCAGCTGGTTCAGCCTGGTTTTCCTCGCGTCGCCCCTGGTGGCCATCTGGG<br>AGTTAAAGAAGGACGTGTACGTGGTGGAGCTGGATTGGTACCCCGACGCCCCGGGCGAGAT<br>GGTCGTGCTCACCTGCGATACCCCCGAGGAGGACGGGATCACCTGGACCCTGGACCAATCC<br>AGCGAGGTGCTGGGCAGCGGCAAGACCCTGACCATACAGGTGAAGGAATTTGGGGACGCCG<br>GGCAGTACACCTGCCACAAGGGCGGGGAAGTGCTGTCCCACTCCCTCCTGCTGCTGCATAA<br>GAAGGAGGACGGCATCTGGAGCACCGACATCCTGAAGGACCAAAAGGAGCCCAAGAACAAG<br>ACCTTCCTGAGGTGCGAGGCCAAAAACTATTCCGGCCGCTTTACCTGTTGGTGGCTGACCA<br>CCATCTCCACCGATCTGACCTTCAGCGTGAAGTCGTCTAGGGGCTCCTCCGACCCCCAGGG<br>CGTAACCTGCGGCGCCGCGACCCTGAGCGCCGAGAGGGTGCGGGGCGATAACAAAGAGTAC<br>GAGTACTCGGTGGAGTGCCAGGAGGACAGCGCCTGTCCGGCGGCCGAGGAGAGCCTGCCCA<br>TCGAGGTGATGGTGGACGCCGTCCACAAGCTGAAGTACGAGAACTACACCAGTTCGTTCTT<br>CATCAGGGACATCATCAAGCCGGACCCCCCCAAGAACCTCCAGCTGAAGCCCCTGAAGAAC<br>AGCAGGCAGGTGGAAGTGTCCTGGGAGTATCCCGACACCTGGAGCACCCCCCACAGCTACT<br>TCAGCCTGACCTTTTGCGTGCAGGTGCAGGGCAAAAGCAAGAGGGAAAAGAAGGACCGGGT<br>GTTCACCGATAAGACGAGCGCCACCGTTATCTGCAGGAAGAACGCCTCCATAAGCGTGAGG<br>GCGCAGGACCGTTACTACAGCAGCAGCTGGAGTGAGTGGGCAAGCGTGCCCTGTAGCGGCG<br>GGGGCGGGGGCGGGTCCCGCAACCTCCCCGTCGCCACCCCCGACCCAGGCATGTTTCCGTG<br>CCTGCACCACAGCCAGAACCTGCTGCGGGCCGTTAGCAACATGCTGCAGAAGGCCAGGCAG<br>ACCCTCGAGTTCTATCCCTGCACATCTGAGGAGATCGACCACGAAGACATCACTAAGGATA<br>AGACCTCCACCGTGGAGGCCTGTCTGCCCCTCGAGCTGACCAAGAATGAATCCTGCCTGAA<br>CAGCCGAGAGACCAGCTTTATCACCAACGGCTCCTGCCTGGCCAGCAGGAAGACCTCCTTC<br>ATGATGGCCCTGTGCCTCTCCAGCATCTACGAGGATCTGAAGATGTACCAGGTAGAGTTCA<br>AGACGATGAACGCCAAGCTCCTGATGGACCCCAAGAGGCAGATATTCCTGGACCAGAACAT<br>GCTGGCGGTGATCGACGAGCTGATGCAGGCCCTGAATTTCAACAGCGAGACGGTGCCACAG<br>AAGTCCAGCCTGGAGGAGCCAGACTTCTACAAGACCAAGATCAAACTGTGCATCCTCCTGC<br>ACGCGTTCAGGATCCGCGCCGTCACCATAGACAGGGTGATGAGTTATCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |

TABLE 16A-continued

| mRNA Sequences (with T100 tail) | | |
|---|---|---|
| SEQ ID NO | Description | Sequence |
| 1154 | hIL12AB_036 | G*GGGAAATAAGAGAGAAAAGAAGAGTAAGAAGAAATATAAGAGCCACCATGTGCCATCAG<br>CAGCTGGTAATCAGCTGGTTTAGCCTGGTGTTCCTGGCCAGCCCACTGGTGGCCATCTGGG<br>AGCTGAAGAAGGACGTGTACGTGGTGGAACTGGACTGGTACCCCGACGCCCCTGGCGAGAT<br>GGTGGTACTGACCTGTGACACCCCGGAGGAAGACGGTATCACCTGGACCCTGGATCAGAGC<br>TCCGAGGTGCTGGGCTCCGGCAAGACACTGACCATCCAAGTTAAGGAATTTGGGGACGCCG<br>GCCAGTACACCTGCCACAAGGGGGGCGAGGTGCTGTCCCACTCCCTGCTGCTTCTGCATAA<br>GAAGGAGGATGGCATCTGGTCCACCGACATACTGAAGGACCAGAAGGAGCCCAAGAATAAG<br>ACCTTCCTGAGATGCGAGGCCAAGAACTACTCGGGAAGGTTCACCTGCTGGTGGCTGACCA<br>CCATCAGCACCGACCTGACCTTCTCCGTGAAGAGCTCCCGGGGCAGCTCCGACCCCCAGGG<br>CGTAACCTGTGGGGCCGCTACCCTGTCCGCCGAGAGGGTCCGGGGCGACAACAAGGAATAC<br>GAGTACAGCGTGGAGTGCCAGGAGGACTCCGCCTGCCCCGCCGCCGAGGAGTCGCTGCCCA<br>TAGAGGTGATGGTGGACGCCGTGCACAAGCTCAAGTACGAGAATTACACCAGCAGCTTCTT<br>TATCAGGGACATAATTAAGCCGGACCCCCCAAAGAATCTGCAGCTGAAGCCCCTGAAGAAT<br>AGCCGGCAGGTGGAAGTGTCCTGGGAGTACCCCGACACCTGGAGCACCCCCCACTCCTATT<br>TCTCACTGACATTCTGCGTGCAGGTGCAAGGGAAAAGCAAGAGGGAGAAGAAGGATAGGGT<br>GTTCACCGACAAGACAAGCGCCACCGTGATCTGCCGAAAAAATGCCAGCATCAGCGTGAGG<br>GCCCAGGATCGGTATTACAGCAGCTCCTGGAGCGAGTGGGCCAGCGTGCCCTGTTCCGGCG<br>GGGGAGGGGGCGGCTCCCGGAACCTGCCGGTGGCCACCCCCGACCCTGGCATGTTCCCCTG<br>CCTGCATCACAGCCAGAACCTGCTCCGGGCCGTGTCGAACATGCTGCAGAAGGCCCGGCAG<br>ACCCTCGAGTTTTACCCCTGCACCAGCGAAGAGATCGACCACGAAGACATAACCAAGGACA<br>AGACCAGCACGGTGGAGGCCTGCCTGCCCCTGGAGCTTACCAAAAACGAGTCCTGCCTGAA<br>CAGCCGGGAAACCAGCTTCATAACGAACGGGAGCTGCCTGGCCTCCAGGAAGACCAGCTTC<br>ATGATGGCGCTGTGTCTGTCCAGCATATACGAGGATCTGAAGATGTATCAGGTGGAATTCA<br>AAACTATGAATGCCAAGCTCCTGATGGACCCCAAGAGGCAGATCTTCCTGGACCAGAACAT<br>GCTAGCCGTGATCGACGAGCTGATGCAGGCCCTCAACTTCAACTCGGAGACGGTGCCCCAG<br>AAGTCCAGCCTCGAGGAGCCCGACTTCTACAAGACCAAGATCAAGCTGTGCATACTGCTGC<br>ATGCCTTCAGGATAAGGGCGGTGACTATCGACAGGGTCATGTCCTACCTGAACGCCAGCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1155 | hIL12AB_037 | G*GGGAAATAAGAGAGAAAAGAAGAGTAAGAAGAAATATAAGAGCCACCATGTGCCACCAA<br>CAACTGGTGATCAGCTGGTTCTCCCTGGTGTTCCTGGCCAGCCCCCTGGTGGCCATCTGGG<br>AGCTCAAAAAAGACGTGTACGTGGTGGAGCTCGATTGGTACCCAGACGCGCCGGGGGAAAT<br>GGTGGTGCTGACCTGCGACACCCCAGAGGAGGATGGCATCACGTGGACGCTGGATCAGTCC<br>AGCGAGGTGCTGGGGAGCGGCAAGACGCTCACCATCCAGGTGAAGGAATTTGGCGACGCGG<br>GCCAGTATACCTGTCACAAGGGCGGCGAGGTGCTGAGCCACTCCCTGCTGCTGCTGCACAA<br>GAAGGAGGATGGGATCTGGTCAACCGATATCCTGAAAGACCAGAAGGAGCCCAAGAACAAG<br>ACCTTCCTGCGCTGCGAGGCCAAGAACTATAGCGGCAGGTTCACCTGCTGGTGGCTGACCA<br>CCATCAGCACCGACCTGACCTTCAGCGTGAAATCCTCCAGGGGCAGCAGCGACCCCCAGGG<br>CGTGACCTGCGGTGCCGCCACGCTCTCCGCCGAGCGAGTGAGGGGTGACAACAAGGAGTAC<br>GAGTACAGCGTGGAATGTCAGGAGGACAGCGCCTGTCCCGCCGCCGAGGAGTCGCTGCCCA<br>TCGAGGTGATGGTCGACGCGGTGCACAAGCTCAAATACGAGAATTACACCAGCAGCTTCTT<br>CATCAGGGACATCATCAAGCCCGACCCCCCCAAGAACCTGCAGCTGAAGCCCTTGAAGAAC<br>AGCAGGCAGGTGGAGGTGAGCTGGGAGTACCCGGACACCTGGAGCACCCCCCACTCCTACT<br>TCAGCCTGACGTTCTGTGTGCAGGTGCAGGGGAAGTCCAAGAGGGAGAAGAAGGACCGGGT<br>GTTCACCGACAAGACCAGCGCCACCGTGATATGCCGCAAGAACGCGTCCATCAGCGTTCGC<br>GCCCAGGACCGCTACTACAGCAGCTCCTGGTCCGAATGGGCCAGCGTGCCCTGCAGCGGTG<br>GAGGGGGCGGGGGCTCCAGGAATCTGCCGGTGGCCACCCCCGACCCCGGGATGTTCCCGTG<br>TCTGCATCACTCCCAGAACCTGCTGCGGGCCGTGAGCAATATGCTGCAGAAGGCCAGGCAG<br>ACGCTCGAGTTCTACCCCTGCACCTCCGAAGAGATCGACCATGAGGACATCACCAAGGACA<br>AGACCAGCACCGTGGAGGCCTGCCTCCCCCTGGAGCTGACCAAAAACGAGAGCTGCCTGAA<br>CTCCAGGGAGACCAGCTTTATAACCAACGGCAGCTGCCTCGCCTCCAGGAAGACCTCGTTT<br>ATGATGGCCCTCTGCCTGTCCAGCATCTACGAGGACCTGAAGATGTACCAGGTGGAGTTCA<br>AGACCATGAACGCGAAGTTGCTCATGGACCCCAAGAGGCAGATCTTCCTGGACCAGAACAT<br>GCTCGCGGTGATCGACGAGCTGATGCAAGCCCTGAACTTCAACAGCGAGACCGTGCCCCAG<br>AAGAGCAGCCTGGAAGAGCCCGACTTCTACAAGACCAAGATCAAGCTGTGCATCCTGCTGC<br>ACGCCTTCCGGATCCGGGCCGTGACCATCGACAGGGTGATGAGCTACCTCAACGCCTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCAAACACCATTGTCACACTCCAGTGGTCTTTGAATA<br>AAGTCTGAGTGGGCGGCAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |
| 1156 | hIL12AB_038 | G*GGGAAATAAGAGAGAAAAGAAGAGTAAGAAGAAATATAAGAGCCACCATGTGCCACCAG<br>CAGCTCGTGATCAGCTGGTTCTCCCTCGTCTTCCTGGCCTCCCCGCTGGTGGCCATCTGGG<br>AGCTGAAGAAGGACGTGTACGTGGTGGAGCTGGACTGGTATCCCGACGCCCCCGGCGAGAT<br>GGTGGTGCTGACGTGCGACACACCAGAAGAGGACGGGATCACATGGACCCTGGATCAGTCG<br>TCCGAGGTGCTGGGGAGCGGCAAGACCCTCACCATCCAAGTGAAGGAGTTCGGGGACGCCG<br>GCCAGTACACCTGCCACAAGGGCGGGGAGGTGCTCTCCCATAGCCTGCTCCTCCTGCACAA<br>AAAGGAGGATGGCATCTGGAGCACCGACATCCTGAAGGACCAGAAGGAGCCCAAGAACAAG<br>ACATTTCTCAGGTGTGAGGCCAAGAACTATTCGGGCAGGTTTACCTGTTGGTGGCTCACCA<br>CCATCTCTACCGACCTGACGTTCTCCGTCAAGTCAAGCAGGGGGAGCTCGGACCCCCAGGG<br>GGTGACATGTGGGGCCGCCACCCTGAGCGCGGAGCGTGTCCGCGGCGACAACAAGGAGTAC<br>GAGTATTCCGTGGAGTGCCAGGAGGACAGCGCCTGCCCCGCCGCCGAGGAGTCCCTGCCCA<br>TAGAGGTGATGGTGGACGCCGTCCACAAGTTGAAGTACGAAAATTATACCTCCTCGTTCTT |

TABLE 16A-continued mRNA Sequences (with T100 tail)

| SEQ ID NO | Description | Sequence |
|---|---|---|
| | | CATTAGGGACATCATCAAGCCTGACCCCCCGAAGAACCTACAACTCAAGCCCCTCAAGAAC |
| | | TCCCGCCAGGTGGAGGTGTCCTGGGAGTACCCCGACACCTGGTCCACCCCGCACAGCTACT |
| | | TCAGCCTGACCTTCTGCGTGCAGGTCCAGGGGAAGAGCAAGCGTGAAAAGAAAGACAGGGT |
| | | GTTCACCGACAAGACGAGCGCCACCGTGATCTGCAGGAAAAACGCCTCCATCTCCGTGCGC |
| | | GCCCAGGACAGGTACTACAGTAGCTCCTGGAGCGAATGGGCCAGCGTGCCGTGCAGCGGCG |
| | | GGGGAGGAGGCGGCAGTCGCAACCTGCCCGTGGCCACCCCCGACCCCGGCATGTTCCCATG |
| | | CCTGCACCACAGCCAGAACCTGCTGAGGGCAGTCAGCAATATGCTGCAGAAGGCCAGGCAG |
| | | ACCCTGGAGTTTTATCCCTGCACCAGCGAGGAGATCGACCACGAGGACATCACCAAGGACA |
| | | AGACCTCCACCGTCGAGGCCTGCCTGCCACTGGAGCTGACCAAAAACGAGAGCTGCCTGAA |
| | | CTCCAGGGAGACCTCCTTCATCACCAACGGGAGCTGCCTGGCCAGCCGGAAGACCAGCTTC |
| | | ATGATGGCGCTGTGCCTCAGCAGCATCTACGAGGATCTCAAGATGTACCAGGTGGAGTTCA |
| | | AGACCATGAACGCGAAGCTGCTGATGGACCCCAAGCGGCAGATCTTCCTGGACCAGAACAT |
| | | GCTGGCCGTGATTGACGAGCTCATGCAGGCCCTGAACTTCAATAGCGAGACCGTCCCCCAA |
| | | AAGAGCAGCCTGGAGGAACCCGACTTCTACAAAACGAAGATCAAGCTCTGCATCCTGCTGC |
| | | ACGCCTTCCGGATCCGGGCCGTGACCATCGATCGTGTGATGAGCTACCTGAACGCCTCGTG |
| | | ATAATAGGCTGGAGCCTCGGTGGCCATGCTTCTTGCCCCTTGGGCCTCCCCCCAGCCCCTC |
| | | CTCCCCTTCCTGCACCCGTACCCCCCAAACACCATTGTCACACTCCAGTGGTCTTTGAATA |
| | | AAGTCTGAGTGGGCGGCAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAAAAAATCTAG |
| 1157 | hIL12AB_039 | G*GGGAAATAAGAGAGAAAAGAAGAGTAAGAAGAAATATAAGAGCCACCATGTGCCACCAG |
| | | CAGCTCGTCATCTCCTGGTTTAGCCTGGTGTTTCTGGCCTCCCCCCTGGTCGCCATCTGGG |
| | | AGCTGAAGAAAGACGTGTACGTGGTGGAGCTGGACTGGTACCCGGACGCTCCCGGGGAGAT |
| | | GGTGGTGCTGACCTGCGACACCCCCGAGGAGGACGGCATCACCTGGACCCTGGACCAGAGC |
| | | TCCGAGGTGCTGGGGAGCGGCAAGACCCTGACCATTCAGGTGAAAGAGTTCGGCGACGCCG |
| | | GCCAATATACCTGCCACAAGGGGGGGGAGGTCCTGTCGCATTCCCTGCTGCTGCTTCACAA |
| | | AAAGGAGGATGGCATCTGGAGCACCGACATCCTGAAGGACCAGAAAGAACCCAAGAACAAG |
| | | ACGTTCCTGCGCTGCGAGGCCAAGAACTACAGCGGCCGGTTCACCTGTTGGTGGCTGACCA |
| | | CCATCTCCACCGACCTGACTTTCTCGGTGAAGAGCAGCCGCGGGAGCAGCGACCCCCAGGG |
| | | AGTGACCTGCGGCGCCGCCACCCTGAGCGCCGAAAGGGTGAGGGGCGACAATAAAGAGTAC |
| | | GAGTATTCCGTGGAGTGCCAGGAGGACAGCGCCTGTCCCGCCGCCGAGGAGTCCCTGCCTA |
| | | TCGAGGTGATGGTCGACGCGGTGCACAAGCTCAAGTACGAAAACTACACCAGCAGCTTTTT |
| | | CATCAGGGATATCATCAAACCAGACCCCCCCAAGAACCTGCAGCTGAAGCCCCTGAAAAAC |
| | | AGCAGGCAGGTGGAAGTGAGCTGGGAATACCCCGATACCTGGTCCACCCCCCACAGCTACT |
| | | TCAGCCTGACCTTCTGCGTGCAGGTGCAGGGGAAGTCCAAGCGGGAGAAGAAAGATCGGGT |
| | | GTTCACGGACAAGACCAGCGCCACCGTGATTTGCAGGAAAAACGCCAGCATCTCCGTGAGG |
| | | GCTCAGGACAGGTACTACAGCTCCAGCTGGAGCGAGTGGGCCTCCGTGCCTTGCAGCGGGG |
| | | GAGGAGGCGGCGGCAGCAGGAATCTGCCCGTCGCAACCCCCGACCCCGGCATGTTCCCCTG |
| | | CCTGCACCACAGCCAGAATCTGCTGCGAGCCGTGAGCAACATGCTCCAGAAGGCCCGGCAG |
| | | ACGCTGGAGTTCTACCCCTGCACCTCCGAGGAGATCGACCACGAGGACATCACCAAGGATA |
| | | AGACGAGCACCGTCGAGGCCTGTCTCCCCCTGGAGCTCACCAAGAACGAGTCCTGCCTGAA |
| | | TAGCAGGGAGACGTCCTTCATAACCAACGGCAGCTGTCTGGCGTCCAGGAAGACCAGCTTC |
| | | ATGATGGCCCTCTGCCTGAGCTCCATCTACGAGGACCTCAAGATGTACCAGGTCGAGTTCA |
| | | AGACCATGAACGCAAAACTGCTCATGGATCCAAAGAGGCAGATCTTTCTGGACCAGAACAT |
| | | GCTGGCCGTGATCGATGAACTCATGCAGGCCCTGAATTTCAATTCCGAGACCGTGCCCCAG |
| | | AAGAGCTCCCTGGAGGAACCCGACTTCTACAAAACAAAGATCAAGCTGTGTATCCTCCTGC |
| | | ACGCCTTCCGGATCAGGGCCGTCACCATTGACCGGGTGATGTCCTACCTGAACGCCAGCTG |
| | | ATAATAGGCTGGAGCCTCGGTGGCCATGCTTCTTGCCCCTTGGGCCTCCCCCCAGCCCCTC |
| | | CTCCCCTTCCTGCACCCGTACCCCCCAAACACCATTGTCACACTCCAGTGGTCTTTGAATA |
| | | AAGTCTGAGTGGGCGGCAAAAAAAAAAAAAAAAAAAAAAAAAAAAAAAAAAAAAAAAAAAA |
| | | AAAAAAAAAAAAAAAAAAAAAAAAAAAAAAAAAAAAAAAAAAAAAAAAAAAAAAAAATCTAG |
| 1158 | hIL12AB_040 | G*GGGAAATAAGAGAGAAAAGAAGAGTAAGAAGAAATATAAGAGCCACCATGTGCCATCAG |
| | | CAGCTGGTGATCAGCTGGTTCAGCCTCGTGTTCCTCGCCAGCCCCCTCGTGGCCATCTGGG |
| | | AGCTGAAAAAGGACGTGTACGTGGTGGAGCTGGACTGGTATCCCGACGCCCCGGGCGAGAT |
| | | GGTGGTGCTGACCTGCGACACCCCCGAGGAGGACGGCATTACCTGGACACTGGACCAGAGC |
| | | AGCGAGGTCCTGGGCAGCGGGAAGACCCTGACAATTCAGGTGAAGGAGTTCGGCGACGCCG |
| | | GACAGTACACGTGCCACAAGGGGGGGGAGGTGCTGTCCCACAGCCTCCTCCTGCTGCACAA |
| | | GAAGGAGGATGGCATCTGGAGCACCGACATCCTGAAGGATCAGAAGGAGCCCAAGAACAAG |
| | | ACCTTTCTGAGATGCGAGGCCAAGAATTACAGCGGCCGTTTCACCTGCTGGTGGCTCACCA |
| | | CCATCAGCACCGACCTGACCTTCAGCGTGAAATCCTCCAGGGGCTCCTCCGACCCGCAGGG |
| | | AGTGACCTGCGGCGCCGCCACACTGAGCGCCGAGCGGGTCAGAGGGGACAACAAGGAGTAC |
| | | GAGTACAGCGTTGAGTGCCAGGAGGACAGCGCCTGTCCCGCGGCCGAGGAATCCCTGCCCA |
| | | TCGAGGTGATGGTGGACGCAGTGCACAAGCTGAAGTACGAGAACTATACCTCGAGCTTCTT |
| | | CATCCGGGATATCATTAAGCCCGATCCCCCGAAGAACCTGCAGCTCAAACCCCTGAAGAAC |
| | | AGCAGGCAGGTGGAGGTCTCCTGGGAGTACCCCGACACATGGTCCACCCCCCATTCCTATT |
| | | TCTCCCTGACCTTTTGCGTGCAGGTGCAGGGCAAGAGCAAGAGGGAGAAAAAGGACAGGGT |
| | | GTTCACCGACAAGACCTCCGCCACCGTGATCTGCCGTAAGAACGCTAGCATCAGCGTCAGG |
| | | GCCCAGGACAGGTACTATAGCAGCTCCTGGTCCGAGTGGGCCAGCGTCCCGTGCAGCGGCG |
| | | GGGGCGGTGGAGGCTCCCGGAACCTCCCCGTGGCCACCCCGGACCCCGGGATGTTTCCCTG |
| | | CCTGCATCACAGCCAGAACCTGCTGAGGGCCGTGTCCAACATGCTGCAGAAGGCCAGGCAG |
| | | ACACTCGAGTTTTACCCCTGCACCAGCGAGGAGATCGACCACGAAGACATCACCAAGGACA |
| | | AGACCTCCACCGTGGAGGCATGCCTGCCCCTGGAGCTGACCAAAAACGAAAGCTGTCTGAA |
| | | CTCCAGGGAGACCTCCTTTATCACGAACGGCTCATGCCTGGCCTCCAGAAAGACCAGCTTC |
| | | ATGATGGCCCTGTGCCTGAGCTCCATCTACGAGGACTTGAAAATGTACCAGGTCGAGTTCA |
| | | AGACCATGAACGCCAAGCTGCTCATGGACCCCAAAAGGCAGATCTTTCTGGACCAGAATAT |

TABLE 16A-continued

| mRNA Sequences (with T100 tail) | | |
|---|---|---|
| SEQ ID NO | Description | Sequence |
| | | GCTGGCCGTGATCGACGAGCTCATGCAAGCCCTGAATTTCAACAGCGAGACCGTGCCCCAG<br>AAGTCCTCCCTGGAGGAGCCCGACTTCTACAAGACCAAGATCAAGCTGTGCATACTCCTGC<br>ACGCGTTTAGGATCAGGGCGGTGACCATCGATAGGGTGATGAGCTACCTGAATGCCTCCTG<br>ATAATAGGCTGGAGCCTCGGTGGCCATGCTTCTTGCCCCTTGGGCCTCCCCCCAGCCCCTC<br>CTCCCCTTCCTGCACCCGTACCCCCCAAACACCATTGTCACACTCCAGTGGTCTTTGAATA<br>AAGTCTGAGTGGCGGCAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAATCTAG |

TABLE 16B shows RNA sequences corresponding to the hIL12AB_002 ORF (SEQ ID NO: 1042) alone (SEQ ID NO: 1265), after the addition of 5' and 3' UTRs (SEQ ID NO: 1261), and after addition of a poly A tail to the construct comprising the ORF and UTRs (SEQ ID NO: 1262).

TABLE 16B

| mRNA constructs derived from hIL12AB_002 (SEQ ID NO: 1042) | | |
|---|---|---|
| SEQ ID NO | Sequence | Description |
| 1260 | AUGUGCCACCAGCAGCUGGUGAUCAGCUGGUUCAGCCUGGUGUUCCUGGCCAGCC<br>CCCUGGUGGCCAUCUGGGAGCUGAAGAAGGACGUGUACGUGGUGGAGCUGGACUG<br>GUACCCCGACGCCCCCGGCGAGAUGGUGGUGCUGACCUGCGACACCCCCGAGGAG<br>GACGGCAUCACCUGGACCCUGGACCAGAGCAGCGAGGUGCUGGGCAGCGGCAAGA<br>CCCUGACCAUCCAGGUGAAGGAGUUCGGCGACGCCGGCCAGUACACCUGCCACAA<br>GGGCGGCGAGGUGCUGAGCCACAGCCUGCUGCUGCUGCACAAGAAGGAGGACGGC<br>AUCUGGAGCACCGACAUCCUGAAGGACCAGAAGGAGCCCAAGAACAAGACCUUCC<br>UGAGAUGCGAGGCCAAGAACUACAGCGGCAGAUUCACCUGCUGGUGGCUGACCAC<br>CAUCAGCACCGACCUGACCUUCAGCGUGAAGAGCAGCAGAGGCAGCAGCGACCCC<br>CAGGGCGUGACCUGCGGCGCCGCCACCCUGAGCGCCGAGAGAGUGAGAGGCGACA<br>ACAAGGAGUACGAGUACAGCGUGGAGUGCCAGGAGGACAGCGCCUGCCCCGCCGC<br>CGAGGAGAGCCUGCCCAUCGAGGUGAUGGUGGACGCCGUGCACAAGCUGAAGUAC<br>GAGAACUACACCAGCAGCUUCUUCAUCAGAGACAUCAUCAAGCCCGACCCCCCCA<br>AGAACCUGCAGCUGAAGCCCCUGAAGAACAGCAGACAGGUGGAGGUGAGCUGGGA<br>GUACCCCGACACCUGGAGCACCCCCCACAGCUACUUCAGCCUGACCUUCUGCGUG<br>CAGGUGCAGGGCAAGAGCAAGAGAGAGAAGAAGGACAGAGUGUUCACCGACAAGA<br>CCAGCGCCACCGUGAUCUGCAGAAAGAACGCCAGCAUCAGCGUGAGAGCCCAGGA<br>CAGAUACUACAGCAGCAGCUGGAGCGAGUGGGCCAGCGUGCCCUGCAGCGGCGGC<br>GGCGGCGGCGGCAGCAGAAACCUGCCCGUGGCCACCCCCGACCCCGGCAUGUUCC<br>CCUGCCUGCACCACAGCCAGAACCUGCUGAGAGCCGUGAGCAACAUGCUGCAGAA<br>GGCCAGACAGACCCUGGAGUUCUACCCCUGCACCAGCGAGGAGAUCGACCACGAG<br>GACAUCACCAAGGACAAGACCAGCACCGUGGAGGCCUGCCUGCCCCUGGAGCUGA<br>CCAAGAACGAGAGCUGCCUGAACAGCAGAGAGACCAGCUUCAUCACCAACGGCAG<br>CUGCCUGGCCAGCAGAAAGACCAGCUUCAUGAUGGCCCUGUGCCUGAGCAGCAUC<br>UACGAGGACCUGAAGAUGUACCAGGUGGAGUUCAAGACCAUGAACGCCAAGCUGC<br>UGAUGGACCCCAAGAGACAGAUCUUCCUGGACCAGAACAUGCUGGCCGUGAUCGA<br>CGAGCUGAUGCAGGCCCUGAACUUCAACAGCGAGACCGUGCCCCAGAAGAGCAGC<br>CUGGAGGAGCCCGACUUCUACAAGACCAAGAUCAAGCUGUGCAUCCUGCUGCACG<br>CCUUCAGAAUCAGAGCCGUGACCAUCGACAGAGUGAUGAGCUACCUGAACGCCAG<br>C | hIL12AB_002<br>(mRNA: ORF) |
| 1261 | UCAAGCUUUUGGACCCUCGUACAGAAGCUAAUACGACUCACUAUAGGGAAAUAAG<br>AGAGAAAAGAAGAGUAAGAAGAAAUAUAAGAGCCACCAUGUGCCACCAGCAGCUG<br>GUGAUCAGCUGGUUCAGCCUGGUGUUCCUGGCCAGCCCCCUGGUGGCCAUCUGGG<br>AGCUGAAGAAGGACGUGUACGUGGUGGAGUUGGAUUGGUACCCCGACGCCCCCGG<br>CGAGAUGGUGGUGCUGACCUGCGACACCCCCGAGGAGGACGGCAUCACCUGGACC<br>CUGGACCAGAGCAGCGAGGUGCUGGGCAGCGGCAAGACCCUGACCAUCCAGGUGA<br>AGGAGUUCGGCGACGCCGGCCAGUACACCUGCCACAAGGGCGGCGAGGUGCUGAG<br>CCACAGCCUGCUGCUGCUGCACAAGAAGGAGGACGGCAUCUGGAGCACCGACAUC<br>CUGAAGGACCAGAAGGAGCCCAAGAACAAGACCUUCCUGAGAUGCGAGGCCAAGA<br>ACUACAGCGGCAGAUUCACCUGCUGGUGGCUGACCACCAUCAGCACCGACCUGAC<br>CUUCAGCGUGAAGAGCAGCAGAGGCAGCAGCGACCCCCAGGGCGUGACCUGCGGC<br>GCCGCCACCCUGAGCGCCGAGAGAGUGAGAGGCGACAACAAGGAGUACGAGUACA<br>GCGUGGAGUGCCAGGAAGAUAGCGCCUGCCCCGCCGCCGAGGAGAGCCUGCCCAU<br>CGAGGUGAUGGUGGACGCCGUGCACAAGCUGAAGUACGAGAACUACACCAGCAGC<br>UUCUUCAUCAGAGAUAUCAUCAAGCCCGACCCCCCCAAGAACCUGCAGCUGAAGC<br>CCCUGAAGAACAGCCGGCAGGUGGAGGUGAGCUGGGAGUACCCCGACACCUGGAG<br>CACCCCCCACAGCUACUUCAGCCUGACCUUCUGCGUGCAGGUGCAGGGCAAGAGC<br>AAGAGAGAGAAGAAAGAUAGAGUGUUCACCGACAAGACCAGCGCCACCGUGAUCU<br>GCAGAAAGAACGCCAGCAUCAGCGUGAGAGCCCAAGAUAGAUACUACAGCAGCAG<br>CUGGAGCGAGUGGGCCAGCGUGCCCUGCAGCGGCGGCGGCGGCGGCGGCAGCAGA<br>AACCUGCCCGUGGCCACCCCCGACCCCGGCAUGUUCCCCUGCCUGCACCACAGCC | hIL12AB_002<br>mRNA<br>comprising<br>5' UTR, ORF,<br>and 3' UTR |

TABLE 16B-continued

| mRNA constructs derived from hIL12AB_002 (SEQ ID NO: 1042) | | |
|---|---|---|
| SEQ ID NO | Sequence | Description |
| | AGAACCUGCUGAGAGCCGUGAGCAACAUGCUGCAGAAGGCCCGGCAGACCCUGGA GUUCUACCCCUGCACCAGCGAGGAGAUCGACCACGAAGAUAUCACCAAAGAUAAG ACCAGCACCGUGGAGGCCUGCCUGCCCCUGGAGCUGACCAAGAACGAGAGCUGCC UGAACAGCAGAGAGACCAGCUUCAUCACCAACGGCAGCUGCCUGGCCAGCAGAAA GACCAGCUUCAUGAUGGCCCUGUGCCUGAGCAGCAUCUACGAGGACCUGAAGAUG UACCAGGUGGAGUUCAAGACCAUGAACGCCAAGCUGCUGAUGGACCCCAAGCGGC AGAUCUUCCUGGACCAGAACAUGCUGGCCGUGAUCGACGAGCUGAUGCAGGCCCU GAACUUCAACAGCGAGACCGUGCCCCAGAAGAGCAGCCUGGAGGAGCCCGACUUC UACAAGACCAAGAUCAAGCUGUGCAUCCUGCUGCACGCCUUCAGAAUCAGAGCCG UGACCAUCGACAGAGUGAUGAGCUACCUGAACGCCAGCUGAUAAUAGGCUGGAGC CUCGGUGGCCAUGCUUCUUGCCCCUUGGGCCUCCCCCCAGCCCCUCCUCCCCUUC CUGCACCCGUACCCCCAAACACCAUUGUCACACUCCAGUGGUCUUUGAAUAAAG UCUGAGUGGGCGGC | |
| 1262 | G*GGGAAAUAAGAGAGAAAAGAAGAGUAAGAAGAAAUAUAAGAGCCACCAUGUGC CACCAGCAGCUGGUGAUCAGCUGGUUCAGCCUGGUGUUCCUGGCCAGCCCCCUGG UGGCCAUCUGGGAGCUGAAGAAGGACGUGUACGUGGUGGAGUUGGAUUGGUACCC CGACGCCCCCGGCGAGAUGGUGGUGCUGACCUGCGACACCCCCGAGGAGGACGGC AUCACCUGGACCCUGGACCAGAGCAGCGAGGUGCUGGGCAGCGGCAAGACCCUGA CCAUCCAGGUGAAGGAGUUCGGCGACGCCGGCCAGUACACCUGCCACAAGGGCGG CGAGGUGCUGAGCCACAGCCUGCUGCUGCUGCACAAGAAGGAGGACGGCAUCUGG AGCACCGACAUCCUGAAGGACCAGAAGGAGCCCAAGAACAAGACCUUCCUGAGAU GCGAGGCCAAGAACUACAGCGGCAGAUUCACCUGCUGGUGGCUGACCACCAUCAG CACCGACCUGACCUUCAGCGUGAAGAGCAGCAGAGGCAGCAGCGACCCCCAGGGC GUGACCUGCGGCGCCGCCACCCUGAGCGCCGAGAGAGUGAGAGGCGACAACAAGG AGUACGAGUACAGCGUGGAGUGCCAGGAAGAUAGCGCCUGCCCCGCCGCCGAGGA GAGCCUGCCCAUCGAGGUGAUGGUGGACGCCGUGCACAAGCUGAAGUACGAGAAC UACACCAGCAGCUUCUUCAUCAGAGAUAUCAUCAAGCCCGACCCCCCCAAGAACC UGCAGCUGAAGCCCCUGAAGAACAGCCGGCAGGUGGAGGUGAGCUGGGAGUACCC CGACACCUGGAGCACCCCCCACAGCUACUUCAGCCUGACCUUCUGCGUGCAGGUG CAGGGCAAGAGCAAGAGAGAGAAGAAAGAUAGAGUGUUCACCGACAAGACCAGCG CCACCGUGAUCUGCAGAAAGAACGCCAGCAUCAGCGUGAGAGCCCAAGAUAGAUA CUACAGCAGCAGCUGGAGCGAGUGGGCCAGCGUGCCCUGCAGCGGCGGCGGCGGC GGCGGCAGCAGAAACCUGCCCGUGGCCACCCCCGACCCCGGCAUGUUCCCCUGCC UGCACCACAGCCAGAACCUGCUGAGAGCCGUGAGCAACAUGCUGCAGAAGGCCCG GCAGACCCUGGAGUUCUACCCCUGCACCAGCGAGGAGAUCGACCACGAAGAUAUC ACCAAAGAUAAGACCAGCACCGUGGAGGCCUGCCUGCCCCUGGAGCUGACCAAGA ACGAGAGCUGCCUGAACAGCAGAGAGACCAGCUUCAUCACCAACGGCAGCUGCCU GGCCAGCAGAAAGACCAGCUUCAUGAUGGCCCUGUGCCUGAGCAGCAUCUACGAG GACCUGAAGAUGUACCAGGUGGAGUUCAAGACCAUGAACGCCAAGCUGCUGAUGG ACCCCAAGCGGCAGAUCUUCCUGGACCAGAACAUGCUGGCCGUGAUCGACGAGCU GAUGCAGGCCCUGAACUUCAACAGCGAGACCGUGCCCCAGAAGAGCAGCCUGGAG GAGCCCGACUUCUACAAGACCAAGAUCAAGCUGUGCAUCCUGCUGCACGCCUUCA GAAUCAGAGCCGUGACCAUCGACAGAGUGAUGAGCUACCUGAACGCCAGCUGAUA AUAGGCUGGAGCCUCGGUGGCCAUGCUUCUUGCCCCUUGGGCCUCCCCCCAGCCC CUCCUCCCCUUCCUGCACCCGUACCCCCAAACACCAUUGUCACACUCCAGUGGU CUUUGAAUAAAGUCUGAGUGGGCGGCAAAAAAAAAAAAAAAAAAAAAAAAAAAAA AAAAAAAAAAAAAAAAAAAAAAAAAAAAAAAAAAAAAAAAAAAAAAAAAAAAAAA AAAAAAAAAAAAAAAAUCUAG | hIL12AB_002 mRNA comprising 5' UTR, ORF, 3' UTR, and T100 tail |

The sequence-optimized IL12 polynucleotide sequences disclosed herein are distinct from the corresponding wild type nucleotide acid sequences and from other known sequence-optimized nucleotide sequences, e.g., these sequence-optimized nucleic acids have unique compositional characteristics. See FIGS. 91A to 95D.

In some embodiments, the percentage of uracil or thymine nucleobases in a sequence-optimized IL12 polynucleotide sequence (e.g., encoding an IL12B and/or IL12A polypeptide, a functional fragment, or a variant thereof) is modified (e.g., reduced) with respect to the percentage of uracil or thymine nucleobases in the reference wild-type IL12 polynucleotide sequence. Such a sequence is referred to as a uracil-modified or thymine-modified sequence.

In some embodiments, the sequence-optimized IL12 polynucleotide sequence has a lower uracil or thymine content than the uracil or thymine content in the reference wild-type sequence. In some embodiments, the uracil or thymine content in a sequence-optimized IL12 polynucleotide sequence of the disclosure is greater than the uracil or thymine content in the reference wild-type sequence and still maintain beneficial effects, e.g., increased expression and/or reduced Toll-Like Receptor (TLR) response when compared to the reference wild-type sequence.

In some embodiments, the IL12 optimized sequences of the present disclosure contain unique ranges of uracils or thymine (if DNA) in the sequence. The uracil or thymine content of the optimized IL12 sequences can be expressed in various ways, e.g., uracil or thymine content of optimized sequences relative to the theoretical minimum (% $U_{TM}$ or % $T_{TM}$), relative to the wild-type (% $U_{WT}$ or % $T_{WT}$), and relative to the total nucleotide content (% $U_{TL}$ or % $T_{TL}$). For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding an IL12B polypeptide of the disclosure is below 196%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % UI of a uracil-modified sequence encoding an IL12B polypeptide of the disclosure is below 196% and above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, above 126%, above 127%, above 128%, above 129%, or above 130%, above 135%, above 130%, above 131%, or above 132.

In some embodiments, the % U of a uracil-modified sequence encoding an IL12B polypeptide of the disclosure is between 132% and 150%, between 133% and 150%, between 134% and 150%, between 135% and 150%, between 136% and 150%, between 137% and 150%, between 138% and 150%, between 139% and 150%, between 140% and 150%, between 132% and 151%, between 132% and 152%, between 132% and 153%, between 132% and 154%, between 132% and 155%, between 132% and 156%, between 132% and 157%, between 132% and 158%, between 132% and 159%, between 132% and 160%, between 133% and 151%, between 134% and 152%, between 135% and 153%, between 136% and 154%, between 137% and 155%, between 138% and 156%, between 138% and 157%, between 139% and 158%, between 140% and 159%, or between 141% and 160%.

In some embodiments, the % UI of a uracil-modified sequence encoding an IL12B polypeptide of the disclosure is between about 133% and about 152%, e.g., between 132.32% and 150.51%.

In some embodiments, the % UI of a uracil-modified sequence encoding an IL12A polypeptide of the disclosure is below 198%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, or below 115%.

In some embodiments, the % $U_{TM}$ of a uracil-modified sequence encoding an IL12A polypeptide of the disclosure is below 198% and above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, or above 125%.

In some embodiments, the % $U_{TM}$ of a uracil-modified sequence encoding an IL12A polypeptide of the disclosure is between 125% and 143%, between 126% and 143%, between 127% and 143%, between 128% and 143%, between 129% and 143%, between 130% and 143%, between 131% and 132%, between 133% and 134%, between 135% and 143%, between 125% and 144%, between 125% and 145%, between 125% and 146%, between 125% and 147%, between 125% and 148%, between 125% and 149%, between 125% and 150%, between 125% and 151%, between 125% and 152%, between 125% and 153%, between 125% and 154%, between 125% and 155%, between 126% and 144%, between 127% and 145%, between 128% and 146%, between 129% and 147%, between 130% and 148%, between 131% and 149%, between 132% and 150%, or between 133% and 151%.

In some embodiments, the % $U_{TM}$ of a uracil-modified sequence encoding an IL12A polypeptide of the disclosure is between about 124% and about 145%, e.g., between 125% and 144.42%.

A uracil- or thymine-modified sequence encoding an IL12B polypeptide, IL12A polypeptide, or both IL12B and IL12A polypeptides of the disclosure can also be described according to its uracil or thymine content relative to the uracil or thymine content in the corresponding wild-type nucleic acid sequence (% $U_{WT}$ or % $T_{WT}$).

In some embodiments, the % $U_{WT}$ or % $T_{WT}$ of a uracil- or thymine-modified sequence encoding an IL12B polypeptide of the disclosure is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding an IL12B polypeptide of the disclosure is between 55% and 88%, between 56% and 87%, between 57% and 86%, between 58% and 85%, between 59% and 84%, between 60% and 83%, between 61% and 82%, between 62% and 81%, between 63% and 80%, between 64% and 79%, between 65% and 78%, or between 65% and 77%.

In some embodiments, the % $U_{WT}$ or % $T_{WT}$ of a uracil- or thymine-modified sequence encoding an IL12B polypeptide of the disclosure is between 66% and 78%, between 66% and 77%, between 67% and 77%, between 67% and 76%, or between 65% and 77%.

In a particular embodiment, the % $U_{WT}$ or % $T_{WT}$ of a uracil- or thymine-modified sequence encoding an IL12B polypeptide of the disclosure is between about 66% and about 77%, e.g., between 67% and 76%.

In some embodiments, the % $U_{WT}$ or % $T_{WT}$ of a uracil- or thymine-modified sequence encoding an IL12A polypeptide of the disclosure is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding an IL12A polypeptide of the disclosure is between 50% and 85%, between 51% and 84%, between 52% and 83%, between 53% and 82%, between 54% and 81%, between 55% and 80%, between 56% and 79%, between 57% and 78%, between 58% and 77%, between 59% and 76%, between 60% and 75%, between 61% and 74%, or between 62% and 73%.

In some embodiments, the % $U_{WT}$ or % $T_{WT}$ of a uracil- or thymine-modified sequence encoding an IL12A polypeptide of the disclosure is between 61% and 74%, between 61% and 73%, between 61% and 72%, between 61% and 73%, between 62% and 73%, between 62% and 72%, between 62% and 74%, or between 63% and 72%.

In a particular embodiment, the % $U_{WT}$ or % $T_{WT}$ of a uracil- or thymine-modified sequence encoding an IL12A polypeptide of the disclosure is between about 62% and about 73%, e.g., between 63% and 72%.

The uracil or thymine content of wild-type IL12B relative to the total nucleotide content (%) is about 21%. In some embodiments, the uracil or thymine content of a uracil- or thymine-modified sequence encoding an IL12B polypeptide relative to the total nucleotide content (%) (% $U_{TL}$ or % $T_{TL}$) is less than 21%. In some embodiments, the % $U_{TL}$ or % $T_{TL}$ is less than 20%, less than 19%, less that 18%, less than 17%, less than 16%, less than 15%, less than 14%, less than 13%, less than 12%, less than 11%, or less than 10%. In some embodiments, the % $U_{TL}$ or % T, is not less than 10%, 9%, 8%, 7%, 6%, 5%, 4%, 3%, 2%, or 1%.

In some embodiments, the uracil or thymine content of a uracil- or thymine-modified sequence encoding an IL12B polypeptide of the disclosure relative to the total nucleotide content (% $U_{TL}$ or % $T_{TL}$) is between 10% and 20%, between 11% and 20%, between 11.5% and 190.5%, between 12% and 19%, between 12% and 18%, between 13% and 18%, between 13% and 17%, between 13% and 16%, between 13% and 16%, between 14% and 16%, between 14% and 17%, or between 13% and 17%.

In a particular embodiment, the uracil or thymine content (% $U_{TL}$ or % $T_{TL}$) of a uracil- or thymine modified sequence encoding a L1B2 polypeptide of the disclosure is between about 13% and about 17%, e.g., between 14% and 16%

The uracil or thymine content of wild-type IL12A relative to the total nucleotide content (%) is about 26%. In some embodiments, the uracil or thymine content of a uracil- or thymine-modified sequence encoding an L12A polypeptide relative to the total nucleotide content (%) (% $U_{TL}$ or % $T_{TL}$) is less than 25%. In some embodiments, the % $U_{TL}$ or % $T_{TL}$ is less than 25%, less than 24%, less than 23%, less than 22%, less than 21%, less than 20%, less than 19%, less that 18%, less than 17%, less than 16%, less than 15%, less than 14%, less than 13%, less than 12%, less than 11%, or less than 10%. In some embodiments, the % $U_{TL}$ or % $T_{TL}$ is not less than 10%, 9%, 8%, 7%, 6%, 5%, 4%, 3%, 2%, or 1%.

In some embodiments, the uracil or thymine content of a uracil- or thymine-modified sequence encoding an IL12A polypeptide of the disclosure relative to the total nucleotide content (% $U_{TL}$ or % $T_{TL}$) is between 10% and 25%, between 11% and 25%, between 12% and 25%, between 13% and 25%, between 14% and 25%, between 15% and 25%, between 16% and 25%, between 10% and 24%, between 10% and 23%, between 11% and 22%, between 11% and 21%, between 11% and 20%, between 11% and 19%, between 11% and 18%, between 12% and 24%, between 12% and 23%, between 13% and 22%, between 14% and 21%, between 13% and 20%, between 15% and 19%, between 15% and 20%, between 16% and 19%, between 16% and 18%, or between 13% and 17%.

In a particular embodiment, the uracil or thymine content (% $U_{TL}$ or % $T_{TL}$) of a uracil- or thymine modified sequence encoding an IL12A polypeptide of the disclosure is between about 15% and about 19%, e.g., between 16% and 18% In some embodiments, a uracil-modified sequence encoding an IL12B polypeptide, IL12A polypeptide, or both IL12B and IL12A polypeptides of the disclosure has a reduced number of consecutive uracils with respect to the corresponding wild-type nucleic acid sequence. For example, two consecutive leucines can be encoded by the sequence CUUUUG (SEQ ID NO: 1159), which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide.

In some embodiments, a uracil-modified sequence encoding an IL12B and/or IL12A polypeptide of the disclosure has a reduced number of uracil triplets (UUU) with respect to the wild-type nucleic acid sequence. In some embodiments, a uracil-modified sequence encoding an IL12B and/or IL12A polypeptide of the disclosure contains 4, 3, 2, 1 or no uracil triplets (UUU).

In some embodiments, a uracil-modified sequence encoding an IL12B and/or IL12A polypeptide has a reduced number of uracil pairs (UU) with respect to the number of uracil pairs (UU) in the wild-type nucleic acid sequence. In some embodiments, a uracil-modified sequence encoding an IL12B and/or IL12A polypeptide of the disclosure has a number of uracil pairs (UU) corresponding to the minimum possible number of uracil pairs (UU) in the wild-type nucleic acid sequence.

In some embodiments, a uracil-modified sequence encoding an IL12B polypeptide of the disclosure has at least 1, 2, 3, 4, 5, 6, 7, 8, 9, 10, 11, 12, 13, 14, 15, 16, 17, 18, 19, 20, 21, 22, or 23 uracil pairs (UU) less than the number of uracil pairs (UU) in the wild-type nucleic acid sequence. In some embodiments, a uracil-modified sequence encoding an IL12B polypeptide of the disclosure has between 7 and 13, between 8 and 14, between 9 and 15, between 10 and 16, between 11 and 7, between 12 and 18 uracil pairs (UU).

In some embodiments, a uracil-modified sequence encoding an IL12B polypeptide of the disclosure has at least 1, 2, 3, 4, 5, 6, 7, 8, 9, 10, 11, 12, 13, 14, 15, 16, 17, 18, 19, or 20 uracil pairs (UU) less than the number of uracil pairs (UU) in the wild-type nucleic acid sequence. In some embodiments, a uracil-modified sequence encoding an IL12A polypeptide of the disclosure has between 7 and 13, between 8 and 14, between 9 and 15, between 10 and 16, between 11 and 7, between 12 and 18 uracil pairs (UU).

In some embodiments, a uracil-modified sequence encoding an IL12A or IL12B polypeptide of the disclosure has a % $UU_{wt}$ less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding an IL12B polypeptide has a % $UU_{wt}$ between 24% and 59%. In a particular embodiment, a uracil-modified sequence encoding an IL12B polypeptide, IL12A polypeptide, or both IL12B and IL12A polypeptides of the disclosure has a % $UU_{wt}$ between 29% and 55%.

In some embodiments, a uracil-modified sequence encoding an IL12A polypeptide has a % $UU_{wt}$ between 14% and 57%. In a particular embodiment, a uracil-modified sequence encoding an IL12B polypeptide, L12A polypeptide, or both IL12B and IL12A polypeptides of the disclosure has a % $UU_{wt}$ between 19% and 52%.

In some embodiments, the IL12 polynucleotide comprises a uracil-modified sequence encoding an IL12A polypeptide, an IL12B polypeptide, or both IL12A and IL12B polypeptides disclosed herein. In some embodiments, the uracil-modified sequence encoding an IL12A polypeptide, an IL12B polypeptide, or both IL12A and IL12B polypeptides comprises at least one chemically modified nucleobase, e.g., 5-methoxyuracil. In some embodiments, at least 95% of a nucleobase (e.g., uracil) in a uracil-modified sequence encoding an IL12A polypeptide, an IL12B polypeptide, or both IL12A and IL12B polypeptides of the disclosure are modified nucleobases. In some embodiments, at least 95% of uracil in a uracil-modified sequence encoding an IL12A polypeptide, an IL12B polypeptide, or both L12A and IL12B polypeptides is 5-methoxyuracil.

In some embodiments, the IL12 polynucleotide comprising a uracil-modified sequence further comprises a miRNA binding site, e.g., a miRNA binding site that binds to miR-122. In some embodiments, the IL12 polynucleotide comprising a uracil-modified sequence is formulated with a delivery agent, e.g., a compound having Formula (I), e.g., any of Compounds 1-147.

In some embodiments, the "guanine content of the sequence optimized ORF encoding IL12B and/or IL12A with respect to the theoretical maximum guanine content of a nucleotide sequence encoding the IL12B and/or IL12A polypeptide," abbreviated as % $G_{TMX}$ is at least 69%, at least 70%, at least 75%, at least about 80%, at least about 85%, at least about 90%, at least about 95%, or about 100%. In some embodiments, the % $G_{TMX}$ is between about 70% and about 80%, between about 71% and about 79%, between about 71% and about 78%, or between about 71% and about 77%.

In some embodiments, the "cytosine content of the ORF relative to the theoretical maximum cytosine content of a nucleotide sequence encoding the IL12B and/or IL12A polypeptide," abbreviated as % $C_{TMX}$, is at least 59%, at least 60%, at least about 65%, at least about 70%, at least about 75%, at least about 80%, at least about 85%, at least about 90%, at least about 95%, or about 100%. In some embodiments, the % $C_{TMX}$ is between about 60% and about 80%, between about 62% and about 80%, between about 63% and about 79%, or between about 68% and about 76%.

In some embodiments, the "guanine and cytosine content (G/C) of the ORF relative to the theoretical maximum G/C content in a nucleotide sequence encoding the IL12B and/or IL12A polypeptide," abbreviated as % $G/C_{TMX}$ is at least about 81%, at least about 85%, at least about 90%, at least about 95%, or about 100%. The % $G/C_{TMX}$ is between about 80% and about 100%, between about 85% and about 99%, between about 90% and about 97%, or between about 91% and about 96%.

In some embodiments, the "G/C content in the ORF relative to the G/C content in the corresponding wild-type ORF," abbreviated as % $G/C_{WT}$ is at least 102%, at least 103%, at least 104%, at least 105%, at least 106%, at least 107%, at least 110%, at least 115%, or at least 120%.

In some embodiments, the average G/C content in the 3rd codon position in the ORF is at least 20%, at least 21%, at least 22%, at least 23%, at least 24%, at least 25%, at least 26%, at least 27%, at least 28%, at least 29%, or at least 30% higher than the average G/C content in the 3rd codon position in the corresponding wild-type ORF.

In some embodiments, the IL12 polynucleotide of the disclosure comprises an open reading frame (ORF) encoding an IL12B and/or IL12A polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

Modified Nucleotide Sequences Encoding IL12 Polypeptides:

In some embodiments, the IL12 polynucleotide (e.g., a RNA, e.g., an mRNA) of the disclosure comprises a chemically modified nucleobase, e.g., 5-methoxyuracil. In some embodiments, the mRNA is a uracil-modified sequence comprising an ORF encoding an IL12B polypeptide, IL12A polypeptide, or both IL12B and IL12A polypeptides, wherein the mRNA comprises a chemically modified nucleobase, e.g., 5-methoxyuracil.

In certain aspects of the disclosure, when the 5-methoxyuracil base is connected to a ribose sugar, as it is in polynucleotides, the resulting modified nucleoside or nucleotide is referred to as 5-methoxyuridine. In some embodiments, uracil in the IL12 polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the polynucleotide is at least 95% 5-methoxyuracil. In another embodiment, uracil in the polynucleotide is 100% 5-methoxyuracil.

In embodiments where uracil in the IL12 polynucleotide is at least 95% 5-methoxyuracil, overall uracil content can be adjusted such that an mRNA provides suitable protein expression levels while inducing little to no immune response. In some embodiments, the uracil content of the ORF (% $U_{TM}$) is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140%.

In other embodiments, the uracil content of the ORF is between about 117% and about 134% or between 118% and 132% of the % $U_{TM}$. In some embodiments, the % $U_{TM}$ is about 115%, about 120%, about 125%, about 130%, about 135%, about 140%, about 145%, or about 150%. In this context, the term "uracil" can refer to 5-methoxyuracil and/or naturally occurring uracil.

In some embodiments, the uracil content in the ORF of the mRNA encoding an IL12A polypeptide, an IL12B polypeptide, or both L12A and IL12B polypeptides of the disclosure is less than about 50%, about 40%, about 30%, or about 20% of the total nucleobase content in the ORF. In some embodiments, the uracil content in the ORF is between about 15% and about 25% of the total nucleobase content in the ORF.

In other embodiments, the uracil content in the ORF is between about 20% and about 30% of the total nucleobase content in the ORF. In one embodiment, the uracil content in the ORF of the mRNA encoding an IL12A polypeptide, an IL12B polypeptide, or both IL12A and IL12B polypeptides is less than about 20% of the total nucleobase content in the open reading frame. In this context, the term "uracil" can refer to 5-methoxyuracil and/or naturally occurring uracil.

In further embodiments, the ORF of the mRNA encoding an IL12A polypeptide, an IL12B polypeptide, or both L12A and IL12B polypeptides having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF.

In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the IL12A polypeptide, IL12B polypeptide, or both IL12A and IL12B polypeptides (% $G_{TMX}$; % $C_{TMX}$, or % $G/C_{TMX}$). In other embodiments, the G, the C, or the G/C content in the ORF is between about 70% and about 80%, between about 71% and about 79%, between about 71% and about 78%, or between about 71% and about 77% of the % $G_{TMX}$, % $C_{TMX}$, or % $G/C_{TMX}$. In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding an IL12A polypeptide, an IL12B polypeptide, or both L12A and IL12B polypeptides of the disclosure comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the IL12A polypeptide, IL12B polypeptide, or both IL12A and IL12B polypeptides.

In some embodiments, the ORF of the mRNA encoding an IL12A polypeptide, an IL12B polypeptide, or both L12A and IL12B polypeptides of the disclosure contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the IL12A polypeptide, IL12B polypeptide, or both IL12A and IL12B polypeptides.

In a particular embodiment, the ORF of the mRNA encoding the IL12A polypeptide, IL12B polypeptide, or both L12A and IL12B polypeptides of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the IL12A polypeptide, IL12B polypeptide, or both L12A and IL12B polypeptides contains no non-phenylalanine uracil pairs and/or triplets.

In further embodiments, the ORF of the mRNA encoding an L12A polypeptide, an IL12B polypeptide, or both L12A and IL12B polypeptides of the disclosure comprises 5-methoxyuracil and has an adjusted uracil content containing less uracil-rich clusters than the corresponding wild-type nucleotide sequence encoding the IL12A polypeptide, an IL12B polypeptide, or both L12A and IL12B polypeptides. In some embodiments, the ORF of the mRNA encoding the IL12A polypeptide, IL12B polypeptide, or both IL12A and IL12B polypeptides of the disclosure contains uracil-rich clusters that are shorter in length than corresponding uracil-rich clusters in the corresponding wild-type nucleotide sequence encoding the IL12A polypeptide, IL12B polypeptide, or both IL12A and IL12B polypeptides.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the IL12A polypeptide, IL12B polypeptide, or both IL12A and IL12B polypeptides-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above.

In some embodiments, at least one codon in the ORF of the mRNA encoding the IL12A polypeptide, IL12B polypeptide, or both IL12A and IL12B polypeptides is substituted with an alternative codon having a codon frequency lower than the codon frequency of the substituted codon in the synonymous codon set.

In some embodiments, the adjusted uracil content, IL12A polypeptide, IL12B polypeptide, or both IL12A and IL12B polypeptides-encoding ORF of the 5-methoxyuracil-comprising mRNA exhibits expression levels of IL12 when administered to a mammalian cell that are higher than expression levels of IL12 from the corresponding wild-type mRNA. In other embodiments, the expression levels of IL12 when administered to a mammalian cell are increased relative to a corresponding mRNA containing at least 95% 5-methoxyuracil and having a uracil content of about 160%, about 170%, about 180%, about 190%, or about 200% of the theoretical minimum.

In yet other embodiments, the expression levels of IL12 when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, IL12 is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the IL12 polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, IL12A polypeptide, IL12B polypeptide, or both IL12A and IL12B polypeptides-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the mRNA of the present disclosure induces a detectably lower immune response (e.g., innate or acquired) relative to the immune response induced by a corresponding wild-type mRNA under the same conditions. In other embodiments, the mRNA of the present disclosure induces a detectably lower immune response (e.g., innate or acquired) relative to the immune response induced by an mRNA that encodes for an IL12B polypeptide, L12A polypeptide, or both IL12B and IL12A polypeptides but does not comprise 5-methoxyuracil under the same conditions, or relative to the immune response induced by an mRNA that encodes for an IL12A polypeptide, IL12B polypeptide, or both IL12A and IL12B polypeptides and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of the mRNA of the disclosure into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes an IL12A polypeptide, IL12B polypeptide, or both IL12A and IL12B polypeptides but does not comprise 5-methoxyuracil, or to an mRNA that encodes an IL12A polypeptide, IL12B polypeptide, or both IL12A and IL12B polypeptides and that comprises 5-methoxyuracil but that does not have adjusted uracil content. In some embodiments, the interferon is IFN-β. In some embodiments, cell death frequency caused by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for an IL12A polypeptide, IL12B polypeptide, or both IL12A and IL12B polypeptides but does not comprise 5-methoxyuracil, or an mRNA that encodes for an IL12A polypeptide, IL12B polypeptide, or both IL12A and IL12B polypeptides and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the IL12 polynucleotide is an mRNA that comprises an ORF that encodes an IL12A polypeptide, IL12B polypeptide, or both IL12A and IL12B polypeptides, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the IL12A polypeptide, IL12B polypeptide, or both IL12A and IL12B polypeptides is less than about 30% of the total nucleobase content in the ORF. In some embodiments, the ORF that encodes the IL12A polypeptide, IL12B polypeptide, or both IL12A and IL12B polypeptides is further modified to increase G/C content of the ORF (absolute or relative) by at least about 40%, as compared to the corresponding wild-type ORF. In yet other embodiments, the ORF encoding the IL12A polypeptide, IL12B polypeptide, or both IL12A and IL12B polypeptides contains less than 20 non-phenylalanine uracil pairs and/or triplets. In some embodiments, at least one codon in the ORF of the mRNA encoding the IL12A polypeptide, IL12B polypeptide, or both IL12A and IL12B polypeptides is further substituted with an alternative codon having a codon frequency lower than the codon frequency of the substituted codon in the synonymous codon set.

In some embodiments, the expression of the IL12A polypeptide, IL12B polypeptide, or both IL12A and IL12B polypeptides encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the IL12A polypeptide, IL12B polypeptide, or both IL12A and IL12B polypeptides from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

Polynucleotide Comprising an mRNA Encoding an IL12 Polypeptide:

In certain embodiments, an IL12 polynucleotide of the present disclosure, for example a polynucleotide comprising an mRNA nucleotide sequence encoding an IL12B polypeptide, IL12A polypeptide, or both IL12B and IL12A polypeptides, comprises from 5' to 3' end:

(i) a 5' UTR, such as the sequences provided below, comprising a 5' cap provided below;

(ii) an open reading frame encoding an IL12B polypeptide, IL12A polypeptide, or both IL12B and IL12A polypeptides, e.g., a sequence optimized nucleic acid sequence encoding IL12 disclosed herein;

(iii) at least one stop codon;

(iv) a 3' UTR, such as the sequences provided below; and (v) a poly-A tail provided below.

In some embodiments, the IL12 polynucleotide further comprises a miRNA binding site, e.g., a miRNA binding site that binds to miRNA-122. In some embodiments, the 3'UTR comprises the miRNA binding site.

In some embodiments, an IL12 polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type IL12 (e.g., isoform 1, 2, 3, or 4).

Compositions and Formulations for Use Comprising an IL12 Polynucleotide:

Certain aspects of the disclosure are directed to compositions or formulations comprising any of the IL12 polynucleotides disclosed above.

In some embodiments, the composition or formulation comprises:

(i) an IL12 polynucleotide (e.g., a RNA, e.g., an mRNA) comprising a sequence-optimized nucleotide sequence (e.g., an ORF) encoding an IL12B polypeptide, IL12A polypeptide, or both IL12B and IL12A polypeptides (e.g., the wild-type sequence, functional fragment, or variant thereof), wherein the IL12 polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the IL12 polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the IL12B polypeptide, IL12A polypeptide, or both IL12B and IL12A polypeptides (% $U_{TM}$ or % $T_{TM}$), is between about 100% and about 150%.

In some embodiments, the polynucleotides, compositions or formulations above are used to treat and/or prevent an IL12-related diseases, disorders or conditions, e.g., cancer.

H. OX40L

In some embodiments, the combination therapies disclosed herein comprise one or more OX40L polynucleotides (e.g., mRNAs), i.e., polynucleotides comprising one or more ORFs encoding an OX40L polypeptide.

OX40L, the ligand for OX40 (CD134) has also been designated Tumor Necrosis Factor Superfamily (ligand) Member 4 (TNFSF4), CD252 (cluster of differentiation 252), CD134L, Tax-Transcriptionally Activated Glycoprotein 1 (TXGP1), Glycoprotein 34 (GP34), and ACT-4-L. Human OX40L is a 34 kDa glycosylated type II transmembrane protein that exists on the surface of cells as a trimer. OX40L comprises a cytoplasmic domain (amino acids 1-23), a transmembrane domain (amino acids 24-50) and an extracellular domain (amino acids 51-183). Human OX40L was first identified on the surface of human lymphocytes infected with human T-cell leukemia virus type-I (HTLV-I) by Tanaka et al. (Tanaka et al., International Journal of Cancer (1985), 36(5):549-55).

In some embodiments, the OX40L polynucleotide comprises an mRNA encoding a mammalian OX40L polypeptide. In some embodiments, the mammalian OX40L polypeptide is a murine OX40L polypeptide. In some embodiments, the mammalian OX40L polypeptide is a human OX40L polypeptide. In some embodiments, the OX40L polypeptide comprises the amino acid sequence set forth in SEQ ID NO: 1160. In another embodiment, the OX40L polypeptide comprises the amino acid sequence set forth in SEQ ID NO: 1161.

In some embodiments, the OX40L polypeptide comprises an amino acid sequence at least 50%, at least 60%, at least 70%, at least 80%, at least 85%, at least 90%, at least 95%, at least 99%, or 100% identical to an amino acid sequence listed in TABLE 17 (e.g., selected from SEQ ID NOs: 1160-1162) or an amino acid sequence encoded by a nucleotide sequence listed in TABLE 17, wherein the amino acid sequence is capable of binding to an OX40 receptor.

In other embodiments, the OX40L polypeptide useful for the disclosure comprises an amino acid sequence listed in TABLE 17 with one or more conservative substitutions, wherein the conservative substitutions do not affect the binding of the OX40L polypeptide to an OX40 receptor, i.e., the amino acid sequence binds to the OX40 receptor after the substitutions.

In certain embodiments, the OX40L polypeptide comprises an amino acid sequence at least 50%, at least 60%, at least 70%, at least 80%, at least 85%, at least 90%, at least 95%, at least 99%, or 100% identical to an extracellular domain of OX40L (e.g., SEQ ID NO:1161), wherein the OX40L polypeptide binds to an OX40 receptor.

In other embodiments, a polynucleotide sequence (i.e., mRNA) encoding an OX40L polypeptide comprises a sequence at least 50%, at least 60%, at least 70%, at least 80%, at least 85%, at least 90%, at least 95%, at least 99%, or 100% identical to a nucleic acid sequence listed in TABLE 17 (e.g., selected from SEQ ID NOs: 1163-1205).

TABLE 17

OX40L Polypeptide and OX40L Polynucleotide Sequences

| Encoded Polypeptide | Description | Sequence | SEQ ID NO (no. aa/nt) |
|---|---|---|---|
| OX40L (TNFSF4) | Amino acid sequence of tumor necrosis factor ligand superfamily member 4 isoform 1 [*Homo sapiens*] NP_003317 | MERVQPLEENVGNAARPRFERNKLLLVASVIQGLGLLLCFTY ICLHFSALQVSHRYPRIQSIKVQFTEYKKEKGFILTSQKEDE IMKVQNNSVIINCDGFYLISLKGYFSQEVNISLHYQKDEEPL FQLKKVRSVNSLMVASLTYKDKVYLNVTTDNTSLDDFHVNGG ELILIHQNPGEFCVL | 1160 (183 aa) |
| OX40L (TNFSF4) | Amino acid sequence of tumor necrosis factor ligand superfamily member 4 isoform 2 [*Homo sapiens*] NP_001284491 | MVSHRYPRIQSIKVQFTEYKKEKGFILTSQKEDEIMKVQNNS VIINCDGFYLISLKGYFSQEVNISLHYQKDEEPLFQLKKVRS VNSLMVASLTYKDKVYLNVTTDNTSLDDFHVNGGELILIHQN PGEFCVL | 1161 (133 aa) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| OX40L (TNFSF4) | Amino acid sequence of tumor necrosis factor ligand superfamily member 4 [*Mus musculus*] NP_033478 | MEGEGVQPLDENLENGSRPRFKWKKTLRLVVSGIKGAGMLLC FIYVCLQLSSSPAKDPPIQRLRGAVTRCEDGQLFISSYKNEY QTMEVQNNSVVIKCDGLYIIYLKGSFFQEVKIDLHFREDHNP ISIPMLNDGRRIVFTVVASLAFKDKVYLTVNAPDTLCEHLQI NDGELIVVQLTPGYCAPEGSYHSTVNQVPL | 1162 (198 aa) |
| OX40L (TNFSF4) | Nucleotide sequence of TNFSF4 tumor necrosis factor (ligand) superfamily, member 4, open reading frame [*Homo sapiens*] | AUGGAAAGGGUCCAACCCCUGGAAGAGAAUGUGGGAAAUGCA GCCAGGCCAAGAUUCGAGAGGAACAAGCUAUUGCUGGUGGCC UCUGUAAUUCAGGGACUGGGGCUGCUCCUGUGCUUCACCUAC AUCUGCCUGCACUUCUCUGCUCUUCAGGUAUCACAUCGGUAU CCUCGAAUUCAAAGUAUCAAAGUACAAUUUACCGAAUAUAAG AAGGAGAAAGGUUUCAUCCUCACUUCCCAAAAGGAGGAUGAA AUCAUGAAGGUGCAGAACAACUCAGUCAUCAUCAACUGUGAU GGGUUUUAUCUCAUCUCCCUGAAGGGCUACUUCUCCCAGGAA GUCAACAUUAGCCUUCAUUACCAGAAGGAUGAGGAGCCCCUC UUCCAACUGAAGAAGGUCAGGUCUGUCAACUCCUUGAUGGUG GCCUCUCUGACUUACAAAGACAAAGUCUACUUGAAUGUGACC ACUGACAAUACCUCCCUGGAUGACUUCCAUGUGAAUGGCGGA GAACUGAUUCUUAUCCAUCAAAAUCCUGGUGAAUUCUGUGUC CUUUGA | 1163 (552nts) |
| OX40L (TNFSF4) | Nucleotide sequence of *homo sapiens* tumor necrosis factor (ligand) superfamily, member 4 (TNFSF4), transcript variant 1, mRNA NM_003326 | GGCCCUGGGACCUUUGCCUAUUUUCUGAUUGAUAGGCUUUGU UUUGUCUUUACCUCCUUCUUUCUGGGGAAAACUUCAGUUUUA UCGCACGUUCCCCUUUUCCAUAUCUUCAUCUUCCCUCUACCC AGAUUGUGAAGAUGGAAAGGGUCCAACCCCUGGAAGAGAAUG UGGGAAAUGCAGCCAGGCCAAGAUUCGAGAGGAACAAGCUAU UGCUGGUGGCCUCUGUAAUUCAGGGACUGGGGCUGCUCCUGU GCUUCACCUACAUCUGCCUGCACUUCUCUGCUCUUCAGGUAU CACAUCGGUAUCCUCGAAUUCAAAGUAUCAAAGUACAAUUUA CCGAAUAUAAGAAGGAGAAAGGUUUCAUCCUCACUUCCCAAA AGGAGGAUGAAAUCAUGAAGGUGCAGAACAACUCAGUCAUCA UCAACUGUGAUGGGUUUUAUCUCAUCUCCCUGAAGGGCUACU UCUCCCAGGAAGUCAACAUUAGCCUUCAUUACCAGAAGGAUG AGGAGCCCCUCUUCCAACUGAAGAAGGUCAGGUCUGUCAACU CCUUGAUGGUGGCCUCUCUGACUUACAAAGACAAAGUCUACU UGAAUGUGACCACUGACAAUACCUCCCUGGAUGACUUCCAUG UGAAUGGCGGAGAACUGAUUCUUAUCCAUCAAAAUCCUGGUG AAUUCUGUGUCCUUUGAGGGGCUGAUGGCAAUAUCUAAAACC AGGCACCAGCAUGAACACCAAGCUGGGGGUGGACAGGGCAUG GAUUCUUCAUUGCAAGUGAAGGAGCCUCCCAGCUCAGCCACG UGGGAUGUGACAAGAAGCAGAUCCUGGCCCUCCCGCCCCCAC CCCUCAGGGAUAUUUAAAACUUAUUUUAUAUACCAGUUAAUC UUAUUUAUCCUUAUAUUUUCUAAAUUGCCUAGCCGUCACACC CCAAGAUUGCCUUGAGCCUACUAGGCACCUUUGUGAGAAAGA AAAAAUAGAUGCCUCUUCUUCAAGAUGCAUUGUUUCUAUUGG UCAGGCAAUUGUCAUAAUAAACUUAUGUCAUUGAAAACGGUA CCUGACUACCAUUUGCUGGAAAUUUGACAUGUGUGUGGCAUU AUCAAAAUGAAGAGGAGCAAGGAGUGAAGGAGUGGGGUUAUG AAUCUGCCAAAGGUGGUAUGAACCAACCCCUGGAAGCCAAAG CGGCCUCUCCAAGGUUAAAUUGAUUGCAGUUUGCAUAUUGCC UAAAUUUAAACUUUCUCAUUUGGUGGGGGUUCAAAAGAAGAA UCAGCUUGUGAAAAAUCAGGACUUGAAGAGAGCCGUCUAAGA AAUACCACGUGCUUUUUUUCUUUACCAUUUUGCUUUCCCAGC CUCCAAACAUAGUUAAUAGAAAUUUCCCUUCAAAGAACUGUC UGGGGAUGUGAUGCUUUGAAAAAUCUAAUCAGUGACUUAAGA GAGAUUUUCUUGUAUACAGGGAGAGUGAGAUAACUUAUUGUG AAGGGUUAGCUUUACUGUACAGGAUAGCAGGGAACUGGACAU CUCAGGGUAAAAGUCAGUACGGAUUUUAAUAGCCUGGGGAGG AAAACACAUUCUUUGCCACAGACAGGCAAAGCAACACAUGCU CAUCCUCCUGCCUAUGCUGAGAUACGCACUCAGCUCCAUGUC UUGUACACACAGAAACAUUGCUGGUUUCAAGAAAUGAGGUGA UCCUAUUAUCAAAUUCAAUCUGAUGUCAAAUAGCACUAAGAA GUUAUUGUGCCUUAUGAAAAAUAAUGAUCUCUGUCUAGAAAU ACCAUAGACCAUAUAUAGUCUCACAUUGAUAAUUGAAACUAG AAGGGUCUAUAAUCAGCCUAUGCCAGGGCUUCAAUGGAAUAG UAUCCCCUUAUGUUUAGUUGAAAUGUCCCCUUAACUUGAUAU AAUGUGUUAUGCUUAUGGCGCUGUGGACAAUCUGAUUUUUCA UGUCAACUUUCCAGAUGAUUUGUAACUUCUCUGUGCCAAACC UUUUAUAAACAUAAAUUUUUGAGAUAUGUAUUUUAAAAUUGU AGCACAUGUUUCCCUGACAUUUUCAAUAGAGGAUACAACAUC ACAGAAUCUUUCUGGAUGAUUCUGUGUUAUCAAGGAAUUGUA CUGUGCUACAAUUAUCUCUAGAAUCUCCAGAAAGGUGGAGGG | 1164 (3484 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | CUGUUCGCCCUUACACUAAAUGGUCUCAGUUGGAUUUUUUUU UCCUGUUUUCUAUUUCCUCUUAAGUACACCUUCAACUAUAUU CCCAUCCCUCUAUUUUAAUCUGUUAUGAAGGAAGGUAAAUAA AAAUGCUAAAUAGAAGAAAUUGUAGGUAAGGUAAGAGGAAUC AAGUUCUGAGUGGCUGCCAAGGCACUCACAGAAUCAUAAUCA UGGCUAAAUAUUUAUGGAGGGCCUACUGUGGACCAGGCACUG GGCUAAAUACUUACAUUUACAAGAAUCAUUCUGAGACAGAUA UUCAAUGAUAUCUGGCUUCACUACUCAGAAGAUUGUGUGUGU GUUUGUGUGUGUGUGUGUGUGUAUUUCACUUUUUGUUAUU GACCAUGUUCUGCAAAAUUGCAGUUACUCAGUGAGUGAUAUC CGAAAAAGUAAACGUUUAUGACUAUAGGUAAUAUUUAAGAAA AUGCAUGGUUCAUUUUUAAGUUUGGAAUUUUUAUCUAUAUUU CUCACAGAUGUGCAGUGCACAUGCAGGCCUAAGUAUAUGUUG UGUGUGUUGUUUGUCUUUGAUGUCAUGGUCCCCUCUCUUAGG UGCUCACUCGCUUUGGGUGCACCUGGCCUGCUCUUCCCAUGU UGGCCUCUGCAACCACACAGGGAUAUUUCUGCUAUGCACCAG CCUCACUCCACCUUCCUUCCAUCAAAAAUAUGUGUGUGUGUC UCAGUCCCUGUAAGUCAUGUCCUUCACAGGGAGAAUUAACCC UUCGAUAUACAUGGCAGAGUUUUGUGGGAAAAGAAUUGAAUG AAAAGUCAGGAGAUCAGAAUUUUAAAUUUGACUUAGCCACUA ACUAGCCAUGUAACCUUGGGAAAGUCAUUUCCCAUUUCUGGG UCUUGCUUUUCUUUCUGUUAAAUGAGAGGAAUGUUAAAUAUC UAACAGUUUAGAAUCUUAUGCUUACAGUGUUAUCUGUGAAUG CACAUAUUAAAUGUCUAUGUUCUUGUUGCUAUGAGUCAAGGA GUGUAACCUUCUCCUUUACUAUGUUGAAUGUAUUUUUUUCUG GACAAGCUUACAUCUUCCUCAGCCAUCUUUGUGAGUCCUUCA AGAGCAGUUAUCAAUUGUUAGUUAGAUAUUUUCUAUUUAGAG AAUGCUUAAGGGAUUCCAAUCCCGAUCCAAAUCAUAAUUUGU UCUUAAGUAUACUGGGCAGGUCCCCUAUUUUAAGUCAUAAUU UUGUAUUUAGUGCUUUCCUGGCUCUCAGAGAGUAUUAAUAUU GAUAUUAAUAAUAUAGUUAAUAGUAAUAUUGCUAUUUACAUG GAAACAAAUAAAAGAUCUCAGAAUUCACUAAAAAAAAAAA | |
| OX40L (TNFSF4) | Nucleotide sequence of *Mus musculus* tumor necrosis factor (ligand) superfamily, member 4 (Tnfsf4), mRNA NM_009452 | AUUGCUUUUUGUCUCCUGUUCUGGGACCUUUAUCUUCUGACC CGCAGGCUUGACUUUGCCCUUAUUGGCUCCUUUGUGGUGAAG AGCAGUCUUCCCCCAGGUUCCCCGCCACAGCUGUAUCUCCUC UGCACCCCGACUGCAGAGAUGGAAGGGGAAGGGGUUCAACCC CUGGAUGAGAAUCUGGAAAACGGAUCAAGGCCAAGAUUCAAG UGGAAGAAGACGCUAAGGCUGGUGGUCUCUGGGAUCAAGGGA GCAGGGAUGCUUCUGUGCUUCAUCUAUGUCUGCCUGCAACUC UCUUCCUCUCCGGCAAAGGACCCUCCAAUCCAAAGACUCAGA GGAGCAGUUACCAGAUGUGAGGAUGGGCAACUAUUCAUCAGC UCAUACAAGAAUGAGUAUCAAACUAUGGAGGUGCAGAACAAU UCGGUUGUCAUCAAGUGCGAUGGGCUUUAUAUCAUCUACCUG AAGGGCUCCUUUUUCCAGGAGGUCAAGAUUGACCUUCAUUUC CGGGAGGAUCAUAAUCCCAUCUCUAUUCCAAUGCUGAACGAU GGUCGAAGGAUUGUCUUCACUGUGGUGGCCUCUUUGGCUUUC AAAGAUAAAGUUUACCUGACUGUAAAUGCUCCUGAUACUCUC UGCGAACACCUCCAGAUAAAUGAUGGGGAGCUGAUUGUUGUC CAGCUAACGCCUGGAUACUGUGCUCCUGAAGGAUCUUACCAC AGCACUGUGAACCAAGUACCACUGUGAAUUCCACUCUGAGGG UGGACGGGACACAGGUUCUUUCUCGAGAGAGAUGAGUGCAUC CUGCUCAUGAGAUGUGACUGAAUGCAGAGCCUACCCUACUUC CUCACUCAGGGAUAUUUAAAUCAUGUCUUACAUAACAGUUGA CCUCUCAUUCCCAGGAUUGCCUUGAGCCUGCUAAGAGCUGUU CUGGGAAUGAAAAAAAAAAUAAAUGUCUCUUCAAGACACAUU GCUUCUGUCGGUCAGAAGCUCAUCGUAAUAAACAUCUGCCAC UGAAAAUGGCGCUUGAUUGCUAUCUUCUAGAAUUUUGAUGUU GUCAAAAGAAAGCAAAACAUGGAAAGGGUGGUGUCCACCGGC CAGUAGGAGCUGGAGUGCUCUCUUCAAGGUUAAGGUGAUAGA AGUUUACAUGUUGCCUAAAACUGUCUCUCAUCUCAUGGGGGG CUUGGAAAGAAGAUUACCCCGUGGAAAGCAGGACUUGAAGAU GACUGUUUAAGCAACAAGGUGCACUCUUUUCCUGGCCCCUGA AUACACAUAAAAGACAACUUCCUUCAAAGAACUACCUAGGGA CUAUGAUACCCACCAAAGAACCACGUCAGCGAUGCAAAGAAA ACCAGGAGAGCUUUGUUUAUUUUGCAGAGUAUACGAGAGAUU UUACCCUGAGGGCUAUUUUUAUUAUACAGGAUGAGAGUGAAC UGGAUGUCUCAGGAUAAAGGCCAAGAAGGAUUUUUCACAGUC UGAGCAAGACUGUUUUUGUAGGUUCUCUCUCCAAAACUUUUA GGUAAAUUUUUGAUAAUUUUAAAAUUUUUAGUUAUAUUUUUG GACCAUUUUCAAUAGAAGAUUGAAACAUUUCCAGAUGGUUUC AUAUCCCCACAAG | 1165 (1609 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| OX40L (TNFSF4) | Codon-optimized sequence 1 for ENSP 281834 | AUGGAGAGAGUGCAGCCCCUGGAGGAGAACGUGGGCAACGCC GCCAGACCCAGAUUCGAGAGAAACAAGCUGCUGCUGGUGGCC AGCGUGAUCCAGGGCCUGGGCCUGCUGCUGUGCUUCACCUAC AUCUGCCUGCACUUCAGCGCCCUGCAGGUGAGCCACAGAUAC CCCAGAAUCCAGAGCAUCAAGGUGCAGUUCACCGAGUACAAG AAGGAGAAGGGCUUCAUCCUGACCAGCCAGAAGGAGGACGAG AUCAUGAAGGUGCAGAACAACAGCGUGAUCAUCAACUGCGAC GGCUUCUACCUGAUCAGCCUGAAGGGCUACUUCAGCCAGGAG GUGAACAUCAGCCUGCACUACCAGAAGGACGAGGAGCCCCUG UUCCAGCUGAAGAAGGUGAGAAGCGUGAACAGCCUGAUGGUG GCCAGCCUGACCUACAAGGACAAGGUGUACCUGAACGUGACC ACCGACAACACCAGCCUGGACGACUUCCACGUGAACGGCGGC GAGCUGAUCCUGAUCCACCAGAACCCCGGCGAGUUCUGCGUG CUGUAG | 1166 (552 nts) |
| OX40L (TNFSF4) | Codon-optimized sequence 2 for ENSP 281834 | AUGGAGCGUGUGCAGCCUCUUGAGGAGAAUGUGGGAAAUGCA GCCCGGCCUCGAUUCGAACGUAAUAAACUCCUGCUCGUGGCC UCCGUGAUCCAGGGUCUCGGUUUAUUGCUGUGUUUUACCUAU AUAUGCUUACACUUUAGUGCAUUACAGGUCUCACACCGGUAC CCUCGCAUUCAGUCUAUAAAAGUGCAGUUUACCGAGUAUAAG AAGGAGAAAGGUUUUAUACUGACUUCUCAGAAAGAGGACGAG AUCAUGAAGGUGCAGAAUAAUAGCGUCAUUAUCAACUGCGAU GGAUUCUAUCUAAUUUCCCUAAAGGGGUACUUCAGCCAGGAG GUCAAUAUAUCACUGCACUAUCAAAAGGACGAGGAGCCCCUG UUUCAACUGAAGAAAGUGCGAUCAGUUAACUCUCUGAUGGUU GCCUCUCUGACCUAUAAGGACAAAGUCUACUUGAACGUGACA ACUGACAACACCUCACUGGAUGACUUUCAUGUGAAUGGGGGG GAACUGAUUCUUAUCCAUCAGAAUCCAGGAGAAUUCUGUGUG CUCUAG | 1167 (552 nts) |
| OX40L (TNFSF4) | Codon-optimized sequence 3 for ENSP 281834 | AUGGAGCGGGUGCAGCCCCUGGAGGAGAAUGUGGGCAAUGCU GCCCGGCCCAGGUUUGAAAGAAACAAGCUGCUGCUGGUGGCC AGCGUCAUCCAGGGCCUGGGCCUGCUGCUGUGCUUCACCUAC AUCUGCCUGCACUUCAGCGCCCUGCAGGUGAGCCACCGCUAC CCCCGCAUCCAGAGCAUCAAGGUGCAGUUCACAGAGUACAAG AAGGAGAAGGGCUUCAUCCUGACCAGCCAGAAGGAGGAUGAG AUCAUGAAGGUGCAGAACAACAGCGUCAUCAUCAACUGUGAU GGCUUCUACCUGAUCAGCCUGAAGGGCUACUUCAGCCAGGAG GUGAACAUCAGCCUGCACUACCAGAAGGAUGAGGAGCCCCUC UUCCAGCUGAAGAAGGUGCGCUCUGUGAACAGCCUGAUGGUG GCCAGCCUGACCUACAAGGACAAGGUGUACCUGAAUGUGACC ACAGACAACACCAGCCUGGAUGACUUCCACGUGAAUGGAGGA GAGCUGAUCCUGAUCCACCAGAACCCUGGAGAGUUCUGUGUG CUGUAG | 1168 (552 nts) |
| OX40L (TNFSF4) | Codon-optimized sequence 4 for ENSP 281834 | AUGGAGCGGGUGCAGCCCCUGGAGGAGAACGUGGGCAACGCC GCCCGCCCGCGUUUUGAGCGAAAUAAGUUACUGCUUGUUGCA UCUGUGAUACAGGGGUUGGGUUUACUUCUUUGCUUUACAUAU AUUUGUCUCCACUUUAGUGCGCUUCAGGUAUCCCAUCGGUAC CCGCGCAUCCAGUCAAUCAAGGUCCAGUUCACUGAAUAUAAA AAGGAGAAAGGAUUCAUUCUGACUUCACAAAAAGAGGACGAA AUCAUGAAAGUGCAGAACAACUCUGUAAUUAUAAACUGCGAU GGGUUCUAUCUGAUCAGUCUGAAGGGAUAUUUUAGCCAGGAA GUAAAUAUUUCACUACAUUAUCAGAAGGACGAAGAACCACUU UUUCAACUGAAGAAAGUCCGGUCCGUGAACUCCCUGAUGGUU GCUAGCCUUACCUACAAGGAUAAAGUCUAUUUAAACGUCACA ACAGAUAACACUAGCCUCGACGAUUUCCAUGUGAACGGAGGU GAACUGAUAUUGAUCCAUCAAAACCCCGGCGAGUUCUGCGUU UUAUAG | 1169 (552 nts) |
| OX40L (TNFSF4) | Codon-optimized sequence 5 for ENSP 281834 | AUGGAGCGGGUCCAGCCCCUCGAGGAGAACGUUGGUAAUGCC GCACGUCCCAGGUUUGAACGCAACAAGCUGCUGUUGGUGGCC AGCGUCAUUCAGGGGCUGGGUUUGUUGCUGUGCUUCACUUAC AUCUGUCUGCAUUUUAGUGCACUCCAGGUGUCCCACCGCUAC CCCCGUAUCCAAUCCAUUAAAGUCCAAUUUACCGAAUACAAA AAAGAGAAGGGUUUCAUUCUUACCUCCCAGAAGGAGGAUGAA AUUAUGAAGGUGCAGAACAAUUCUGUUAUCAUCAACUGUGAC GGAUUCUAUCUGAUUUCACUGAAGGGAUACUUUUCCCAGGAG GUGAACAUCAGUCUGCAUUAUCAGAAGGACGAAGAACCGCUU UUUCAACUGAAGAAGGUUAGGAGUGUGAACUCCUUAAUGGUA GCCAGCCUGACAUAUAAGGACAAGGUAUAUCUGAACGUCACC ACUGAUAACACCUCUUUAGACGAUUUUCAUGUAAAUGGGGGA GAAUUGAUACUCAUUCACCAGAAUCCGGGUGAGUUUUGUGUU CUGUAG | 1170 (552 nts) |

TABLE 17-continued

OX40L Polypeptide and OX40L Polynucleotide Sequences

| Encoded Polypeptide | Description | Sequence | SEQ ID NO (no. aa/nt) |
| --- | --- | --- | --- |
| OX40L (TNFSF4) | Codon-optimized sequence 1 for ENSP 356691 | AUGGUGAGCCACAGAUACCCCAGAAUCCAGAGCAUCAAGGUG<br>CAGUUCACCGAGUACAAGAAGGAGAAGGGCUUCAUCCUGACC<br>AGCCAGAAGGAGGACGAGAUCAUGAAGGUGCAGAACAACAGC<br>GUGAUCAUCAACUGCGACGGCUUCUACCUGAUCAGCCUGAAG<br>GGCUACUUCAGCCAGGAGGUGAACAUCAGCCUGCACUACCAG<br>AAGGACGAGGAGCCCCUGUUCCAGCUGAAGAAGGUGAGAAGC<br>GUGAACAGCCUGAUGGUGGCCAGCCUGACCUACAAGGACAAG<br>GUGUACCUGAACGUGACCACCGACAACACCAGCCUGGACGAC<br>UUCCACGUGAACGGCGGCGAGCUGAUCCUGAUCCACCAGAAC<br>CCCGGCGAGUUCUGCGUGCUGUAG | 1171<br>(402 nts) |
| OX40L (TNFSF4) | Codon-optimized sequence 2 for ENSP 356691 | AUGGUUUCUCACCGUUACCCACGGAUCCAGUCUAUCAAGGUU<br>CAGUUUACCGAGUACAAAAGGAAAAGGGUUCAUCCUCACC<br>UCUCAGAAAGAGGACGAAAUCAUGAAGGUGCAGAAUAACUCU<br>GUAAUCAUUAAUUGCGACGGUUUUUAUCUGAUUUCACUGAAG<br>GGCUACUUUAGUCAGGAAGUUAAUAUUAGUUUGCACUACCAA<br>AAGGACGAGGAGCCUCUCUUCCAACUAAAAAAGGUAAGAUCC<br>GUUAAUUCCCUUAUGGUGGCCUCCUUAACUUAUAAGGACAAG<br>GUGUAUCUGAAUGUGACCACAGAUAACACAUCCCUGGACGAC<br>UUUCAUGUAAAUGGCGGCGAGUUAAUUCUGAUACACCAGAAC<br>CCUGGCGAGUUCUGCGUGCUGUAG | 1172<br>(402 nts) |
| OX40L (TNFSF4) | Codon-optimized sequence 3 for ENSP 356691 | AUGGUGAGCCACCGCUACCCCCGCAUCCAGAGCAUCAAGGUG<br>CAGUUCACAGAGUACAAGAAGGAGAAGGGCUUCAUCCUGACC<br>AGCCAGAAGGAGGAUGAGAUCAUGAAGGUGCAGAACAACAGC<br>GUCAUCAUCAACUGUGAUGGCUUCUACCUGAUCAGCCUGAAG<br>GGCUACUUCAGCCAGGAGGUGAACAUCAGCCUGCACUACCAG<br>AAGGAUGAGGAGCCCCUCUUCCAGCUGAAGAAGGUGCGCUCU<br>GUGAACAGCCUGAUGGUGGCCAGCCUGACCUACAAGGACAAG<br>GUGUACCUGAAUGUGACCACAGACAACACCAGCCUGGAUGAC<br>UUCCACGUGAAUGGAGGAGAGCUGAUCCUGAUCCACCAGAAC<br>CCUGGAGAGUUCUGUGUGCUGUAG | 1173<br>(402 nts) |
| OX40L (TNFSF4) | Codon-optimized sequence 4 for ENSP 356691 | AUGGUGAGCCACCGGUACCCCCGGAUCCAGAGCAUCAAGGUG<br>CAGUUCACCGAAUACAAGAAGGAGAAGGGUUUUAUCCUGACG<br>AGCCAGAAGGAAGACGAGAUUAUGAAGGUCCAAAACAACUCA<br>GUCAUCAUAAACUGCGAUGGAUUUUACCUGAUCUCUCUGAAA<br>GGGUACUUCUCCCAGGAAGUGAAUAUUAGCUUGCACUAUCAA<br>AAAGAUGAGGAGCCUCUAUUCCAGCUCAAGAAGGUCAGAAGC<br>GUCAAUAGUCUGAUGGUCGCAUCAUUAACCUAUAAAGACAAA<br>GUAUAUCUAAAUGUGACGACAGACAAUACAUCCCUCGAUGAU<br>UUUCACGUCAACGGAGGCGAACUCAUUCUGAUCCACCAGAAU<br>CCAGGGGAAUUUUGCGUGCUGUAG | 1174<br>(402 nts) |
| OX40L (TNFSF4) | Codon-optimized sequence 5 for ENSP 356691 | AUGGUCUCACACCGGUACCCCCGUAUCCAGAGUAUUAAGGUG<br>CAAUUCACGGAGUAUAAAAAGAAAAGGGAUUCAUUCUGACG<br>UCUCAGAAGGAAGAUGAGAUCAUGAAGGUCCAGAACAAUUCU<br>GUGAUCAUUAAUUGCGAUGGAUUUUAUCUGAUUUCACUUAAA<br>GGAUAUUUUUCCCAGGAGGUUAAUAUCAGUUUGCACUAUCAG<br>AAAGACGAGGAGCCAUUAUUCCAGCUGAAGAAGGUGAGAUCA<br>GUGAAUAGCCUGAUGGUUGCGUCACUGACGUAUAAAGACAAA<br>GUUUAUCUAAACGUUACCACUGAUAAUACAUCCCUUGAUGAU<br>UUUCAUGUGAACGGGGGUGAACUGAUCCUUAUACACCAGAAC<br>CCCGGAGAGUUCUGUGUGUUGUAG | 1175<br>(402 nts) |
| OX40L (TNFSF4) | Codon-optimized sequence 1 for ENSP 439704 | AUGGUGAGCCACAGAUACCCCAGAAUCCAGAGCAU<br>CAAGGUGCAGUUCACCGAGUACAAGAAGGAGAAGGGCUUCAU<br>CCUGACCAGCCAGAAGGAGGACGAGAUCAUGAAGGUGCAGAA<br>CAACAGCGUGAUCAUCAACUGCGACGGCUUCUACCUGAUCAG<br>CCUGAAGGGCUACUUCAGCCAGGAGGUGAACAUCAGCCUGCA<br>CUACCAGAAGGACGAGGAGCCCCUGUUCCAGCUGAAGAAGGU<br>GAGAAGCGUGAACAGCCUGAUGGUGGCCAGCCUGACCUACAA<br>GGACAAGGUGUACCUGAACGUGACCACCGACAACACCAGCCU<br>GGACGACUUCCACGUGAACGGCGGCGAGCUGAUCCUGAUCCA<br>CCAGAACCCCGGCGAGUUCUGCGUGCUGUAG | 1176<br>(401 nts) |
| OX40L (TNFSF4) | Codon-optimized sequence 2 for ENSP 439704 | AUGGUGUCACACCGGUACCCUCGGAUCCAGUCUAUUAAAGUU<br>CAAUUUACGGAGUACAAGAAAGAAAAAGGCUUUAUCCUUACA<br>AGCCAAAAGGAAGACGAGAUCAUGAAAGUGCAAAACAACAGU<br>GUGAUUAUAAAUUGUGAUGGCUUCUACCUUAUUAGUCUGAAG<br>GGCUACUUUAGUCAGGAAGUCAAUAUUAGCCUACACUACCAG<br>AAAGACGAGGAGCCCCUCUUUCAACUGAAAAAGGUGCGCUCC<br>GUGAAUUCGUUGAUGGUCGCCUCUCUGACCUACAAAGAUAAG<br>GUGUAUCUUAACGUUACUACCGACAAUACUAGUCUGGACGAC<br>UUUCACGUCAACGGAGGCGAACUUAUUCUGAUCCACCAGAAC | 1177<br>(402 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | CCCGGCGAAUUCUGCGUGCUGUAG | |
| OX40L (TNFSF4) | Codon-optimized sequence 3 for ENSP 439704 | AUGGUGAGCCACCGCUACCCCCGCAUCCAGAGCAUCAAGGUG CAGUUCACAGAGUACAAGAAGGAGAAGGGCUUCAUCCUGACC AGCCAGAAGGAGGAUGAGAUCAUGAAGGUGCAGAACAACAGC GUCAUCAUCAACUGUGAUGGCUUCUACCUGAUCAGCCUGAAG GGCUACUUCAGCCAGGAGGUGAACAUCAGCCUGCACUACCAG AAGGAUGAGGAGCCCCUCUUCCAGCUGAAGAAGGUGCGCUCU GUGAACAGCCUGAUGGUGGCCAGCCUGACCUACAAGGACAAG GUGUACCUGAAUGUGACCACAGACAACACCAGCCUGGAUGAC UUCCACGUGAAUGGAGGAGAGCUGAUCCUGAUCCACCAGAAC CCUGGAGAGUUCUGUGUGCUGUAG | 1178 (402 nts) |
| OX40L (TNFSF4) | Codon-optimized sequence 4 for ENSP 439704 | AUGGUGAGCCACCGGUACCCCCGGAUCCAGAGCAUCAAGGUG CAGUUCACAGAGUACAAGAAGGAGAAGGGAUUUAUUCUCACA AGUCAGAAAGAAGAUGAGAUCAUGAAGGUUCAGAACAACUCA GUCAUUAUUAAUUGCGACGGAUUCUAUCUCAUUAGCCUCAAA GGCUAUUUCAGCCAGGAGGUCAAUAUCAGCCUGCACUACCAG AAGGAUGAGGAACCUCUCUUUCAGCUGAAAAAAGUCCGCUCU GUGAAUUCCCUCAUGGUCGCUUCCCUGACCUACAAGGAUAAA GUUUAUUUGAACGUUACAACAGAUAAUACAUCGCUGGACGAC UUCCAUGUGAAUGGUGGCGAACUAAUUCUAAUACACCAAAAU CCAGGCGAAUUUUGUGUCCUUUAG | 1179 (402 nts) |
| OX40L (TNFSF4) | Codon-optimized sequence 5 for ENSP 439704 | AUGGUAUCCCAUAGAUACCCACGUAUUCAAAGCAUUAAGGUG CAGUUCACAGAGUACAAAAAGGAGAAGGGUUUCAUACUGACG UCACAGAAGGAGGACGAGAUAAUGAAGGUGCAGAAUAAUAGU GUGAUCAUCAAUUGUGAUGGAUUCUAUUUGAUCAGCCUCAAA GGUUAUUUCUCACAGGAAGUCAACAUUUCCCUGCACUACCAG AAGGACGAAGAGCCUUUGUUUCAGCUGAAGAAGGUGCGCUCA GUGAACAGUUUGAUGGUAGCCUCCCUAACUUAUAAAGAUAAA GUUUAUCUGAACGUGACAACCGAUAACACAUCCCUGGACGAC UUUCACGUCAAUGGAGGUGAGUUAAUCCUGAUCCAUCAGAAU CCCGGAGAAUUCUGCGUUCUUUAG | 1180 (402 nts) |
| OX40L (TNFSF4) | Codon-optimized sequence OX40L-CO1 | AUGGAGAGGGUCCAGCCCCUAGAGGAGAACGUAGGCAACGCC GCCCGACCCAGGUUCGAGCGCAACAAGCUCCUCCUGGUCGCC AGCGUCAUCCAAGGCCUCGGCCUCCUCUUGUGCUUCACCUAC AUCUGCCUCCACUUCAGCGCCCUCCAGGUGUCGCACAGGUAC CCGAGGAUUCAGAGCAUCAAAGUACAGUUCACCGAGUACAAG AAGGAGAAGGGCUUCAUCCUCACCUCCCAGAAGGAGGACGAG AUUAUGAAGGUCCAGAACAAUAGCGUCAUCAUCAACUGCGAC GGCUUCUAUCUGAUCAGCCUGAAGGGCUACUUCUCCCAAGAA GUAAACAUCAGCCUGCACUACCAGAAGGACGAGGAGCCACUC UUCCAGCUGAAAAAGGUGAGGUCCGUCAACAGCCUGAUGGUG GCCUCCUUGACAUACAAGGACAAGGUGUACCUGAACGUGACC ACGGAUAACACCAGCCUGGAUGACUUCCAUGUCAACGGCGGC GAGCUGAUCCUGAUCCACCAAAACCCCGGCGAGUUCUGCGUG CUG | 1181 (549 nts) |
| OX40L (TNFSF4) | Codon-optimized sequence OX40L-CO2 | AUGGAGAGGGUCCAGCCCCUUGAGGAGAACGUAGGGAACGCA GCCCGCCCGAGGUUCGAGAGGAACAAGCUCCUCUUGGUCGCC UCGGUUAUCCAGGGACUCGGGCUCCUUCUCUGCUUCACGUAC AUCUGCCUUCACUUUUCGGCCCUACAGGUAAGCCACAGGUAC CCCAGGAUCCAGAGCAUCAAGGUCCAGUUCACCGAGUAUAAG AAGGAAAAGGGGUUCAUCCUCACCUCCCAGAAGGAGGACGAG AUCAUGAAGGUCCAGAACAACAGCGUCAUCAUUAAUUGCGAC GGCUUUUACCUCAUCAGCCUGAAGGGAUACUUCAGCCAGGAG GUGAACAUCAGCCUGCAUUACCAGAAGGACGAAGAACCCCUG UUCCAGCUGAAGAAGGUGCGCUCGGUCAACUCCCUGAUGGUG GCCAGCCUGACCUACAAGGACAAGGUGUACCUGAACGUGACG ACCGACAACACCAGCCUGGAUGAUUUUCACGUGAACGGGGGC GAGCUGAUCCUGAUCCACCAGAACCCCGGCGAGUUCUGCGUG CUG | 1182 (549 nts) |
| OX40L (TNFSF4) | Codon-optimized sequence OX40L-CO3 | AUGGAGAGGGUACAGCCCCUAGAGGAGAACGUCGGGAACGCC GCUCGGCCCCGGUUCGAACGCAACAAGCUCCUCCUCGUCGCG AGCGUCAUCCAGGGCCUCGGGCUCUUGCUUUGCUUCACCUAC AUUUGCCUCCACUUUAGCGCGCUCCAGGUGUCGCACAGGUAC CCGCGAAUACAGAGCAUCAAGGUCCAGUUCACCGAGUACAAA AAAGAGAAGGGGUUCAUCCUCACCAGCCAGAAGGAGGACGAG AUCAUGAAGGUCCAGAACAACAGCGUCAUCAUCAACUGUGAC GGCUUCUACCUCAUCAGCCUGAAGGGCUACUUCAGCCAGGAG GUCAACAUCAGCCUCCACUACCAGAAGGACGAGGAGCCCCUG UUCCAGCUGAAGAAGGUCAGGAGCGUCAACAGCCUGAUGGUG | 1183 (549 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | GCGAGCCUGACCUACAAAGACAAGGUCUAUCUGAAUGUGACC ACCGACAAUACCAGCCUGGAUGACUUCCACGUGAACGGCGGA GAGCUCAUCCUGAUCCAUCAGAACCCCGGGGAGUUUUGCGUC CUC | |
| OX40L (TNFSF4) | Codon-optimized sequence OX40L-CO4 | AUGGAGAGAGUCCAGCCACUCGAGGAGAACGUGGGGAACGCG GCCAGGCCCAGGUUCGAGAGGAAUAAGCUCCUCCUCGUCGCG UCGGUCAUCCAGGGCCUUGGACUCCUUUUGUGCUUCACCUAC AUCUGCUUGCACUUCUCCGCCCUUCAGGUCAGCCACAGGUAC CCCCGCAUCCAGAGCAUCAAGGUCCAAUUUACCGAGUACAAG AAGGAGAAGGGAUUCAUCCUCACCUCCCAGAAGGAGGACGAA AUAAUGAAGGUCCAGAACAACUCCGUCAUAAUCAACUGCGAC GGGUUCUACCUGAUCAGCCUGAAGGGCUACUUCAGCCAGGAG GUGAACAUCAGCCUCCAUUACCAGAAGGACGAGGAGCCGCUA UUUCAGCUUAAGAAGGUGCGGUCCGUGAACAGCCUGAUGGUG GCCAGCCUCACCUAUAAGGACAAAGUGUACCUGAACGUGACC ACGGACAACACCAGCCUGGACGACUUCCACGUGAACGGGGGC GAGCUGAUCCUGAUCCACCAGAACCCCGGGGAAUUCUGCGUG CUG | 1184 (549 nts) |
| OX40L (TNFSF4) | Codon-optimized sequence OX40L-CO5 | AUGGAGAGGGUACAGCCCCUCGAGGAGAACGUCGGGAACGCC GCCCGGCCCCGGUUCGAGAGGAACAAGCUUCUUCUCGUCGCC AGCGUAAUCCAGGGCCUAGGGCUCCUCCUCUGCUUCACCUAU AUCUGCCUCCACUUCUCCGCGCUCCAGGUCAGCCAUCGGUAC CCCAGGAUCCAGAGCAUAAAGGUCCAAUUCACCGAGUACAAA AAGGAGAAGGGUUUUAUCCUCACAAGCCAGAAGGAGGACGAG AUCAUGAAGGUCCAGAACAACAGCGUCAUAAUCAACUGCGAC GGGUUCUACCUGAUCUCCCUGAAAGGCUACUUCAGCCAGGAG GUGAACAUCAGCCUCCACUACCAGAAGGACGAGGAGCCCCUG UUCCAGCUCAAGAAGGUCAGGUCCGUCAACAGCCUGAUGGUG GCCAGCCUGACCUACAAGGACAAGGUGUAUCUGAACGUGACC ACCGACAACACCAGCCUGGACGACUUUCAUGUCAACGGGGGC GAGCUGAUCCUGAUCCACCAGAACCCAGGCGAGUUCUGCGUC CUG | 1185 (549 nts) |
| OX40L (TNFSF4) | Codon-optimized sequence OX40L-CO6 | AUGGAGAGGGUCCAGCCACUAGAGGAGAACGUAGGUAACGCC GCUAGGCCCAGGUUCGAGCGUAACAAGCUCCUGCUCGUUGCC UCCGUUAUCCAGGGCCUCGGGCUCCUCCUCUGCUUCACUUAU AUCUGCCUCCACUUCUCCGCCCUCCAGGUCAGCCACCGGUAC CCGAGGAUCCAGUCCAUCAAGGUUCAGUUCACCGAGUACAAG AAGGAGAAAGGCUUCAUACUCACCAGCCAGAAGGAGGACGAG AUCAUGAAGGUCCAGAAUAACUCCGUCAUCAUCAACUGUGAC GGCUUCUACCUCAUCUCGCUGAAGGGCUACUUUUCCCAGGAG GUGAACAUCAGCCUGCACUACCAGAAGGACGAGGAGCCCCUG UUCCAGCUGAAGAAGGUGCGGUCCGUGAACAGCCUGAUGGUG GCGAGCCUGACCUACAAGGACAAGGUGUAUCUGAAUGUCACC ACCGACAACACCAGCCUGGACGACUUCCAUGUGAACGGCGGC GAGCUGAUCCUGAUCCACCAAAAUCCGGGCGAGUUUUGCGUG CUC | 1186 (549 nts) |
| OX40L (TNFSF4) | Codon-optimized sequence OX40L-CO7 | AUGGAGAGGGUCCAGCCGCUCGAAGAAAACGUGGGCAACGCC GCCCGGCCCAGGUUCGAGAGGAACAAGCUCCUCCUCGUAGCA UCAGUCAUCCAGGGACUCGGCCUUUUGCUCUGCUUCACCUAC AUCUGCCUCCACUUCAGCGCCUUGCAGGUGUCGCACAGGUAC CCCAGGAUCCAGAGCAUCAAGGUCCAGUUCACCGAAUACAAG AAGGAGAAGGGGUUCAUUCUCACCAGCCAGAAGGAGGACGAA AUCAUGAAGGUCCAGAACAACUCCGUCAUCAUCAACUGCGAC GGAUUCUACCUGAUCAGCCUGAAAGGCUACUUCAGCCAGGAG GUGAAUAUCAGCCUCCACUACCAAAAGGACGAAGAACCCCUG UUUCAGCUCAAGAAGGUGCGGUCCGUGAAUUCCCUCAUGGUC GCCAGCCUGACGUACAAGGACAAGGUGUACCUGAACGUGACC ACCGAUAAUACGUCGCUGGAUGACUUUCACGUAAACGGGGGC GAACUGAUCCUGAUCCACCAGAACCCUGGCGAGUUCUGUGUG CUG | 1187 (549 nts) |
| OX40L (TNFSF4) | Codon-optimized sequence OX40L-CO8 | AUGGAGAGGGUCCAGCCGCUAGAGGAGAACGUCGGCAACGCG GCCAGGCCCAGGUUCGAGAGGAACAAGCUCCUACUCGUUGCC AGUGUGAUCCAGGGCCUCGGGCUCCUCCUUUGCUUCACAUAC AUCUGCCUCCACUUCAGCGCCCUCCAGGUGUCGCAUAGGUAC CCCAGGAUCCAGUCCAUCAAGGUCCAGUUCACGGAAUAUAAG AAGGAGAAGGGAUUUAUCCUCACCUCCCAGAAGGAGGACGAG AUCAUGAAGGUCCAGAACAACAGCGUCAUCAUCAACUGCGAC GGGUUCUACCUGAUCAGCCUGAAGGGCUACUUCAGCCAAGAG GUGAAUAUCAGCCUGCACUACCAGAAGGACGAGGAGCCCCUG UUCCAGCUCAAGAAGGUCCGGAGCGUGAACAGCCUGAUGGUC | 1188 (549 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | GCCAGCCUGACGUACAAAGACAAGGUGUACCUGAACGUGACU ACGGACAACACCAGCCUGGACGACUUCCACGUGAACGGCGGG GAGCUGAUCCUGAUCCACCAGAACCCCGGGGAGUUCUGCGUG CUG | |
| OX40L (TNFSF4) | Codon-optimized sequence OX40L-CO9 | AUGGAACGGGUCCAGCCCCUCGAGGAGAACGUAGGCAACGCC GCCAGGCCCAGGUUCGAGCGGAACAAGCUCCUCCUCGUCGCC UCGGUCAUCCAGGGCCUCGGGCUCCUCCUUUGCUUCACCUAU AUCUGCCUUCACUUCUCCGCCCUCCAGGUGUCCCACCGGUAC CCCCGGAUCCAGUCCAUCAAGGUCCAGUUCACCGAGUAUAAG AAAGAGAAGGGAUUCAUCCUCACCUCUCAGAAGGAGGACGAG AUCAUGAAGGUUCAGAACAACAGCGUCAUCAUCAACUGCGAC GGCUUCUAUCUGAUCAGCCUGAAGGGCUACUUCAGCCAAGAA GUCAACAUCAGCCUGCACUACCAGAAGGACGAGGAGCCCCUG UUCCAGCUGAAGAAGGUCAGGAGCGUGAACUCCCUGAUGGUG GCGAGCCUGACCUACAAGGACAAGGUGUACCUGAACGUGACC ACCGACAAUACCAGCCUGGAUGACUUCCACGUGAACGGCGGC GAGCUCAUCCUGAUCCACCAGAACCCCGGCGAGUUCUGCGUG CUG | 1189 (549 nts) |
| OX40L (TNFSF4) | Codon-optimized sequence OX40L-CO10 | AUGGAGAGGGUUCAGCCCCUAGAGGAAAACGUCGGCAACGCG GCCAGGCCCCGGUUCGAGAGGAAUAAGCUCCUCCUCGUGGCG UCGGUCAUCCAGGGCCUCGGCCUCCUCUUGUGCUUCACCUAC AUCUGCCUCCAUUUCAGCGCCCUCCAGGUCAGCCACAGGUAC CCCAGGAUCCAGAGCAUCAAGGUCCAGUUCACCGAGUACAAG AAGGAGAAGGGCUUCAUCCUCACCAGCCAGAAGGAGGACGAG AUCAUGAAGGUCCAGAACAAUUCAGUCAUCAUCAACUGCGAC GGCUUCUACCUGAUCUCCCUGAAGGGAUACUUCAGCCAGGAG GUGAACAUCAGCCUCCACUACCAGAAGGAUGAGGAGCCGCUG UUCCAGCUGAAAAAGGUGAGGUCCGUGAACUCCCUGAUGGUC GCCUCGCUGACCUAUAAGGACAAGGUCUACCUGAACGUGACC ACCGACAACACGAGCCUCGACGAUUUUCACGUCAACGGGGGA GAGCUCAUUCUAAUCCACCAGAACCCCGGCGAGUUCUGCGUG CUG | 1190 (549 nts) |
| OX40L (TNFSF4) | Codon-optimized sequence OX40L-CO11 | AUGGAGAGGGUCCAGCCCCUAGAAGAGAACGUCGGCAACGCC GCCCGCCCCAGGUUCGAGAGGAACAAGCUCCUCCUAGUCGCU UCCGUCAUCCAGGGCCUUGGGCUCCUCCUCUGCUUCACCUAU AUCUGCCUCCACUUCAGCGCCCUCCAGGUGUCCCACCGCUAC CCGCGGAUCCAAUCCAUCAAGGUCCAGUUCACGGAGUAUAAA AAGGAAAAAGGGUUCAUCCUCACCUCCCAGAAGGAAGACGAG AUCAUGAAGGUCCAGAACAACUCCGUCAUCAUCAACUGCGAC GGCUUCUACCUGAUCUCCCUGAAGGGUUAUUUCAGCCAGGAG GUGAACAUCAGCCUGCACUACCAGAAAGACGAGGAGCCGCUG UUCCAGCUGAAAAAGGUGCGGUCCGUGAACAGCCUGAUGGUG GCCUCCCUCACCUACAAGGACAAGGUAUACCUGAACGUGACC ACGGACAACACCAGCCUGGACGACUUCCAUGUGAACGGAGGA GAGCUGAUCCUGAUCCAUCAGAACCCCGGCGAGUUUUGCGUG CUC | 1191 (549 nts) |
| OX40L (TNFSF4) | Codon-optimized sequence OX40L-CO12 | AUGGAGAGGGUACAGCCUCUCGAAGAGAACGUUGGCAACGCC GCCCGGCCCCGGUUCGAGCGGAACAAACUUCUCCUCGUAGCC AGCGUCAUACAGGGGCUAGGCCUCCUACUAUGCUUCACCUAC AUCUGCCUCCACUUCUCGGCCCUACAGGUGUCCCACAGGUAC CCCCGUAUCCAGAGCAUCAAGGUCCAGUUCACCGAGUACAAG AAGGAGAAGGGCUUCAUCUUGACCUCCCAGAAGGAGGACGAG AUCAUGAAGGUCCAGAACAACUCCGUCAUCAUCAAUUGCGAC GGCUUCUACCUCAUCAGCCUGAAGGGGUACUUCAGCCAAGAG GUGAACAUCUCCCUGCACUAUCAGAAGGACGAGGAGCCCCUG UUCCAGCUGAAGAAGGUGCGAAGCGUGAACUCCCUGAUGGUC GCCAGCUUGACCUAUAAGGAUAAGGUCUACCUGAACGUGACC ACCGAUAAUACCUCCCUCGAUGACUUCCACGUCAACGGAGGG GAGCUUAUCCUGAUCCACCAGAAUCCCGGGGAGUUCUGCGUG CUG | 1192 (549 nts) |
| OX40L (TNFSF4) | Codon-optimized sequence OX40L-CO13 | AUGGAGAGGGUCCAGCCGCUCGAGGAGAACGUAGGCAACGCC GCCAGGCCGAGGUUCGAGAGGAACAAACUCCUACUCGUGGCC UCCGUCAUACAGGGCCUAGGUCUGCUCCUCUGUUUCACCUAU AUCUGCCUUCACUUCAGCGCCCUCCAGGUGUCGCACCGAUAU CCCAGGAUCCAGAGUAUCAAGGUUCAGUUCACCGAGUACAAG AAGGAGAAGGGCUUUAUCCUUACCUCCCAGAAGGAGGACGAG AUCAUGAAGGUCCAGAAUAACAGCGUCAUCAUCAAUUGUGAC GGGUUCUACCUCAUCAGCCUGAAGGGGUACUUCUCCCAGGAA GUGAACAUUUCCCUGCACUACCAGAAAGAUGAAGAACCCCUG UUUCAGCUGAAAAAGGUGCGCUCCGUGAACAGCCUGAUGGUG | 1193 (549 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | GCCAGCCUGACGUACAAGGACAAGGUGUAUCUGAACGUGACC ACCGACAACACCAGCCUGGAUGAUUUCCACGUCAACGGGGGU GAGCUGAUCCUGAUACACCAGAACCCGGGCGAGUUUUGUGUG CUG | |
| OX40L (TNFSF4) | Codon-optimized sequence OX40L-CO14 | AUGGAGAGGGUCCAGCCCCUCGAAGAGAACGUCGGCAACGCC GCCAGGCCCAGGUUCGAGCGGAACAAGUUGCUCCUCGUUGCC UCUGUGAUCCAGGGUCUGGGCCUCCUCUUAUGCUUCACCUAC AUCUGCCUCCACUUCAGCGCGCUCCAGGUCAGCCACAGGUAC CCGAGGAUCCAGUCGAUCAAGGUACAGUUCACCGAGUACAAG AAGGAGAAGGGCUUCAUCCUCACCUCCCAAAAGGAGGACGAG AUCAUGAAGGUUCAGAACAAUUCCGUCAUCAUCAACUGCGAC GGGUUCUACCUGAUCUCCCUGAAGGGCUACUUCAGCCAGGAG GUGAACAUUAGCCUGCACUAUCAAAAGGACGAGGAGCCGCUG UUCCAGCUUAAGAAAGUGCGGAGCGUGAACUCCCUGAUGGUC GCCUCACUUACCUACAAGGAUAAGGUGUACCUGAACGUGACC ACCGAUAACACCAGCCUGGACGACUUUCACGUCAAUGGCGGG GAGCUGAUCCUGAUCCACCAGAAUCCCGGCGAGUUCUGCGUG CUG | 1194 (549 nts) |
| OX40L (TNFSF4) | Codon-optimized sequence OX40L-CO15 | AUGGAGCGGGUCCAGCCCCUCGAGGAGAACGUUGGCAACGCC GCCAGGCCCCGGUUCGAGAGGAACAAGCUCCUCCUCGUCGCC AGCGUCAUCCAGGGCUUGGGGCUCCUUCUCUGCUUUACCUAC AUCUGCCUCCACUUUUCCGCCUUACAGGUCAGCCACCGGUAC CCCCGGAUCCAGAGCAUCAAAGUUCAGUUCACCGAAUACAAG AAGGAGAAAGGCUUCAUCCUCACCAGCCAGAAGGAAGACGAA AUCAUGAAGGUCCAGAACAAUUCCGUCAUCAUCAACUGUGAC GGUUUUUAUCUCAUCAGCCUGAAGGGCUACUUCUCGCAGGAG GUCAACAUCAGCCUGCACUAUCAGAAGGACGAGGAGCCCCUG UUCCAACUGAAGAAGGUGAGGAGCGUGAAUAGCCUGAUGGUG GCGUCCCUGACCUACAAGGACAAGGUGUACCUCAACGUGACA ACGGACAACACCAGCCUGGAUGACUUCCACGUGAACGGGGGC GAGCUGAUCCUCAUCCACCAAAACCCCGGCGAAUUCUGCGUG CUC | 1195 (549 nts) |
| OX40L (TNFSF4) | Codon-optimized sequence OX40L-CO16 | AUGGAAAGGGUACAGCCCCUCGAGGAGAACGUCGGCAACGCC GCGCGGCCCAGGUUCGAGAGGAACAAGCUCCUCCUCGUCGCC AGCGUCAUCCAAGGCCUAGGCCUUCUACUCUGUUUCACCUAC AUCUGCUUGCACUUUAGCGCCCUACAGGUCAGCCACCGGUAC CCCCGGAUCCAGUCCAUCAAGGUCCAGUUCACCGAGUACAAG AAGGAGAAGGGCUUCAUCCUCACCUCGCAGAAGGAGGACGAG AUCAUGAAGGUCCAGAAUAACAGCGUCAUCAUCAACUGCGAC GGCUUUUACCUGAUCAGCCUGAAGGGCUACUUUUCCCAGGAG GUGAAUAUCUCGCUGCACUACCAGAAGGAUGAGGAGCCCCUG UUCCAGCUGAAAAAAGUCAGGUCCGUCAAUAGCCUGAUGGUG GCGAGCCUGACCUACAAGGACAAAGUGUAUCUGAACGUGACC ACGGACAACACAAGCCUGGAUGACUUCCACGUGAACGGGGGC GAGCUGAUCCUCAUCCACCAGAACCCCGGCGAAUUUUGCGUG CUG | 1196 (549 nts) |
| OX40L (TNFSF4) | Codon-optimized sequence OX40L-CO17 | AUGGAACGCGUCCAGCCCCUCGAGGAGAACGUCGGGAACGCC GCCCGACCCAGGUUCGAAAGGAACAAGCUCUUGCUCGUCGCC AGCGUCAUCCAGGGCCUCGGCCUCCUCCUCUGUUUCACCUAC AUCUGCCUCCACUUCUCGGCGCUCCAGGUGUCGCACCGGUAC CCCAGGAUCCAGAGCAUCAAGGUCCAGUUUACCGAGUAUAAG AAGGAGAAGGGCUUUAUACUCACCAGCCAGAAGGAGGACGAA AUCAUGAAGGUACAGAACAACAGCGUCAUCAUCAACUGCGAC GGCUUUUACCUGAUCAGCCUGAAGGGGUACUUCUCCCAGGAG GUGAACAUCUCCCUCCACUACCAGAAGGACGAAGAACCCCUG UUCCAGCUGAAGAAGGUACGAAGCGUGAACAGUCUGAUGGUC GCCUCCCUGACCUACAAGGAUAAAGUGUAUCUGAACGUGACC ACCGACAACACCUCCCUGGACGACUUUCAUGUGAACGGCGGC GAGCUGAUCCUGAUCCAUCAGAACCCGGGCGAGUUUUGUGUC CUC | 1197 (549 nts) |
| OX40L (TNFSF4) | Codon-optimized sequence OX40L-CO18 | AUGGAGAGGGUCCAGCCCCUCGAGGAGAACGUCGGCAACGCC GCCCGCCCGAGGUUCGAGCGGAAUAAGCUCCUCCUCGUCGCC UCCGUCAUCCAGGGGCUCGGUUUGCUCUUGUGCUUCACCUAC AUCUGCCUCCACUUCAGCGCCCUUCAGGUUAGCCACCGGUAC CCCCGGAUCCAGUCCAUCAAGGUCCAGUUCACCGAAUACAAG AAAGAGAAAGGGUUCAUCCUCACCUCCCAGAAGGAGGACGAA AUAAUGAAGGUCCAGAAUAACAGCGUCAUCAUCAAUUGCGAC GGCUUUUACCUGAUCUCGCUGAAGGGAUACUUCAGCCAGGAG GUGAAUAUCAGCCUCCACUACCAGAAGGACGAGGAGCCGCUG UUCCAGCUGAAGAAGGUGCGAAGCGUCAACUCCCUCAUGGUG | 1198 (549 nts) |

TABLE 17-continued

| OX40L Polypeptide and OX40L Polynucleotide Sequences | | | |
|---|---|---|---|
| Encoded Polypeptide | Description | Sequence | SEQ ID NO (no. aa/nt) |
| | | GCGAGCCUGACCUACAAGGACAAGGUCUAUCUGAACGUGACC<br>ACGGACAACACCAGCCUGGACGACUUUCACGUGAACGGGGGC<br>GAACUGAUCCUGAUCCACCAGAACCCCGGCGAGUUCUGCGUG<br>CUC | |
| OX40L (TNFSF4) | Codon-optimized sequence OX40L-CO19 | AUGGAGAGGGUCCAGCCGCUCGAGGAGAACGUAGGCAACGCC<br>GCCAGGCCACGGUUCGAGAGGAACAAGCUCUUACUCGUCGCC<br>AGCGUCAUCCAGGGCCUCGGCUUGCUCCUCUGUUUCACCUAC<br>AUCUGUCUACACUUCAGCGCCCUUCAAGUCAGCCACAGGUAC<br>CCCCGGAUCCAGUCCAUCAAGGUCCAGUUCACCGAAUACAAG<br>AAAGAGAAGGGGUUCAUCCUCACCUCCCAGAAGGAGGACGAG<br>AUCAUGAAGGUCCAGAACAAUUCCGUCAUCAUAAACUGUGAC<br>GGUUUCUACCUCAUCAGCCUGAAGGGCUACUUCUCGCAGGAA<br>GUGAACAUCAGCCUGCACUACCAGAAGGACGAAGAACCCCUG<br>UUCCAGCUGAAGAAGGUCAGGAGCGUCAAUAGCCUGAUGGUG<br>GCCUCCCUGACCUACAAGGACAAGGUGUAUCUCAAUGUCACC<br>ACCGAUAACACCUCCCUCGACGACUUCCACGUCAACGGCGGG<br>GAGCUGAUCCUUAUCCAUCAGAACCCCGGCGAGUUCUGCGUG<br>CUC | 1199 (549 nts) |
| OX40L (TNFSF4) | Codon-optimized sequence OX40L-CO20 | AUGGAGAGGGUCCAGCCCCUCGAAGAGAACGUAGGCAACGCC<br>GCCAGGCCCAGGUUCGAGCGGAACAAGCUCCUCCUCGUCGCC<br>UCCGUAAUCCAGGGCCUAGGCCUUCUCUUAUGCUUCACCUAC<br>AUCUGCCUACACUUCUCCGCCCUCCAGGUGUCACACAGGUAC<br>CCCCGCAUCCAGAGCAUCAAAGUACAGUUCACCGAGUACAAG<br>AAGGAGAAGGGCUUCAUCCUCACCAGCCAAAAGGAGGACGAG<br>AUCAUGAAAGUACAGAAUAACUCCGUCAUCAUCAACUGCGAC<br>GGGUUCUACCUGAUCUCCCUGAAGGGAUACUUCAGCCAGGAG<br>GUGAACAUCAGCCUCCACUACCAGAAGGACGAGGAGCCCCUC<br>UUCCAGCUGAAGAAGGUGAGGUCCGUGAACAGCCUGAUGGUG<br>GCCAGCCUCACCUACAAGGAUAAGGUGUACCUGAACGUGACC<br>ACGGACAACACCUCCUUGGACGACUUCCACGUGAACGGCGGG<br>GAACUCAUUCUGAUCCACCAAAACCCCGGCGAGUUUUGCGUG<br>CUG | 1200 (549 nts) |
| OX40L (TNFSF4) | Codon-optimized sequence OX40L-CO21 | AUGGAGAGGGUCCAGCCCCUCGAGGAGAACGUCGGCAACGCC<br>GCGAGGCCGAGGUUCGAGAGGAAUAAGCUCCUCCUCGUCGCC<br>AGCGUCAUCCAGGGGCUCGGGUUGCUCCUCUGUUUCACCUAU<br>AUCUGCCUCCACUUCUCCGCCCUCCAGGUGUCGCACAGGUAU<br>CCCCGCAUCCAGAGCAUCAAGGUCCAAUUCACGGAAUACAAG<br>AAGGAGAAGGGAUUCAUCCUCACCUCGCAGAAGGAGGACGAG<br>AUCAUGAAGGUCCAGAACAACAGCGUCAUCAUUAACUGCGAC<br>GGGUUUUACCUGAUCAGCCUGAAGGGGUACUUUAGCCAGGAA<br>GUGAACAUCUCCCUGCAUUAUCAGAAGGAUGAGGAGCCCCUG<br>UUUCAGCUGAAAAAGGUGAGGAGCGUGAACUCCCUGAUGGUC<br>GCCAGCCUGACGUACAAGGACAAAGUCUAUCUGAACGUGACC<br>ACCGACAACACCAGCCUGGAUGACUUUCACGUGAACGGCGGC<br>GAGCUGAUCCUGAUACACCAGAACCCCGGGGAGUUCUGCGUC<br>CUG | 1201 (549 nts) |
| OX40L (TNFSF4) | Codon-optimized sequence OX40L-CO22 | AUGGAAAGGGUACAGCCCCUCGAGGAGAACGUGGGCAACGCC<br>GCCCGCCCCAGGUUCGAGCGCAACAAGCUCCUCCUCGUGGCG<br>AGCGUCAUCCAGGGCCUCGGCCUCCUCCUCUGCUUCACGUAC<br>AUCUGCCUCCACUUCAGCGCGCUCCAAGUAUCCCACAGGUAU<br>CCCCGCAUCCAGUCCAUCAAGGUCCAGUUCACCGAAUACAAG<br>AAGGAGAAGGGGUUCAUCUUAACCAGCCAGAAGGAGGACGAG<br>AUCAUGAAGGUACAGAACAACAGCGUCAUCAUCAACUGCGAC<br>GGCUUCUACCUCAUAUCCCUGAAAGGGUAUUUCUCGCAGGAG<br>GUGAACAUAAGCCUGCACUACCAGAAGGAUGAGGAGCCCCUG<br>UUUCAGCUGAAGAAAGUGCGGAGCGUGAACAGCCUCAUGGUG<br>GCCUCCCUGACGUACAAGGACAAGGUGUAUCUGAACGUGACC<br>ACCGAUAACACCAGCCUGGACGACUUUCACGUGAACGGAGGC<br>GAGCUGAUCCUGAUCCAUCAGAACCCCGGCGAGUUCUGCGUG<br>CUG | 1202 (549 nts) |
| OX40L (TNFSF4) | Codon-optimized sequence OX40L-CO23 | AUGGAGCGGGUACAGCCCUUGGAGGAGAACGUCGGCAACGCC<br>GCCAGGCCCAGGUUCGAGAGGAAUAAACUCCUCCUCGUCGCC<br>UCCGUCAUCCAGGGUCUAGGCCUUCUCCUCUGCUUCACCUAU<br>AUCUGCCUCCACUUCAGCGCCCUCCAGGUUAGCCAUCGGUAC<br>CCCAGGAUCCAGAGCAUCAAGGUACAGUUCACCGAGUACAAA<br>AAGGAGAAGGGCUUCAUCCUCACGUCCCAGAAAGAGGACGAG<br>AUCAUGAAAGUCCAGAACAAUUCCGUAAUCAUCAACUGCGAC<br>GGCUUCUACCUGAUCAGCCUGAAGGGCUACUUCAGCCAGGAG<br>GUAAACAUAAGCCUGCACUACCAGAAGGACGAGGAACCCCUG<br>UUCCAACUUAAAAAGGUGAGGAGCGUGAACAGCCUGAUGGUG | 1203 (549 nts) |

TABLE 17-continued

OX40L Polypeptide and OX40L Polynucleotide Sequences

| Encoded Polypeptide | Description | Sequence | SEQ ID NO (no. aa/nt) |
|---|---|---|---|
| | | GCCUCCCUCACCUAUAAGGACAAGGUGUACCUGAACGUCACG ACGGACAACACCAGCCUGGAUGACUUUCACGUGAACGGCGGC GAGCUGAUCCUGAUCCACCAGAACCCGGGCGAAUUCUGCGUG CUG | |
| OX40L (TNFSF4) | Codon-optimized sequence OX40L-CO24 | AUGGAGAGGGUCCAGCCCUUGGAGGAGAACGUCGGCAACGCC GCCCGGCCUCGGUUCGAACGGAACAAGCUCCUCCUCGUCGCC AGCGUCAUCCAGGGGCUCGGCCUCCUCCUCUGCUUCACCUAC AUCUGCCUCCACUUCUCCGCCCUCCAGGUAAGCCACCGUUAC CCCAGGAUCCAAAGCAUAAAGGUCCAGUUCACCGAAUACAAG AAGGAGAAGGGCUUCAUCCUAACCAGCCAGAAGGAGGACGAG AUCAUGAAGGUCCAGAACAACUCCGUUAUCAUCAACUGCGAC GGAUUCUACCUGAUCAGCCUGAAGGGUUACUUCAGCCAGGAG GUGAACAUCAGCCUGCACUACCAGAAGGACGAGGAGCCCCUG UUCCAGCUCAAGAAGGUCAGGUCCGUGAACAGCCUGAUGGUG GCCAGCCUGACCUACAAGGAUAAGGUGUACCUAAAUGUGACG ACCGACAACACGAGCCUGGACGACUUCCACGUCAACGGCGGC GAGCUGAUCCUCAUCCACCAGAAUCCGGGCGAGUUCUGUGUG CUG | 1204 (549 nts) |
| OX40L (TNFSF4) | Codon-optimized sequence OX40L-CO25 | AUGGAGAGGGUCCAGCCCCUCGAGGAGAACGUCGGCAACGCC GCCCGGCCCCGCUUCGAGAGGAACAAACUCCUCCUCGUCGCG AGCGUCAUCCAGGGCCUCGGGCUCCUCCUCUGCUUCACCUAC AUUUGCCUCCACUUCUCAGCCUUGCAGGUGUCCCACAGGUAC CCGCGCAUCCAGUCCAUCAAGGUCCAGUUCACCGAAUACAAG AAAGAGAAAGGCUUCAUCCUUACGAGCCAGAAGGAGGACGAG AUCAUGAAGGUCCAGAACAACAGCGUAAUCAUCAACUGUGAC GGCUUCUACCUGAUCAGCCUGAAGGGCUACUUCAGCCAGGAG GUGAACAUCAGCCUCCACUACCAGAAGGACGAGGAGCCCCUG UUCCAGCUGAAGAAGGUGAGGUCCGUCAAUAGCCUGAUGGUG GCCUCCCUCACCUACAAGGAUAAGGUGUACCUCAACGUGACC ACCGAUAACACCUCCCUGGACGACUUUCAUGUGAACGGUGGC GAGCUCAUACUCAUCCACCAGAACCCCGGCGAAUUCUGCGUC CUG | 1205 (549 nts) |

In some embodiments, the mRNA useful for the methods and compositions comprises an open reading frame encoding an extracellular domain of OX40L. In other embodiments, the mRNA comprises an open reading frame encoding a cytoplasmic domain of OX40L. In some embodiments, the mRNA comprises an open reading frame encoding a transmembrane domain of OX40L. In certain embodiments, the mRNA comprises an open reading frame encoding an extracellular domain of OX40L and a transmembrane of OX40L. In other embodiments, the mRNA comprises an open reading frame encoding an extracellular domain of OX40L and a cytoplasmic domain of OX40L. In yet other embodiments, the mRNA comprises an open reading frame encoding an extracellular domain of OX40L, a transmembrane of OX40L, and a cytoplasmic domain of OX40L.

In some embodiments, the mRNA comprises a codon optimized sequence encoding an OX40L polypeptide, e.g., a codon optimized sequence from TABLE 17 (e.g., selected from SEQ ID NOs: 1165-1205).

In some embodiments, the OX40L polynucleotides comprise an mRNA encoding an OX40L polypeptide which is full length. In some embodiments, the OX40L polynucleotide comprises an mRNA encoding a human OX40L polypeptide which is 183 amino acids in length. In certain embodiments, the OX40L polypeptide can lack at least one, at least two, at least three, at least four, at least five, at least six, at least seven, at least eight, at least nine, at least 10, at least 14, or at least 15 amino acids at the N-terminus or C-terminus of the OX40L polypeptide.

In some embodiments, the OX40L polynucleotide (e.g., mRNA) of the present disclosure is structurally modified or chemically modified. As used herein, a "structural" modification is one in which two or more linked nucleosides are inserted, deleted, duplicated, inverted or randomized in a polynucleotide without significant chemical modification to the mRNA themselves. Because chemical bonds will necessarily be broken and reformed to effect a structural modification, structural modifications are of a chemical nature and hence are chemical modifications. However, structural modifications will result in a different sequence of nucleotides. For example, the mRNA "AUCG" can be chemically modified to "AU-5meC-G". The same mRNA can be structurally modified from "AUCG" to "AUCCCG". Here, the dinucleotide "CC" has been inserted, resulting in a structural modification to the polynucleotide.

In some embodiments, the OX40L polynucleotide (e.g., mRNA) of the present disclosure can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the OX40L polynucleotide (e.g., mRNA) encoding an OX40L polypeptide can have a uniform chemical modification of two, three, or four of the same nucleoside type throughout the entire polynucleotide (e.g., mRNA) (such as all uridines and all cytosines, etc. are modified in the same way).

When the OX40L polynucleotide (e.g., mRNA) encoding an OX40L polypeptide is chemically and/or structurally modified the mRNA can be referred to as "modified mRNA." Non-limiting examples of chemical modifications are described elsewhere herein.

Sequence-Optimized Nucleotide Sequences Encoding OX40L Polypeptides:

In some embodiments, the OX40L polynucleotide comprises a sequence-optimized nucleotide sequence encoding an OX40L polypeptide disclosed herein. In some embodiments, the OX40L polynucleotide comprises an open reading frame (ORF) encoding an OX40L polypeptide, wherein the ORF has been sequence optimized.

Exemplary sequence-optimized OX40L polynucleotide sequences encoding OX40L are shown in TABLE 17. In some embodiments, the sequence optimized OX40L sequences in TABLE 17, fragments, and variants thereof are used to practice the methods disclosed herein. In some embodiments, the sequence optimized OX40L sequences in TABLE 17, fragments and variants thereof are combined with or alternatives to the wild-type sequences disclosed in TABLE 17.

The sequence-optimized OX40L polynucleotide sequences disclosed herein are distinct from the corresponding wild type nucleotide acid sequences and from other known sequence-optimized nucleotide sequences, e.g., these sequence-optimized nucleic acids have unique compositional characteristics.

In some embodiments, the percentage of uracil or thymine nucleobases in a sequence-optimized OX40 polynucleotide sequence (e.g., encoding an OX40L polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence.

In some embodiments, the sequence-optimized nucleotide sequence has a lower uracil or thymine content than the uracil or thymine content in the reference wild-type sequence. In some embodiments, the uracil or thymine content in a sequence-optimized OX40L polynucleotide sequence of the disclosure is greater than the uracil or thymine content in the reference wild-type sequence and still maintain beneficial effects, e.g., increased expression and/or OX40L signaling response when compared to the reference wild-type sequence.

In some embodiments, the optimized sequences of the present disclosure contain unique ranges of uracils or thymine (if DNA) in the sequence. The uracil or thymine content of the optimized sequences can be expressed in various ways, e.g., uracil or thymine content of optimized sequences relative to the theoretical minimum (% $U_{TM}$ or % $T_{TM}$), relative to the wild-type (% $U_{WT}$ or % $T_{WT}$), and relative to the total nucleotide content (% $U_{TL}$ or % $T_{TL}$). For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $T_{TM}$, % $T_{WT}$, or % $T_{TL}$ with respect to DNA.

In some embodiments, the % $U_{TM}$ of a uracil-modified sequence encoding an OX40L polypeptide of the disclosure is below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, below 117%, below 116%, below 115%, below 114%, below 113%, below 112%, below 111%, below 110%, below 109%, below 108%, below 107%, below 106%, below 105%, below 104%, or below 103%.

In some embodiments, the % $U_{TM}$ of a uracil-modified sequence encoding an OX40L polypeptide of the disclosure is below 170% and above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, above 126%, above 127%, above 128%, above 129%, or above 130%, above 135%, above 130%, above 131%, above 132%, above 133%, above 134%, above 135%, above 136%, above 137%, above 138%, above 139%, above 140%, above 141%, above 142%, above 143%, above 144%, above 145%, above 146%, above 147%, above 148%, above 149%, or above 150%.

In some embodiments, the % $U_{TM}$ of a uracil-modified sequence encoding an OX40L polypeptide of the disclosure is between 100% and 150%, between 105% and 150%, between 110% and 150%, between 115% and 150%, between 120% and 150%, between 125% and 150%, between 130% and 150%, between 135% and 150%, between 136% and 150%, between 137% and 150%, between 138% and 150%, between 139% and 150%, between 140% and 150%, between 110% and 151%, between 110% and 152%, between 110% and 153%, between 110% and 154%, between 110% and 155%, between 110% and 156%, between 110% and 157%, between 110% and 158%, between 110% and 159%, between 110% and 160%, between 110% and 130%, between 111% and 131%, between 112% and 132%, between 113% and 133%, between 114% and 134%, between 115% and 135%, between 116% and 136%, between 117% and 137%, between 118% and 138%, between 119% and 139%, or between 120% and 140%.

In some embodiments, the % $U_{TM}$ of a uracil-modified sequence encoding an OX40L polypeptide of the disclosure is between about 118% and about 138%, e.g., between 118.29% and 137.8%.

A uracil- or thymine-modified sequence encoding an OX40L polypeptide of the disclosure can also be described according to its uracil or thymine content relative to the uracil or thymine content in the corresponding wild-type nucleic acid sequence (% $U_{WT}$ or % $T_{WT}$).

In some embodiments, the % $U_{WT}$ or % $T_{WT}$ of a uracil- or thymine-modified sequence encoding an OX40L polypeptide of the disclosure is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding an OX40L polypeptide of the disclosure is between 60% and 90%, between 61% and 89%, between 62% and 88%, between 63% and 87%, between 64% and 86%, between 65% and 85%, between 66% and 84%, between 67% and 83%, or between 68% and 82%.

In some embodiments, the % $U_{WT}$ or % $T_{WT}$ of a uracil- or thymine-modified sequence encoding an OX40L polypeptide of the disclosure is between 67% and 82%, between 67% and 82%, between 68% and 81%, between 68% and 81%, or between 69% and 80%.

In a particular embodiment, the % $U_{WT}$ or % $T_{WT}$ of a uracil- or thymine-modified sequence encoding an OX40L polypeptide of the disclosure is between about 68% and about 80%, e.g., between 68% and 80%.

The uracil or thymine content of wild-type OX40L relative to the total nucleotide content (%) is about 26%. In some embodiments, the uracil or thymine content of a uracil- or thymine-modified sequence encoding an OX40L polypeptide relative to the total nucleotide content (%) (% $U_{TL}$ or % $T_{TL}$) is less than 26%. In some embodiments, the % $U_{TL}$ or % $T_{TL}$ is less than 26%, less than 25%, less that 24%, less than 23%, less than 22%, less than 21%, less than 20%, less than 19%, less than 18%, less than 17%, less than 16%, less than 15%, less than 14%, less than 13%, less than 12%, less than 11%, or less than 10%. In some embodiments, the % $U_{TL}$ or % T, is not less than 10%, 9%, 8%, 7%, 6%, 5%, 4%, 3%, 2%, or 1%.

In some embodiments, the uracil or thymine content of a uracil- or thymine-modified sequence encoding an OX40L polypeptide of the disclosure relative to the total nucleotide content (% $U_{TL}$ or % $T_{TL}$) is between 15% and 22%, between 16% and 22%, between 17% and 22%, between 17% and 21%, or between 18% and 21%.

In some embodiments, the uracil or thymine content of a uracil- or thymine-modified sequence encoding an OX40L polypeptide of the disclosure relative to the total nucleotide content (% $U_{TL}$ or % $T_{TL}$) is between 10% and 25%, between 11% and 25%, between 12% and 25%, between 13% and 25%, between 14% and 25%, between 15% and 25%, between 16% and 25%, between 17% and 25%, between 10% and 24%, between 10% and 23%, between 11% and 22%, between 11% and 21%, between 11% and 20%, between 11% and 19%, between 11% and 18%, between 12% and 24%, between 12% and 23%, between 13% and 22%, between 14% and 21%, between 13% and 20%, between 15% and 19%, between 15% and 20%, between 16% and 19%, between 16% and 18%, or between 13% and 17%.

In a particular embodiment, the uracil or thymine content (% $U_{TL}$ or % $T_{TL}$) of a uracil- or thymine modified sequence encoding an OX40L polypeptide of the disclosure is between about 18% and about 21%. In some embodiments, a uracil-modified sequence encoding an OX40L polypeptide of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide.

In some embodiments, a uracil-modified sequence encoding an OX40L polypeptide of the disclosure has a reduced number of uracil triplets (UUU) with respect to the wild-type nucleic acid sequence. In some embodiments, a uracil-modified sequence encoding an OX40L polypeptide of the disclosure contains 4, 3, 2, 1 or no uracil triplets (UUU).

In some embodiments, a uracil-modified sequence encoding an OX40L polypeptide has a reduced number of uracil pairs (UU) with respect to the number of uracil pairs (UU) in the wild-type nucleic acid sequence. In some embodiments, a uracil-modified sequence encoding an OX40L polypeptide of the disclosure has a number of uracil pairs (UU) corresponding to the minimum possible number of uracil pairs (UU) in the wild-type nucleic acid sequence.

In some embodiments, a uracil-modified sequence encoding an OX40L polypeptide of the disclosure has at least 1, 2, 3, 4, 5, 6, 7, 8, 9, 10, 11, 12, 13, 14, 15, 16, 17, 18, 19, 20, 21, 22, or 23 uracil pairs (UU) less than the number of uracil pairs (UU) in the wild-type nucleic acid sequence. In some embodiments, a uracil-modified sequence encoding an OX40L polypeptide of the disclosure has between 7 and 13, between 8 and 14, between 9 and 15, between 10 and 16, between 11 and 7, between 12 and 18 uracil pairs (UU).

In some embodiments, a uracil-modified sequence encoding an OX40L polypeptide of the disclosure has at least 1, 2, 3, 4, 5, 6, 7, 8, 9, 10, 11, 12, 13, 14, 15, 16, 17, 18, 19, or 20 uracil pairs (UU) less than the number of uracil pairs (UU) in the wild-type nucleic acid sequence. In some embodiments, a uracil-modified sequence encoding an IL12A polypeptide of the disclosure has between 7 and 13, between 8 and 14, between 9 and 15, between 10 and 16, between 11 and 7, between 12 and 18 uracil pairs (UU).

In some embodiments, a uracil-modified sequence encoding an OX40L polypeptide of the disclosure has a % $UU_{wt}$ less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding an OX40L polypeptide has a % $UU_{wt}$ between 23% and 87%. In a particular embodiment, a uracil-modified sequence encoding an OX40L polypeptide of the disclosure has a % $UU_{wt}$ between 25% and 85%.

In some embodiments, the OX40L polynucleotide of the disclosure comprises a uracil-modified sequence encoding an OX40L polypeptide disclosed herein. In some embodiments, the uracil-modified sequence encoding an OX40L polypeptide comprises at least one chemically modified nucleobase, e.g., 5-methoxyuracil. In some embodiments, at least 95% of a nucleobase (e.g., uracil) in a uracil-modified sequence encoding an OX40L polypeptide of the disclosure are modified nucleobases. In some embodiments, at least 95% of uracil in a uracil-modified sequence encoding an OX40L polypeptide is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

In some embodiments, the "guanine content of the sequence optimized ORF encoding OX40L with respect to the theoretical maximum guanine content of a nucleotide sequence encoding the OX40L polypeptide," abbreviated as % $G_{TMX}$ is at least 67%, at least 68%, at least 69%, at least 70%, at least 75%, at least about 80%, at least about 85%, at least about 90%, at least about 95%, or about 100%. In some embodiments, the % $G_{TMX}$ is between about 68% and about 80%, between about 69% and about 79%, between about 70% and about 78%, or between about 71% and about 77%.

In some embodiments, the "cytosine content of the ORF relative to the theoretical maximum cytosine content of a nucleotide sequence encoding the OX40L polypeptide," abbreviated as % $C_{TMX}$, is at least 59%, at least 60%, at least about 65%, at least about 70%, at least about 75%, at least about 80%, at least about 85%, at least about 90%, at least about 95%, or about 100%. In some embodiments, the % $C_{TMX}$ is between about 64% and about 82%, between about 65% and about 81%, between about 66% and about 80%, or between about 67% and about 79%.

In some embodiments, the "guanine and cytosine content (G/C) of the ORF relative to the theoretical maximum G/C content in a nucleotide sequence encoding the OX40L polypeptide," abbreviated as % $G/C_{TMX}$ is at least about 81%, at least about 85%, at least about 90%, at least about 95%, or about 100%. In some embodiments, the % $G/C_{TMX}$ is between about 86% and about 98%, between about 87% and about 97%, between about 88% and about 96%, or between about 89% and about 95%.

In some embodiments, the "G/C content in the ORF relative to the G/C content in the corresponding wild-type ORF," abbreviated as % $G/C_{WT}$ is at least 102%, at least 103%, at least 104%, at least 105%, at least 106%, at least 107%, at least 110%, at least 115%, at least 120%, at least 125%, or at least 130%.

In some embodiments, the average G/C content in the 3rd codon position in the ORF is at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, or at least 35% higher than the average G/C content in the 3rd codon position in the corresponding wild-type ORF.

In some embodiments, the OX40L polynucleotide of the disclosure comprises an open reading frame (ORF) encoding an OX40L polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

In some embodiments, an OX40L polynucleotide of the disclosure (e.g., a polynucleotide comprising a nucleotide sequence encoding an OX40L polypeptide (e.g., the wild-type sequence, functional fragment, or variant thereof) is sequence optimized.

In some embodiments, the uridine content (average global uridine content) (absolute or relative) of the uridine-modified OX40L sequence is higher than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% more uridine that the reference nucleic acid sequence.

In other embodiments, the uridine content (average global uridine content) (absolute or relative) of the uridine-modified OX40L sequence is lower than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% less uridine that the reference nucleic acid sequence.

In some embodiments, the uridine content (average global uridine content) (absolute or relative) of the uridine-modified OX40L sequence is less than 50%, 49%, 48%, 47%, 46%, 45%, 44%, 43%, 42%, 41%, 40%, 39%, 38%37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2% or 1% of the total nucleobases in the uridine-modified sequence. In some embodiments, the uridine content of the uridine-modified sequence is between about 10% and about 20%. In some particular embodiments, the uridine content of the uridine-modified sequence is between about 12% and about 16%.

In some embodiments, the uridine content in the sequence optimized sequence can be expressed with respect to the theoretical minimum uridine content in the sequence. The term "theoretical minimum uridine content" is defined as the uridine content of a nucleic acid sequence as a percentage of the sequence's length after all the codons in the sequence have been replaced with synonymous codon with the lowest uridine content.

In some embodiments, the uridine content of the sequence optimized OX40L nucleic acid is identical to the theoretical minimum uridine content of the reference sequence (e.g., a wild type sequence). In some aspects, the uridine content of the sequence optimized OX40L nucleic acid is about 90%, about 95%, about 100%, about 105%, about 110%, about 115%, about 120%, about 125%, about 130%, about 135%, about 140% about 145%, about 150%, about 155%, about 160%, about 165%, about 170%, about 175%, about 180%, about 185%, about 190%, about 195% or about 200% of the theoretical minimum uridine content of the reference sequence (e.g., a wild type sequence).

In some embodiments, the uridine content of the sequence optimized OX40L nucleic acid is identical to the theoretical minimum uridine content of the reference sequence (e.g., a wild type sequence).

In some embodiments, the sequence optimized nucleic acid encoding an OX40L polypeptide comprises an overall increase in G/C content (absolute or relative) relative to the G/C content (absolute or relative) of the reference nucleic acid sequence. In some embodiments, the overall increase in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding an OX40L polypeptide comprises an overall decrease in G/C content (absolute or relative) relative to the G/C content of the reference nucleic acid sequence. In some embodiments, the overall decrease in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding an OX40L polypeptide comprises a local increase in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local increase in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

In some embodiments, the sequence optimized nucleic acid encoding an OX40L polypeptide comprises a local decrease in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local decrease in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

Modified Nucleotide Sequences Encoding OX40L Polypeptides:

In some embodiments, the OX40L polynucleotide (e.g., a RNA, e.g., an mRNA) of the disclosure comprises a chemically modified nucleobase, e.g., 5-methoxyuracil. In some embodiments, the mRNA is a uracil-modified sequence comprising an ORF encoding an OX40L polypeptide, wherein the mRNA comprises a chemically modified nucleobase, e.g., 5-methoxyuracil.

In certain aspects of the disclosure, when the 5-methoxyuracil base is connected to a ribose sugar, as it is in polynucleotides, the resulting modified nucleoside or nucleotide is referred to as 5-methoxyuridine. In some embodiments, uracil in the OX40L polynucleotide is at least about 25%, at least about 30%, at least about 40%, at least about 50%, at least about 60%, at least about 70%, at least about 80%, at least 90%, at least 95%, at least 99%, or about 100% 5-methoxyuracil. In one embodiment, uracil in the OX40L polynucleotide is at least 95% 5-methoxyuracil. In another embodiment, uracil in the polynucleotide is 100% 5-methoxyuracil.

In embodiments where uracil in the OX40L polynucleotide is at least 95% 5-methoxyuracil, overall uracil content can be adjusted such that an mRNA provides suitable protein expression levels while inducing little to no immune response. In some embodiments, the uracil content of the ORF (% $U_{TM}$) is between about 105% and about 145%, about 105% and about 140%, about 110% and about 140%, about 110% and about 145%, about 115% and about 135%, about 105% and about 135%, about 110% and about 135%, about 115% and about 145%, or about 115% and about 140%. In other embodiments, the uracil content of the ORF is between about 117% and about 134% or between 118% and 132% of the % $U_{TM}$. In some embodiments, the % $U_{TM}$ is about 115%, about 120%, about 125%, about 130%, about 135%, about 140%, about 145%, or about 150%. In this context, the term "uracil" can refer to 5-methoxyuracil and/or naturally occurring uracil.

In some embodiments, the uracil content in the ORF of the mRNA encoding an OX40L polypeptide of the disclosure is less than about 50%, about 40%, about 30%, or about 20% of the total nucleobase content in the ORF. In some embodiments, the uracil content in the ORF is between about 15% and about 25% of the total nucleobase content in the ORF. In other embodiments, the uracil content in the ORF is between about 20% and about 30% of the total nucleobase content in the ORF. In one embodiment, the uracil content in the ORF of the mRNA encoding an OX40L polypeptide is less than about 20% of the total nucleobase content in the open reading frame. In this context, the term "uracil" can refer to 5-methoxyuracil and/or naturally occurring uracil.

In further embodiments, the ORF of the mRNA encoding an OX40L polypeptide having 5-methoxyuracil and adjusted uracil content has increased Cytosine (C), Guanine (G), or Guanine/Cytosine (G/C) content (absolute or relative). In some embodiments, the overall increase in C, G, or G/C content (absolute or relative) of the ORF is at least about 2%, at least about 3%, at least about 4%, at least about 5%, at least about 6%, at least about 7%, at least about 10%, at least about 15%, at least about 20%, at least about 40%, at least about 50%, at least about 60%, at least about 70%, at least about 80%, at least about 90%, at least about 95%, or at least about 100% relative to the G/C content (absolute or relative) of the wild-type ORF.

In some embodiments, the G, the C, or the G/C content in the ORF is less than about 100%, less than about 90%, less than about 85%, or less than about 80% of the theoretical maximum G, C, or G/C content of the corresponding wild type nucleotide sequence encoding the OX40L polypeptide (% $G_{TMX}$; % $C_{TMX}$, or % $G/C_{TMX}$). In other embodiments, the G, the C, or the G/C content in the ORF is between about 70% and about 80%, between about 71% and about 79%, between about 71% and about 78%, or between about 71% and about 77% of the % $G_{TMX}$, % $C_{TMX}$, or % $G/C_{TMX}$.

In some embodiments, the increases in G and/or C content (absolute or relative) described herein can be conducted by replacing synonymous codons with low G, C, or G/C content with synonymous codons having higher G, C, or G/C content. In other embodiments, the increase in G and/or C content (absolute or relative) is conducted by replacing a codon ending with U with a synonymous codon ending with G or C.

In further embodiments, the ORF of the mRNA encoding an OX40L polypeptide of the disclosure comprises 5-methoxyuracil and has an adjusted uracil content containing less uracil pairs (UU) and/or uracil triplets (UUU) and/or uracil quadruplets (UUUU) than the corresponding wild-type nucleotide sequence encoding the OX40L polypeptide. In some embodiments, the ORF of the mRNA encoding an OX40L polypeptide of the disclosure contains no uracil pairs and/or uracil triplets and/or uracil quadruplets. In some embodiments, uracil pairs and/or uracil triplets and/or uracil quadruplets are reduced below a certain threshold, e.g., no more than 1, 2, 3, 4, 5, 6, 7, 8, 9, 10, 11, 12, 13, 14, 15, 16, 17, 18, 19, or 20 occurrences in the ORF of the mRNA encoding the OX40L polypeptide. In a particular embodiment, the ORF of the mRNA encoding the OX40L polypeptide of the disclosure contains less than 20, 19, 18, 17, 16, 15, 14, 13, 12, 11, 10, 9, 8, 7, 6, 5, 4, 3, 2, or 1 non-phenylalanine uracil pairs and/or triplets. In another embodiment, the ORF of the mRNA encoding the OX40L polypeptide contains no non-phenylalanine uracil pairs and/or triplets.

In further embodiments, the ORF of the mRNA encoding an OX40L polypeptide of the disclosure comprises 5-methoxyuracil and has an adjusted uracil content containing less uracil-rich clusters than the corresponding wild-type nucleotide sequence encoding the OX40L polypeptide. In some embodiments, the ORF of the mRNA encoding the OX40L polypeptide of the disclosure contains uracil-rich clusters that are shorter in length than corresponding uracil-rich clusters in the corresponding wild-type nucleotide sequence encoding the OX40L polypeptide.

In further embodiments, alternative lower frequency codons are employed. At least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the OX40L polypeptide-encoding ORF of the 5-methoxyuracil-comprising mRNA are substituted with alternative codons, each alternative codon having a codon frequency lower than the codon frequency of the substituted codon in the synonymous codon set. The ORF also has adjusted uracil content, as described above. In some embodiments, at least one codon in the ORF of the mRNA encoding the OX40L polypeptide is substituted with an alternative codon having a codon frequency lower than the codon frequency of the substituted codon in the synonymous codon set.

In some embodiments, the adjusted uracil content, OX40L polypeptide-encoding ORF of the 5-methoxyuracil-comprising mRNA exhibits expression levels of OX40L when administered to a mammalian cell that are higher than expression levels of OX40L from the corresponding wild-type mRNA. In other embodiments, the expression levels of OX40L when administered to a mammalian cell are increased relative to a corresponding mRNA containing at least 95% 5-methoxyuracil and having a uracil content of about 160%, about 170%, about 180%, about 190%, or about 200% of the theoretical minimum.

In yet other embodiments, the expression levels of OX40L when administered to a mammalian cell are increased relative to a corresponding mRNA, wherein at least about 50%, at least about 60%, at least about 70%, at least about 80%, at least about 90%, or about 100% of uracils are 1-methylpseudouracil or pseudouracils. In some embodiments, the mammalian cell is a mouse cell, a rat cell, or a rabbit cell. In other embodiments, the mammalian cell is a monkey cell or a human cell. In some embodiments, the human cell is a HeLa cell, a BJ fibroblast cell, or a peripheral blood mononuclear cell (PBMC). In some embodiments, OX40L is expressed when the mRNA is administered to a mammalian cell in vivo. In some embodiments, the mRNA is administered to mice, rabbits, rats, monkeys, or humans. In one embodiment, mice are null mice. In some embodiments, the mRNA is administered to mice in an amount of about 0.01 mg/kg, about 0.05 mg/kg, about 0.1 mg/kg, or about 0.15 mg/kg. In some embodiments, the mRNA is administered intravenously or intramuscularly. In other embodiments, the OX40L polypeptide is expressed when the mRNA is administered to a mammalian cell in vitro. In some embodiments, the expression is increased by at least about 2-fold, at least about 5-fold, at least about 10-fold, at least about 50-fold, at least about 500-fold, at least about 1500-fold, or at least about 3000-fold. In other embodiments, the expression is increased by at least about 10%, about 20%, about 30%, about 40%, about 50%, 60%, about 70%, about 80%, about 90%, or about 100%.

In some embodiments, adjusted uracil content, OX40L polypeptide-encoding ORF of the 5-methoxyuracil-comprising mRNA exhibits increased stability. In some embodiments, the mRNA exhibits increased stability in a cell relative to the stability of a corresponding wild-type mRNA under the same conditions. In some embodiments, the mRNA exhibits increased stability including resistance to nucleases, thermal stability, and/or increased stabilization of secondary structure. In some embodiments, increased stability exhibited by the mRNA is measured by determining the half-life of the mRNA (e.g., in a plasma, cell, or tissue sample) and/or determining the area under the curve (AUC) of the protein expression by the mRNA over time (e.g., in vitro or in vivo). An mRNA is identified as having increased stability if the half-life and/or the AUC is greater than the half-life and/or the AUC of a corresponding wild-type mRNA under the same conditions.

In some embodiments, the mRNA of the present disclosure induces a detectably lower immune response (e.g., innate or acquired) relative to the immune response induced by a corresponding wild-type mRNA under the same conditions. In other embodiments, the mRNA of the present disclosure induces a detectably lower immune response (e.g., innate or acquired) relative to the immune response induced by an mRNA that encodes for an OX40L polypeptide but does not comprise 5-methoxyuracil under the same conditions, or relative to the immune response induced by an mRNA that encodes for an OX40L polypeptide and that comprises 5-methoxyuracil but that does not have adjusted uracil content under the same conditions. The innate immune response can be manifested by increased expression of pro-inflammatory cytokines, activation of intracellular PRRs (RIG-I, MDA5, etc), cell death, and/or termination or reduction in protein translation. In some embodiments, a reduction in the innate immune response can be measured by expression or activity level of Type 1 interferons (e.g., IFN-α, IFN-β, IFN-κ, IFN-δ, IFN-ε, IFN-τ, IFN-ω, and IFN-ζ) or the expression of interferon-regulated genes such as the toll-like receptors (e.g., TLR7 and TLR8), and/or by decreased cell death following one or more administrations of the mRNA of the disclosure into a cell.

In some embodiments, the expression of Type-1 interferons by a mammalian cell in response to the mRNA of the present disclosure is reduced by at least 10%, 20%, 30%, 40%, 50%, 60%, 70%, 80%, 90%, 95%, 99%, 99.9%, or greater than 99.9% relative to a corresponding wild-type mRNA, to an mRNA that encodes an OX40L polypeptide but does not comprise 5-methoxyuracil, or to an mRNA that encodes an OX40L polypeptide and that comprises 5-methoxyuracil but that does not have adjusted uracil content. In some embodiments, the interferon is IFN-β. In some embodiments, cell death frequency cased by administration of mRNA of the present disclosure to a mammalian cell is 10%, 25%, 50%, 75%, 85%, 90%, 95%, or over 95% less than the cell death frequency observed with a corresponding wild-type mRNA, an mRNA that encodes for an OX40L polypeptide but does not comprise 5-methoxyuracil, or an mRNA that encodes for an OX40L polypeptide and that comprises 5-methoxyuracil but that does not have adjusted uracil content. In some embodiments, the mammalian cell is a BJ fibroblast cell. In other embodiments, the mammalian cell is a splenocyte. In some embodiments, the mammalian cell is that of a mouse or a rat. In other embodiments, the mammalian cell is that of a human. In one embodiment, the mRNA of the present disclosure does not substantially induce an innate immune response of a mammalian cell into which the mRNA is introduced.

In some embodiments, the polynucleotide is an mRNA that comprises an ORF that encodes an OX40L polypeptide, wherein uracil in the mRNA is at least about 95% 5-methoxyuracil, wherein the uracil content of the ORF is between about 115% and about 135% of the theoretical minimum uracil content in the corresponding wild-type ORF, and wherein the uracil content in the ORF encoding the OX40L polypeptide is less than about 30% of the total nucleobase content in the ORF. In some embodiments, the ORF that encodes the OX40L polypeptide is further modified to increase G/C content of the ORF (absolute or relative) by at least about 40%, as compared to the corresponding wild-type ORF. In yet other embodiments, the ORF encoding the OX40L polypeptide contains less than 20 non-phenylalanine uracil pairs and/or triplets.

In some embodiments, at least one codon in the ORF of the mRNA encoding the OX40L polypeptide is further substituted with an alternative codon having a codon frequency lower than the codon frequency of the substituted codon in the synonymous codon set. In some embodiments, the expression of the OX40L polypeptide encoded by an mRNA comprising an ORF wherein uracil in the mRNA is at least about 95% 5-methoxyuracil, and wherein the uracil content of the ORF is between about 115% and about 135% of the theoretical minimum uracil content in the corresponding wild-type ORF, is increased by at least about 10-fold when compared to expression of the OX40L polypeptide from the corresponding wild-type mRNA. In some embodiments, the mRNA comprises an open ORF wherein uracil in the mRNA is at least about 95% 5-methoxyuracil, and wherein the uracil content of the ORF is between about 115% and about 135% of the theoretical minimum uracil content in the corresponding wild-type ORF, and wherein the mRNA does not substantially induce an innate immune response of a mammalian cell into which the mRNA is introduced.

Polynucleotides Comprising mRNA Encoding an OX40L Polypeptide:

In certain embodiments, the OX40L polynucleotide comprising an mRNA encoding an OX40L polypeptide of the present disclosure comprises (i) 5' UTR, such as the sequences provided below, comprising a 5' cap provided below;

(ii) an ORF encoding an OX40L polypeptide, such as the sequences provided in TABLE 17 above, (iii) a stop codon, (iv) a 3' UTR, such as the sequences provided below, and (v) a poly-A tail provided above.

In some embodiments the OX40L polynucleotide comprises an miRNA binding, e.g., an miR122 binding site. In other embodiments, the miR122 binding site is included in the 3' UTR.

In some embodiments, the OX40L polynucleotide of the disclosure comprises at least about 60%, at least about 70%, at least about 80%, at least about 90%, at least about 95%, at least about 96%, at least about 97%, at least about 98%, at least about 99% or about 100% identical to the polynucleotide sequence set forth as SEQ ID NO: 1206 in TABLE 18, wherein the protein encoded by the polynucleotide is capable of binding to the wild-type OX40 receptor.

In a particular embodiment, the OX40L polynucleotide of the present disclosure comprises a sequence set forth in TABLE 18 below (SEQ ID NO: 1206).

Additional OX40L polynucleotides comprising an mRNA, a miR-122 binding site, a 5' UTR, and a 3' UTR are shown below in TABLE 18.

TABLE 18

Additional OX40L polynucleotides comprising an mRNA and a miR-122 binding S site, and mRNA control sequences

| SEQ ID NO. | Description | Sequence |
|---|---|---|
| 1206 | mRNA sequence: Human OX40L with 5'-UTR, 3'-UTR, and miR-122 biding site | GGGAAAUAAGAGAGAAAAGAAGAGUAAGAAGAAAUAUAAGAGCCAC CAUGGAAAGGGUCCAACCCCUGGAAGAGAAUGUGGGAAAUGCAGCC AGGCCAAGAUUCGAGAGGAACAAGCUAUUGCUGGUGGCCUCUGUAA UUCAGGGACUGGGGCUGCUCCUGUGCUUCACCUACAUCUGCCUGCA CUUCUCUGCUCUUCAGGUAUCACAUCGGUAUCCUCGAAUUCAAAGU AUCAAAGUACAAUUUACCGAAUAUAAGAAGGAGAAAGGUUUCAUCC UCACUUCCCAAAAGGAGGAUGAAAUCAUGAAGGUGCAGAACAACUC AGUCAUCAUCAACUGUGAUGGGUUUUAUCUCAUCUCCCUGAAGGGC UACUUCUCCCAGGAAGUCAACAUUAGCCUUCAUUACCAGAAGGAUG AGGAGCCCCUCUUCCAACUGAAGAAGGUCAGGUCUGUCAACUCCUU GAUGGUGGCCUCUCUGACUUACAAAGACAAAGUCUACUUGAAUGUG ACCACUGACAAUACCUCCCUGGAUGACUUCCAUGUGAAUGGCGGAG AACUGAUUCUUAUCCAUCAAAAUCCUGGUGAAUUCUGUGUCCUUUG AUAAUAGGCUGGAGCCUCGGUGGCCAUGCUUCUUGCCCCUUGGGCC UCCCCCCAGCCCCUCCUCCCCUUCCUGCACCCGUACCCCCCAAACA CCAUUGUCACACUCCAGUGGUCUUUGAAUAAAGUCUGAGUGGGCGG C |
| 1207 | mRNA sequence: murine OX40L with 5'-UTR, 3'-UTR, and miR-122 binding site | GGGAAAUAAGAGAGAAAAGAAGAGUAAGAAGAAAUAUAAGAGCCAC CAUGGAAGGGGAAGGGGUUCAACCCCUGGAUGAGAAUCUGGAAAAC GGAUCAAGGCCAAGAUUCAAGUGGAAGAAGACGCUAAGGCUGGUGG UCUCUGGGAUCAAGGGAGCAGGGAUGCUUCUGUGCUUCAUCUAUGU CUGCCUGCAACUCUCUUCCUCUCCGGCAAAGGACCCUCCAAUCCAA AGACUCAGAGGAGCAGUUACCAGAUGUGAGGAUGGGCAACUAUUCA UCAGCUCAUACAAGAAUGAGUAUCAAACUAUGGAGGUGCAGAACAA UUCGGUUGUCAUCAAGUGCGAUGGGCUUUAUAUCAUCUACCUGAAG GGCUCCUUUUUCCAGGAGGUCAAGAUUGACCUUCAUUUCCGGGAGG AUCAUAAUCCCAUCUCUAUUCCAAUGCUGAACGAUGGUCGAAGGAU UGUCUUCACUGUGGUGGCCUCUUUGGCUUUCAAAGAUAAAGUUUAC |

TABLE 18-continued

Additional OX40L polynucleotides comprising an mRNA and a miR-122 binding S site, and mRNA control sequences

| SEQ ID NO. | Description | Sequence |
|---|---|---|
| | | CUGACUGUAAAUGCUCCUGAUACUCUCUGCGAACACCUCCAGAUAA<br>AUGAUGGGGAGCUGAUUGUUGUCCAGCUAACGCCUGGAUACUGUGC<br>UCCUGAAGGAUCUUACCACAGCACUGUGAACCAAGUACCACUGUGA<br>UAAUAGGCUGGAGCCUCGGUGGCCAUGCUUCUUGCCCCUUGGGCCU<br>CCCCCCAGCCCCUCCUCCCCUUCCUGCACCCGUACCCCCCAAACAC<br>CAUUGUCACACUCCAGUGGUCUUUGAAUAAAGUCUGAGUGGGCGGC |
| 1208 | mRNA sequence: non-translatable FIX with 5'-UTR, 3'UTR and miR-122 binding site (NST-FIX) | GGGAAAUAAGAGAGAAAAGAAGAGUAAGAAGAAAUAUAAGACAGCG<br>CGUCAACAUUGCCGAAUCGCCGGGACUCAUCACAAUCUGCCUCUUG<br>GGUUAUCUCUUGUCGGCAGAUACCUUCUUGGAUCACGAAAACGCGA<br>ACAAAAUUCUUAAUCGCCCGAAGCGGUAUAACUCCGGGAAACUUGA<br>GGAGUUUCAGGGCAAUCUUGAACGAGACGAGGAGAACUCCUUUGAG<br>GAGGCGAGGGAAUUUGAAAACACAGAGCGAACAACGGAGUUUUGGA<br>AGCAAUACGUAGGGGACCAGUCGAAUCCCCUCAGGGGAUCUAAAGA<br>CAUCAAUAGCUACUGCCCGUUUGGGUUUGAAGGGAAGAACUAGCUG<br>ACCAACAUCAAAAACGGACGCUAGCAGUUUUGUAAGAACUCGGCUG<br>ACAAUAAGGUAGUCUCCACAGAGGGAUACCGGCUGGCGGAGAACCA<br>AAAAUCCGAGCCCGCAGUCCCGUUCCCUUGGAGGAGCUCACAGACU<br>AGCAAGUUGACGAGAGCGGAGACUGUAUUCCCCGACGACUACGUCA<br>ACAGCACCGAAGCCGAAACAAUCCUCGAUAACAUCACGCAGAGCAC<br>UCAGUCCUUCAACUUUACGAGGGUCGUAGAGGACGCGAAACCCGGU<br>CAGUUCCCCUGGCAGGUAUUGAACGGAAAAGUCGCCUUUUGAGGUU<br>CCAUUGUCAACGAGAAGAUUGUCACAGCGGCACACUGCGUAGAAAC<br>AGGAAAAAUCACGGUAGCGGGAGAGCAUAACAUUGAAGAGACAGAG<br>CACACGGAACAAAAGCGAAUCAUCAGAAUCAUUCCACACCAUAACU<br>AUAACGCGGCAAUCAAUAAGUACAAUCACGACAUCGCACUUUUGGA<br>GCUUGACGAACCUUUGCUUAAUUCGUACGUCACCCCUAUUUGUAUU<br>GCCGACAAAGAGUAUACAAACAUCUUCUUGAAAUUCGGCUCCGGGU<br>ACGUAUCGGGCUGGGGCAGAUUCCAUAAGGGUAGAUCCGCACUGUU<br>GCAAUACCUCAGGCCCCUCGAUCGAGCCACUUGUCUGCGGUCCACC<br>AAAUUCACAAUCUACAACAAUUUCUCGGGAUUCCAAGGGAGAGAUA<br>GCUGCCAGGGAGACUCAGGGGGUCCCCACACGGAAGUCGAGGGGAC<br>GUCAUUUCUGACGGGAAUUAUCUCGGGAGAGGCGAAGGGGAACAUC<br>UACACUAAAUCACGGUUCAAUUGGAUCAAGGAAAAGACGAAACUCA<br>CGUGAUAAUAGGCUGGAGCCUCGGUGGCCAUGCUUCUUGCCCCUUG<br>GGCCUCCCCCCAGCCCCUCCUCCCCUUCCUGCACCCGUACCCCCGU<br>GGUCUUUGAAUAAAGUCUGAGUGGGCGGC |
| 1209 | mRNA sequence: non-translatable OX40L with 5'-UTR, 3'UTR, and miR-122 binding site (NST OX40L) | GGGAAAUAAGAGAGAAAAGAAGAGUAAGAAGAAAUAUAAGAACCCG<br>CAAGGAAGGGGAAGGGGUUCAACCCCUGGAAGAGAAUCUGGAAAAC<br>GGAUCAAGGCCAAGAUUCAAGAGGAAGAAGACGCUAAGGCUGGAGG<br>UCUCUGGGAUCAAGGGAGCAGGGAAGCUUCUGAGCUUCAUCUAAGU<br>CUGCCUGCAACUCUCUUCCUCUCCGGCAAAGGACCCUCCAAUCCAA<br>AGACUCAGAGGAGCAGUUACCAGAAGAGAGGAAGGGCAACUAUUCA<br>UCAGCUCAUACAAGAAAGAGUAUCAAACUAAGGAGGAGCAGAACAA<br>UUCGGUUGUCAUCAAGAGCGAAGGGCUUUAUAUCAUCUACCUGAAG<br>GGCUCCUUUUUCCAGGAGGUCAAGAUUGACCUUCAUUUCCGGGAGG<br>AUCAUAAUCCCAUCUCUAUUCCAAAGCUGAACGAAGGUCGAAGGAU<br>UGUCUUCACUGAGGAGGCCUCUUUGGCUUUCAAAGAUAAAGUUUAC<br>CUGACUGUAAAAGCUCCUGAUACUCUCUGCGAACACCUCCAGAUAA<br>AAGAAGGGGAGCUGAUUGUUGUCCAGCUAACGCCUGGAUACUGAGC<br>UCCUGAAGGAUCUUACCACAGCACUGAGAACCAAGUACCACUGUGA<br>UAAUAGGCUGGAGCCUCGGUGGCCAAGCUUCUUGCCCCUUGGGCCU<br>CCCCCCAGCCCCUCCUCCCCUUCCUGCACCCGUACCCCCCAAACAC<br>CAUUGUCACACUCCAGUGGUCUUUGAAUAAAGUCUGAGUGGGCGGC |
| 1210 | mRNA sequence: Firefly luciferase with 5'-UTR, 3'-UTR, and miR-122 binding site | GGGAAAUAAGAGAGAAAAGAAGAGUAAGAAGAAAUAUAAGAGCCAC<br>CAUGGAAGAUGCGAAGAACAUCAAGAAGGGACCUGCCCCGUUUUAC<br>CCUUUGGAGGACGGUACAGCAGGAGAACAGCUCCACAAGGCGAUGA<br>AACGCUACGCCCUGGUCCCCGGAACGAUUGCGUUUACCGAUGCACA<br>UAUUGAGGUAGACAUCACAUACGCAGAAUACUUCGAAAUGUCGGUG<br>AGGCUGGCGGAAGCGAUGAAGAGAUAUGGUCUUAACACUAAUCACC<br>GCAUCGUGGUGUGUUCGGAGAACUCAUUGCAGUUUUUCAUGCCGGU<br>CCUUGGAGCACUUUUCAUCGGGGUCGCAGUCGCGCCAGCGAACGAC<br>AUCUACAAUGAGCGGGAACUCUUGAAUAGCAUGGGAAUCUCCCAGC<br>CGACGGUCGUGUUUGUCUCCAAAAAGGGGCUGCAGAAAAUCCUCAA<br>CGUGCAGAAGAAGCUCCCCAUUAUUCAAAAGAUCAUCAUUAUGGAU<br>AGCAAGACAGAUUACCAAGGGUUCCAGUCGAUGUAUACCUUUGUGA<br>CAUCGCAUUUGCCGCCAGGGUUUAACGAGUAUGACUUCGUCCCCGA<br>GUCAUUUGACAGAGAUAAAACCAUCGCGCUGAUUAUGAAUUCCUCG<br>GGUAGCACCGGUUUGCCAAAGGGGGUGGCGUUGCCCCACCGCACUG<br>CUUGUGUGCGGUUCUCGCACGCUAGGGAUCCUAUCUUUGGUAAUCA<br>GAUCAUUCCCGACACAGCAAUCCUGUCCGUGGUACCUUUUCAUCAC<br>GGUUUUGGCAUGUUCACGACUCUCGGCUAUUUGAUUUGCGGUUUCA |

TABLE 18-continued

Additional OX40L polynucleotides comprising an mRNA and a miR-122 binding S site, and mRNA control sequences

| SEQ ID NO. | Description | Sequence |
|---|---|---|
| | | GGGUCGUACUUAUGUAUCGGUUCGAGGAAGAACUGUUUUUGAGAUC CUUGCAAGAUUACAAGAUCCAGUCGGCCCUCCUUGUGCCAACGCUU UUCUCAUUCUUUGCGAAAUCGACACUUAUUGAUAAGUAUGACCUUU CCAAUCUGCAUGAGAUUGCCUCAGGGGGAGCGCCGCUUAGCAAGGA AGUCGGGGAGGCAGUGGCCAAGCGCUUCCACCUUCCCGGAAUUCGG CAGGGAUACGGGCUCACGGAGACAACAUCCGCGAUCCUUAUCACGC CCGAGGGUGACGAUAAGCCGGGAGCCGUCGGAAAAGUGGUCCCCUU CUUUGAAGCCAAGGUCGUAGACCUCGACACGGGAAAAACCCUCGGA GUGAACCAGAGGGGCGAGCUCUGCGUGAGAGGGCCGAUGAUCAUGU CAGGUUACGUGAAUAACCCUGAAGCGACGAAUGCGCUGAUCGACAA GGAUGGGUGGUUGCAUUCGGGAGACAUUGCCUAUUGGGAUGAGGAU GAGCACUUCUUUAUCGUAGAUCGACUUAAGAGCUUGAUCAAAUACA AAGGCUAUCAGGUAGCGCCUGCCGAGCUCGAGUCAAUCCUGCUCCA GCACCCCAACAUUUUCGACGCCGGAGUGGCCGGGUUGCCCGAUGAC GACGCGGGUGAGCUGCCAGCGGCCGUGGUAGUCCUCGAACAUGGGA AAACAAUGACCGAAAAGGAGAUCGUGGACUACGUAGCAUCACAAGU GACGACUGCGAAGAAACUGAGGGGAGGGGUAGUCUUUGUGGACGAG GUCCCGAAAGGCUUGACUGGGAAGCUUGACGCUCGCAAAAUCCGGG AAAUCCUGAUUAAGGCAAAGAAAGGCGGGAAAAUCGCUGUCUGAUA AUAGGCUGGAGCCUCGGUGGCCAUGCUUCUUGCCCCUUGGGCCUCC CCCCAGCCCCUCCUCCCCUUCCUGCACCCGUACCCCCCAAACACCA UUGUCACACUCCAGUGGUCUUUGAAUAAAGUCUGAGUGGGCGGC |

Compositions and Formulations for Use Comprising OX40L Polynucleotides:

Certain aspects of the present disclosure are directed to compositions or formulations comprising any of the OX40L polynucleotides disclosed above.

In some embodiments, the composition or formulation comprises:

(i) an OX40L polynucleotide (e.g., a RNA, e.g., an mRNA) comprising a sequence-optimized nucleotide sequence (e.g., an ORF) encoding an OX40L polypeptide (e.g., the wild-type sequence, functional fragment, or variant thereof), wherein the OX40L polynucleotide comprises at least one chemically modified nucleobase, e.g., 5-methoxyuracil (e.g., wherein at least about 25%, at least about 30%, at least about 40%, at least about 50%, at least about 60%, at least about 70%, at least about 80%, at least about 90%, at least about 95%, at least about 99%, or 100% of the uracils are 5-methoxyuracils), and wherein the OX40L polynucleotide further comprises a miRNA binding site, e.g., a miRNA binding site that binds to miR-122 (e.g., a miR-122-3p or miR-122-5p binding site); and (ii) a delivery agent comprising a compound having Formula (I), e.g., any of Compounds 1-147 (e.g., Compound 18, 25, 26 or 48).

In some embodiments, the uracil or thymine content of the ORF relative to the theoretical minimum uracil or thymine content of a nucleotide sequence encoding the OX40L polypeptide (% $U_{TM}$ or % $T_{TM}$), is between about 100% and about 150%.

In some embodiments, the OX40L polynucleotides, compositions or formulations above are used to treat and/or prevent cell proliferation-related diseases, disorders or conditions, e.g., cancer.

IV. DISEASES, DISORDERS AND/OR CONDITIONS

In some embodiments, the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) can be used to reduce or decrease a size of a tumor or inhibit a tumor growth in a subject in need thereof.

In some embodiments, additional polynucleotides and/or polypeptides (e.g., polynucleotides and/or polypeptides indirectly or directly activating CD8+ T cells) can be administered in combination with the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) to reduce or decrease a size of a tumor or inhibit a tumor growth in a subject in need thereof.

Accordingly, in some embodiments, the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) can be used to reduce or decrease a size of a tumor or inhibit a tumor growth in a subject in need thereof.

In some embodiments, the tumor is associated with a disease, disorder, and/or condition. In a particular embodiment, the disease, disorder, and/or condition is a cancer. Thus, in one aspect, the administration of a combination therapy disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) treats a cancer.

In another aspect, the administration of a combination therapy disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) further comprising additional polynucleotides and/or polypeptides (e.g., polynucleotides and/or polypeptides indirectly or directly activating CD8+ T cells) treats a cancer.

A "cancer" refers to a broad group of various diseases characterized by the uncontrolled growth of abnormal cells in the body. Unregulated cell division and growth results in the formation of malignant tumors that invade neighboring tissues and can also metastasize to distant parts of the body through the lymphatic system or bloodstream. A "cancer" or "cancer tissue" can include a tumor at various stages. In certain embodiments, the cancer or tumor is stage 0, such that, e.g., the cancer or tumor is very early in development and has not metastasized. In some embodiments, the cancer or tumor is stage I, such that, e.g., the cancer or tumor is relatively small in size, has not spread into nearby tissue, and has not metastasized. In other embodiments, the cancer or tumor is stage II or stage III, such that, e.g., the cancer or tumor is larger than in stage 0 or stage I, and it has grown into neighboring tissues but it has not metastasized, except potentially to the lymph nodes. In other embodiments, the cancer or tumor is stage IV, such that, e.g., the cancer or tumor has metastasized. Stage IV can also be referred to as advanced or metastatic cancer.

In some aspects, the cancer can include, but is not limited to, adrenal cortical cancer, advanced cancer, anal cancer, aplastic anemia, bileduct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor and secondary cancers caused by cancer treatment.

In some aspects, the tumor is a solid tumor. A "solid tumor" includes, but is not limited to, sarcoma, melanoma, carcinoma, or other solid tumor cancer. "Sarcoma" refers to a tumor which is made up of a substance like the embryonic connective tissue and is generally composed of closely packed cells embedded in a fibrillar or homogeneous substance. Sarcomas include, but are not limited to, chondrosarcoma, fibrosarcoma, lymphosarcoma, melanosarcoma, myxosarcoma, osteosarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, endometrial sarcoma, stromal sarcoma, Ewing's sarcoma, fascial sarcoma, fibroblastic sarcoma, giant cell sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, or telangiectaltic sarcoma.

The term "melanoma" refers to a tumor arising from the melanocytic system of the skin and other organs. Melanomas include, for example, acra-lentiginous melanoma, amelanotic melanoma, benign juvenile melanoma, Cloudman's melanoma, S91 melanoma, Harding-Passey melanoma, juvenile melanoma, lentigo maligna melanoma, malignant melanoma, metastatic melanoma, nodular melanoma, subungal melanoma, or superficial spreading melanoma.

The term "carcinoma" refers to a malignant new growth made up of epithelial cells tending to infiltrate the surrounding tissues and give rise to metastases. Exemplary carcinomas include, e.g., acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniform carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypemephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidernoid carcinoma, carcinoma mucosum, mucous carcinoma, carcinoma myxomatodes, naspharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, or carcinoma viflosum.

Additional cancers that can be treated include, e.g., leukemia, Hodgkin's Disease, Non-Hodgkin's lymphoma, multiple myeloma, neuroblastoma, breast cancer, ovarian cancer, lung cancer, rhabdomyosarcoma, primary thrombocytosis, primary macroglobulinemia, small-cell lung tumors, primary brain tumors, stomach cancer, colon cancer, malignant pancreatic insulanoma, malignant carcinoid, urinary bladder cancer, premalignant skin lesions, testicular cancer, lymphomas, thyroid cancer, papillary thyroid cancer, neuroblastoma, neuroendocrine cancer, esophageal cancer, genitourinary tract cancer, malignant hypercalcemia, cervical cancer, endometrial cancer, adrenal cortical cancer, prostate cancer, Müllerian cancer, ovarian cancer, peritoneal cancer, fallopian tube cancer, or uterine papillary serous carcinoma.

Cancers and/or tumors amenable to treatment in accordance with the methods of the instant disclosure include those accessible via direct intratumoral and/or regional administration, i.e., administration in the region of a target tumor. For example, tumors accessible to administration with a simple syringe injection are readily amenable to treatment. Also amenable to treatment are tumors in which injection requires some imaging and/or guided administration, and/or those in which injection is possible via image-guided percutaneous injection, or catheter/cannula directly into site, or endoscopy.

Exemplary cancers and/or tumors amenable to treatment include melanoma, breast cancer, e.g., triple-negative breast cancer (TNBC), head & neck cancer, sarcoma, cutaneous T-Cell lymphoma (CTLC), non-Hodgkin's lymphoma (NHL), basal cell carcinoma, non-small cell lung carcinoma (NSCLC), hepatocellular carcinoma (HCC), glioma, gastric cancer, and pancreatic cancer. Particularly amenable to treatment are melanoma, breast cancer, e.g., TNBC, and head & neck cancer.

Melanoma

Melanoma is one of the most aggressive forms of skin cancer. Furthermore, incidence rates are increasing and there are few treatment options available. Melanoma is detected at a rate of 132,000 new cases per year worldwide (76,000 new cases per year in the United States) accounting for approximately 10,000 deaths per year in the US. About 25% are in patients<40 years. PD-1 inhibitors (e.g., nivolumab, pembrolizumab) are currently the standard of care and evidence a durable response rate of 37%, and progression-free survival of 30% at 2 years. However, there is also observed a rapid progression for non-responders (median 4m) and overall survival of only 40% is observed at 3 years with no evidence of plateau, i.e., treated patients continue to regress.

Thus, there is a clear need for new, more effective treatments in this setting. Melanoma also serves as a model tumor for understanding immunity to cancer. Melanoma tumor-associated antigens were among the first cancer antigens to be identified and classified, with further studies showing that many of these are also expressed by other tumor types. In addition, melanoma regression has been associated with vitiligo, visibly confirming an active role of the immune system in this type of cancer, and spontaneous regression of primary melanomas has also been observed in some cases. These observations, relating to the activity of the immune system in melanoma, provided strong evidence that this tumor should prove to be amenable to immunotherapy. Against this background, melanoma has long been at the cutting edge of immuno-oncology research and will likely continue to be used as a model tumor to increase our understanding of immuno-oncology and to inform treatment options in other types of immune-therapy responsive cancers.

Triple Negative Breast Cancer (TNBC)

Breast cancers display different characteristics that require different types of treatment. Most breast cancers are hormone receptor-positive, meaning that the cancer cells are stimulated to grow from exposure to the female hormones estrogen and/or progesterone. Other breast cancers are referred to as HER2-positive, which means that they overexpress the human epidermal growth factor receptor 2, a biologic pathway that is involved in replication and growth of a cell. HER2-positive breast cancers account for approximately 25% of breast cancers and are treated with agents that target the receptor to slow growth and replication. Breast cancers that are not stimulated to grow from exposure to estrogen or progesterone and are HER2-negative are called triple-negative breast cancers. Triple-negative breast cancers tend to be more aggressive than other breast cancers and have fewer treatment options as compared to other breast cancers. Although breast cancer has historically been considered immunologically silent, several preclinical and clinical studies suggest that immunotherapy has the potential to improve clinical outcomes for patients with breast cancer. Overall, immunotherapy holds several key advantages over conventional chemotherapeutic and targeted treatments directed at the tumor itself. First, immunotherapy generally results in fewer side effects, enabling it to be administered for longer periods of time and/or in combination with other agents without added toxicity. Patients may also be less likely to develop resistance to immunotherapy because of the immune system's ability to target multiple cancer antigens simultaneously, and adapt to changing cancer cells.

Head and Neck Cancer

Head and neck squamous cell carcinoma (HNSCC) induces an immune suppressive state via various mechanisms. Patients with HNSCC have altered lymphocyte homeostasis (mainly reduced levels of CD3+, CD4+, and CD8+ T cells) compared to healthy controls. This imbalance even remains 2 years after treatment with curative intent. Consistently, a higher number of tumor infiltrating CD4+ and CD8+ lymphocytes is associated with better overall survival in HNSCC patients. Additionally, natural killer cell (NK) function is impaired in HNSCC patients.

HNSCC cells apply certain strategies to escape immunosurveillance and subsequent elimination. For example, they interact indirectly with the immune system to maintain an immunosuppressive microenvironment. In essence, HNSCC exploit the fact that the immune system is tightly regulated through immune checkpoints to avoid autoimmunity or immune system over-activation under physiological circumstances.

V. SEQUENCE-OPTIMIZED NUCLEOTIDE SEQUENCES

In some embodiments, a polynucleotide in a combination therapy disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) (e.g., an mRNA combination therapy) comprises a sequence-optimized nucleotide sequence encoding an immune response primer, an immune response co-stimulatory signal, a checkpoint inhibitor, or a combination thereof. In some embodiments, the polynucleotide of the disclosure comprises an open reading frame (ORF) encoding an immune response primer, wherein the ORF has been sequence optimized. In some embodiments, the polynucleotide of the disclosure comprises an open reading frame (ORF) encoding an immune response co-stimulatory signal, wherein the ORF has been sequence optimized. In some embodiments, the polynucleotide of the disclosure comprises an open reading frame (ORF) encoding a checkpoint inhibitor, wherein the ORF has been sequence optimized.

In some embodiments, the sequence optimized immune response primer, and/or immune response co-stimulatory signal and/or checkpoint inhibitor sequences, fragments, and variants thereof are used to practice the methods disclosed herein. In some embodiments, the sequence optimized immune response primer, and/or immune response co-stimulatory signal and/or checkpoint inhibitor fragments and variants thereof are combined with or alternatives to their respective wild-type sequences.

The sequence-optimized nucleotide sequences disclosed herein are distinct from the corresponding wild type nucleotide acid sequences and from other known sequence-optimized nucleotide sequences, e.g., these sequence-optimized nucleic acids have unique compositional characteristics.

In some embodiments, the percentage of uracil or thymine nucleobases in a sequence-optimized nucleotide sequence (e.g., encoding an immune response primer, and/or an immune response co-stimulatory signal and/or checkpoint inhibitor, or a combination thereof, or any functional fragments and/or variants, or combination thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100. In some embodiments, the sequence-optimized nucleotide sequence has a lower uracil or thymine content than the uracil or thymine content in the reference wild-type sequence. In some embodiments, the uracil or thymine content in a sequence-optimized nucleotide sequence of the disclosure is greater than the uracil or thymine content in the reference wild-type sequence and still maintain beneficial effects, e.g., increased expression and/or signaling response when compared to the reference wild-type sequence.

In some embodiments, the optimized sequences of the present disclosure contain unique ranges of uracils or thymine (if DNA) in the sequence. In some embodiments, a uracil-modified sequence encoding an immune response primer, immune response co-stimulatory signal, or checkpoint inhibitor polypeptide of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide.

In some embodiments, a uracil-modified sequence encoding an immune response primer, immune response co-stimulatory signal, or checkpoint inhibitor polypeptide of the disclosure has a reduced number of uracil triplets (UUU) with respect to the wild-type nucleic acid sequence. In some embodiments, a uracil-modified sequence encoding an immune response primer, immune response co-stimulatory signal, or checkpoint inhibitor polypeptide has a reduced number of uracil pairs (UU) with respect to the number of uracil pairs (UU) in the wild-type nucleic acid sequence. In some embodiments, a uracil-modified sequence encoding an immune response primer, immune response co-stimulatory signal, or checkpoint inhibitor polypeptide of the disclosure has a number of uracil pairs (UU) corresponding to the minimum possible number of uracil pairs (UU) in the wild-type nucleic acid sequence.

In some embodiments, the polynucleotide of the disclosure comprises a uracil-modified sequence encoding an immune response primer, immune response co-stimulatory signal, or checkpoint inhibitor polypeptide disclosed herein. In some embodiments, the uracil-modified sequence encoding an immune response primer, immune response co-stimulatory signal, or checkpoint inhibitor polypeptide comprises at least one chemically modified nucleobase, e.g., 5-methoxyuracil. In some embodiments, at least 95% of a nucleobase (e.g., uracil) in a uracil-modified sequence encoding an immune response primer, immune response co-stimulatory signal, or checkpoint inhibitor polypeptide of the disclosure are modified nucleobases. In some embodiments, at least 95% of uracil in a uracil-modified sequence encoding an immune response primer, immune response co-stimulatory signal, or checkpoint inhibitor polypeptide is 5-methoxyuracil. In some embodiments, the polynucleotide comprising a uracil-modified sequence further comprises a miRNA binding site, e.g., a miRNA binding site that binds to miR-122. In some embodiments, the polynucleotide comprising a uracil-modified sequence is formulated with a delivery agent, e.g., a compound having Formula (I), e.g., any of Compounds 1-147.

VI. METHODS FOR SEQUENCE OPTIMIZATION

In some embodiments, a polynucleotide of the disclosure (e.g., a polynucleotide comprising a nucleotide sequence encoding an immune response primer, immune response co-stimulatory signal, or checkpoint inhibitor polypeptide (e.g., the wild-type sequence, functional fragment, or variant thereof) is sequence optimized.

A sequence optimized nucleotide sequence (nucleotide sequence is also referred to as "nucleic acid" herein) comprises at least one codon modification with respect to a reference sequence (e.g., a wild-type sequence encoding an immune response primer, immune response co-stimulatory signal, or checkpoint inhibitor polypeptide. Thus, in a sequence optimized nucleic acid, at least one codon is different from a corresponding codon in a reference sequence (e.g., a wild-type sequence).

In general, sequence optimized nucleic acids are generated by at least a step comprising substituting codons in a reference sequence with synonymous codons (i.e., codons that encode the same amino acid). Such substitutions can be effected, for example, by applying a codon substitution map (i.e., a table providing the codons that will encode each amino acid in the codon optimized sequence), or by applying a set of rules (e.g., if glycine is next to neutral amino acid, glycine would be encoded by a certain codon, but if it is next to a polar amino acid, it would be encoded by another codon). In addition to codon substitutions (i.e., "codon optimization") the sequence optimization methods disclosed herein comprise additional optimization steps which are not strictly directed to codon optimization such as the removal of deleterious motifs (destabilizing motif substitution). Compositions and formulations comprising these sequence optimized nucleic acids (e.g., a RNA, e.g., an mRNA) can be administered to a subject in need thereof to facilitate in vivo expression of functionally active immune response primer, immune response co-stimulatory signal, or checkpoint inhibitor polypeptide.

The recombinant expression of large molecules in cell cultures can be a challenging task with numerous limitations (e.g., poor protein expression levels, stalled translation resulting in truncated expression products, protein misfolding, etc.) These limitations can be reduced or avoided by administering the polynucleotides (e.g., a RNA, e.g., an mRNA), which encode a functionally active immune response primer, immune response co-stimulatory signal, or checkpoint inhibitor polypeptide or compositions or formulations comprising the same to a patient suffering from cancer, so the synthesis and delivery of the immune response primer, immune response co-stimulatory signal, or checkpoint inhibitor polypeptide to treat cancer takes place endogenously.

Changing from an in vitro expression system (e.g., cell culture) to in vivo expression requires the redesign of the nucleic acid sequence encoding the therapeutic agent. Redesigning a naturally occurring gene sequence by choosing different codons without necessarily altering the encoded amino acid sequence can often lead to dramatic increases in protein expression levels (Gustafsson et al., 2004, Trends Biotechnol 22:346-53). Variables such as codon adaptation index (CAI), mRNA secondary structures, cis-regulatory sequences, GC content and many other similar variables have been shown to somewhat correlate with protein expression levels (Villalobos et al., 2006, BMC Bioinformatics 7:285). However, due to the degeneracy of the genetic code, there are numerous different nucleic acid sequences that can all encode the same therapeutic agent. Each amino acid is encoded by up to six synonymous codons; and the choice between these codons influences gene expression. In addition, codon usage (i.e., the frequency with which different organisms use codons for expressing a polypeptide sequence) differs among organisms (for example, recombinant production of human or humanized therapeutic antibodies frequently takes place in hamster cell cultures).

In some embodiments, a reference nucleic acid sequence can be sequence optimized by applying a codon map. The skilled artisan will appreciate that the T bases in the codon maps disclosed below are present in DNA, whereas the T bases would be replaced by U bases in corresponding RNAs. For example, a sequence optimized nucleic acid disclosed herein in DNA form, e.g., a vector or an in-vitro translation (IVT) template, would have its T bases transcribed as U based in its corresponding transcribed mRNA. In this respect, both sequence optimized DNA sequences (comprising T) and their corresponding RNA sequences (comprising U) are considered sequence optimized nucleic acid of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn may correspond to a ΨΨC codon (RNA map in which U has been replaced with pseudouridine).

In one embodiment, a reference sequence encoding an immune response primer, immune response co-stimulatory signal, or checkpoint inhibitor polypeptide can be optimized by replacing all the codons encoding a certain amino acid with only one of the alternative codons provided in a codon map. For example, all the valines in the optimized sequence would be encoded by GTG or GTC or GTT.

Sequence optimized polynucleotides of the disclosure can be generated using one or more codon optimization methods, or a combination thereof. Sequence optimization methods which may be used to sequence optimize nucleic acid sequences are described in detail herein. This list of methods is not comprehensive or limiting.

It will be appreciated that the design principles and rules described for each one of the sequence optimization methods discussed below can be combined in many different ways, for example high G/C content sequence optimization for some regions or uridine content sequence optimization for other regions of the reference nucleic acid sequence, as well as targeted nucleotide mutations to minimize secondary structure throughout the sequence or to eliminate deleterious motifs.

The choice of potential combinations of sequence optimization methods can be, for example, dependent on the specific chemistry used to produce a synthetic polynucleotide. Such a choice can also depend on characteristics of the protein encoded by the sequence optimized nucleic acid, e.g., a full sequence, a functional fragment, or a fusion protein comprising an immune response primer, an immune response co-stimulatory signal, a checkpoint inhibitor, etc. In some embodiments, such a choice can depend on the specific tissue or cell targeted by the sequence optimized nucleic acid (e.g., a therapeutic synthetic mRNA).

The mechanisms of combining the sequence optimization methods or design rules derived from the application and analysis of the optimization methods can be either simple or complex. For example, the combination can be:

(i) Sequential: Each sequence optimization method or set of design rules applies to a different subsequence of the overall sequence, for example reducing uridine at codon positions 1 to 30 and then selecting high frequency codons for the remainder of the sequence;

(ii) Hierarchical: Several sequence optimization methods or sets of design rules are combined in a hierarchical, deterministic fashion. For example, use the most GC-rich codons, breaking ties (which are common) by choosing the most frequent of those codons.

(iii) Multifactorial/Multiparametric: Machine learning or other modeling techniques are used to design a single sequence that best satisfies multiple overlapping and possibly contradictory requirements. This approach would require the use of a computer applying a number of mathematical techniques, for example, genetic algorithms.

Ultimately, each one of these approaches can result in a specific set of rules which in many cases can be summarized in a single codon table, i.e., a sorted list of codons for each amino acid in the target protein (i.e., an immune response primer, an immune response co-stimulatory signal, or checkpoint inhibitor polypeptide), with a specific rule or set of rules indicating how to select a specific codon for each amino acid position.

a. Uridine Content Optimization

The presence of local high concentrations of uridine in a nucleic acid sequence can have detrimental effects on translation, e.g., slow or prematurely terminated translation, especially when modified uridine analogs are used in the production of synthetic mRNAs. Furthermore, high uridine content can also reduce the in vivo half-life of synthetic mRNAs due to TLR activation.

Accordingly, a nucleic acid sequence can be sequence optimized using a method comprising at least one uridine content optimization step. Such a step comprises, e.g., substituting at least one codon in the reference nucleic acid with an alternative codon to generate a uridine-modified sequence, wherein the uridine-modified sequence has at least one of the following properties:

(i) increase or decrease in global uridine content;

(ii) increase or decrease in local uridine content (i.e., changes in uridine content are limited to specific subsequences);

(iii) changes in uridine distribution without altering the global uridine content;

(iv) changes in uridine clustering (e.g., number of clusters, location of clusters, or distance between clusters); or (v) combinations thereof.

In some embodiments, the sequence optimization process comprises optimizing the global uridine content, i.e., optimizing the percentage of uridine nucleobases in the sequence optimized nucleic acid with respect to the percentage of uridine nucleobases in the reference nucleic acid sequence. For example, 30% of nucleobases may be uridines in the reference sequence and 10% of nucleobases may be uridines in the sequence optimized nucleic acid.

In other embodiments, the sequence optimization process comprises reducing the local uridine content in specific regions of a reference nucleic acid sequence, i.e., reducing the percentage of uridine nucleobases in a subsequence of the sequence optimized nucleic acid with respect to the percentage of uridine nucleobases in the corresponding subsequence of the reference nucleic acid sequence. For example, the reference nucleic acid sequence may have a 5'-end region (e.g., 30 codons) with a local uridine content of 30%, and the uridine content in that same region could be reduced to 10% in the sequence optimized nucleic acid.

In specific embodiments, codons can be replaced in the reference nucleic acid sequence to reduce or modify, for example, the number, size, location, or distribution of uridine clusters that could have deleterious effects on protein translation. Although as a general rule it is desirable to reduce the uridine content of the reference nucleic acid sequence, in certain embodiments the uridine content, and in particular the local uridine content, of some subsequences of the reference nucleic acid sequence can be increased.

The reduction of uridine content to avoid adverse effects on translation can be done in combination with other optimization methods disclosed here to achieve other design goals. For example, uridine content optimization can be combined with ramp design, since using the rarest codons for most amino acids will, with a few exceptions, reduce the U content.

In some embodiments, the uridine-modified sequence is designed to induce a lower Toll-Like Receptor (TLR) response when compared to the reference nucleic acid sequence. Several TLRs recognize and respond to nucleic acids. Double-stranded (ds)RNA, a frequent viral constituent, has been shown to activate TLR3. See Alexopoulou et al. (2001) Nature, 413:732-738 and Wang et al. (2004) Nat. Med., 10:1366-1373. Single-stranded (ss)RNA activates TLR7. See Diebold et al. (2004) Science 303:1529-1531. RNA oligonucleotides, for example RNA with phosphorothioate internucleotide linkages, are ligands of human TLR8. See Heil et al. (2004) Science 303:1526-1529. DNA containing unmethylated CpG motifs, characteristic of bacterial and viral DNA, activate TLR9. See Hemmi et al. (2000) Nature, 408: 740-745.

As used herein, the term "TLR response" is defined as the recognition of single-stranded RNA by a TLR7 receptor, and in some embodiments encompasses the degradation of the RNA and/or physiological responses caused by the recognition of the single-stranded RNA by the receptor. Methods to determine and quantitate the binding of an RNA to a TLR7 are known in the art. Similarly, methods to determine whether an RNA has triggered a TLR7-mediated physiological response (e.g., cytokine secretion) are well known in the art. In some embodiments, a TLR response can be mediated by TLR3, TLR8, or TLR9 instead of TLR7.

Suppression of TLR7-mediated response can be accomplished via nucleoside modification. RNA undergoes over hundred different nucleoside modifications in nature (see the RNA Modification Database, available at mods.rna.albany.edu). Human rRNA, for example, has ten times more pseudouridine (Ψ) and 25 times more 2'-O-methylated nucleosides than bacterial rRNA. Bacterial mRNA contains no nucleoside modifications, whereas mammalian mRNAs have modified nucleosides such as 5-methylcytidine (m5C), N6-methyladenosine (m6A), inosine and many 2'-O-methylated nucleosides in addition to N7-methylguanosine (m7G).

Uracil and ribose, the two defining features of RNA, are both necessary and sufficient for TLR7 stimulation, and short single-stranded RNA (ssRNA) act as TLR7 agonists in a sequence-independent manner as long as they contain several uridines in close proximity. See Diebold et al. (2006) Eur. J. Immunol. 36:3256-3267, which is herein incorporated by reference in its entirety. Accordingly, one or more of the optimization methods disclosed herein comprises reducing the uridine content (locally and/or locally) and/or reducing or modifying uridine clustering to reduce or to suppress a TLR7-mediated response.

In some embodiments, the TLR response (e.g., a response mediated by TLR7) caused by the uridine-modified sequence is at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% lower than the TLR response caused by the reference nucleic acid sequence.

In some embodiments, the TLR response caused by the reference nucleic acid sequence is at least about 1-fold, at least about 1.1-fold, at least about 1.2-fold, at least about 1.3-fold, at least about 1.4-fold, at least about 1.5-fold, at least about 1.6-fold, at least about 1.7-fold, at least about 1.8-fold, at least about 1.9-fold, at least about 2-fold, at least about 3-fold, at least about 4-fold, at least about 5-fold, at least about 6-fold, at least about 7-fold, at least about 8-fold, at least about 9-fold, or at least about 10-fold higher than the TLR response caused by the uridine-modified sequence.

In some embodiments, the uridine content (average global uridine content) (absolute or relative) of the uridine-modified sequence is higher than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% more uridine that the reference nucleic acid sequence.

In other embodiments, the uridine content (average global uridine content) (absolute or relative) of the uridine-modified sequence is lower than the uridine content (absolute or relative) of the reference nucleic acid sequence. Accordingly, in some embodiments, the uridine-modified sequence contains at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% less uridine that the reference nucleic acid sequence.

In some embodiments, the uridine content (average global uridine content) (absolute or relative) of the uridine-modified sequence is less than 50%, 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2% or 1% of the total nucleobases in the uridine-modified sequence. In some embodiments, the uridine content of the uridine-modified sequence is between about 10% and about 20%. In some particular embodiments, the uridine content of the uridine-modified sequence is between about 12% and about 16%.

In some embodiments, the uridine content of the reference nucleic acid sequence can be measured using a sliding window. In some embodiments, the length of the sliding window is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleobases. In some embodiments, the sliding window is over 40 nucleobases in length. In some embodiments, the sliding window is 20 nucleobases in length. Based on the uridine content measured with a sliding window, it is possible to generate a histogram representing the uridine content throughout the length of the reference nucleic acid sequence and sequence optimized nucleic acids.

In some embodiments, a reference nucleic acid sequence can be modified to reduce or eliminate peaks in the histogram that are above or below a certain percentage value. In some embodiments, the reference nucleic acid sequence can be modified to eliminate peaks in the sliding-window representation which are above 65%, 60%, 55%, 50%, 45%, 40%, 35%, or 30% uridine. In another embodiment, the reference nucleic acid sequence can be modified so no peaks are over 30% uridine in the sequence optimized nucleic acid, as measured using a 20 nucleobase sliding window. In some embodiments, the reference nucleic acid sequence can be modified so no more or no less than a predetermined number of peaks in the sequence optimized nucleic sequence, as measured using a 20 nucleobase sliding window, are above or below a certain threshold value. For example, in some embodiments, the reference nucleic acid sequence can be modified so no peaks or no more than 1, 2, 3, 4, 5, 6, 7, 8, 9 or 10 peaks in the sequence optimized nucleic acid are above 10%, 15%, 20%, 25% or 30% uridine. In another embodiment, the sequence optimized nucleic acid contains between 0 peaks and 2 peaks with uridine contents 30% of higher.

In some embodiments, a reference nucleic acid sequence can be sequence optimized to reduce the incidence of consecutive uridines. For example, two consecutive leucines could be encoded by the sequence CUUUUG, which would include a four uridine cluster. Such subsequence could be substituted with CUGCUC, which would effectively remove the uridine cluster. Accordingly, a reference nucleic sequence can be sequence optimized by reducing or eliminating uridine pairs (UU), uridine triplets (UUU) or uridine quadruplets (UUUU). Higher order combinations of U are not considered combinations of lower order combinations. Thus, for example, UUUU is strictly considered a quadruplet, not two consecutive U pairs; or UUUUUU is considered a sextuplet, not three consecutive U pairs, or two consecutive U triplets, etc.

In some embodiments, all uridine pairs (UU) and/or uridine triplets (UUU) and/or uridine quadruplets (UUUU) can be removed from the reference nucleic acid sequence. In other embodiments, uridine pairs (UU) and/or uridine triplets (UUU) and/or uridine quadruplets (UUUU) can be reduced below a certain threshold, e.g., no more than 1, 2, 3, 4, 5, 6, 7, 8, 9, 10, 11, 12, 13, 14, 15, 16, 17, 18, 19, or 20 occurrences in the sequence optimized nucleic acid. In a particular embodiment, the sequence optimized nucleic acid contains less than 20, 19, 18, 17, 16, 15, 14, 13, 12, 11, 10, 9, 8, 7, 6, 5, 4, 3, 2, or 1 uridine pairs. In another particular embodiment, the sequence optimized nucleic acid contains no uridine pairs and/or triplets.

Phenylalanine codons, i.e., UUC or UUU, comprise a uridine pair or triples and therefore sequence optimization to reduce uridine content can at most reduce the phenylalanine U triplet to a phenylalanine U pair. In some embodiments, the occurrence of uridine pairs (UU) and/or uridine triplets (UUU) refers only to non-phenylalanine U pairs or triplets. Accordingly, in some embodiments, non-phenylalanine uridine pairs (UU) and/or uridine triplets (UUU) can be reduced below a certain threshold, e.g., no more than 1, 2, 3, 4, 5, 6, 7, 8, 9, 10, 11, 12, 13, 14, 15, 16, 17, 18, 19, or 20 occurrences in the sequence optimized nucleic acid. In a particular embodiment, the sequence optimized nucleic acid contains less than 20, 19, 18, 17, 16, 15, 14, 13, 12, 11, 10, 9, 8, 7, 6, 5, 4, 3, 2, or 1 non-phenylalanine uridine pairs and/or triplets. In another particular embodiment, the sequence optimized nucleic acid contains no non-phenylalanine uridine pairs and/or triplets.

In some embodiments, the reduction in uridine combinations (e.g., pairs, triplets, quadruplets) in the sequence optimized nucleic acid can be expressed as a percentage reduction with respect to the uridine combinations present in the reference nucleic acid sequence.

In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine pairs present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine triplets present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of uridine quadruplets present in the reference nucleic acid sequence.

In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of non-phenylalanine uridine pairs present in the reference nucleic acid sequence. In some embodiments, a sequence optimized nucleic acid can contain about 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, or 65% of the total number of non-phenylalanine uridine triplets present in the reference nucleic acid sequence.

In some embodiments, the uridine content in the sequence optimized sequence can be expressed with respect to the theoretical minimum uridine content in the sequence. The term "theoretical minimum uridine content" is defined as the uridine content of a nucleic acid sequence as a percentage of the sequence's length after all the codons in the sequence have been replaced with synonymous codon with the lowest uridine content. In some embodiments, the uridine content of the sequence optimized nucleic acid is identical to the theoretical minimum uridine content of the reference sequence (e.g., a wild type sequence). In some aspects, the uridine content of the sequence optimized nucleic acid is about 90%, about 95%, about 100%, about 105%, about 110%, about 115%, about 120%, about 125%, about 130%, about 135%, about 140%, about 145%, about 150%, about 155%, about 160%, about 165%, about 170%, about 175%, about 180%, about 185%, about 190%, about 195% or about 200% of the theoretical minimum uridine content of the reference sequence (e.g., a wild type sequence).

In some embodiments, the uridine content of the sequence optimized nucleic acid is identical to the theoretical minimum uridine content of the reference sequence (e.g., a wild type sequence).

The reference nucleic acid sequence (e.g., a wild type sequence) can comprise uridine clusters which due to their number, size, location, distribution or combinations thereof have negative effects on translation. As used herein, the term "uridine cluster" refers to a subsequence in a reference nucleic acid sequence or sequence optimized nucleic sequence with contains a uridine content (usually described as a percentage) which is above a certain threshold. Thus, in certain embodiments, if a subsequence comprises more than about 10%, 15%, 20%, 25%, 30%, 35%, 40%, 45%, 50%, 55%, 60% or 65% uridine content, such subsequence would be considered a uridine cluster.

The negative effects of uridine clusters can be, for example, eliciting a TLR7 response. Thus, in some implementations of the nucleic acid sequence optimization methods disclosed herein it is desirable to reduce the number of clusters, size of clusters, location of clusters (e.g., close to the 5' and/or 3' end of a nucleic acid sequence), distance between clusters, or distribution of uridine clusters (e.g., a certain pattern of cluster along a nucleic acid sequence, distribution of clusters with respect to secondary structure elements in the expressed product, or distribution of clusters with respect to the secondary structure of an mRNA).

In some embodiments, the reference nucleic acid sequence comprises at least one uridine cluster, wherein said uridine cluster is a subsequence of the reference nucleic acid sequence wherein the percentage of total uridine nucleobases in said subsequence is above a predetermined threshold. In some embodiments, the length of the subsequence is at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 nucleobases. In some embodiments, the subsequence is longer than 100 nucleobases. In some embodiments, the threshold is 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% uridine content. In some embodiments, the threshold is above 25%.

For example, an amino acid sequence comprising A, D, G, S and R could be encoded by the nucleic acid sequence GCU, GAU, GGU, AGU, CGU. Although such sequence does not contain any uridine pairs, triplets, or quadruplets, one third of the nucleobases would be uridines. Such a uridine cluster could be removed by using alternative codons, for example, by using GCC, GAC, GGC, AGC, and CGC, which would contain no uridines.

In other embodiments, the reference nucleic acid sequence comprises at least one uridine cluster, wherein said uridine cluster is a subsequence of the reference nucleic acid sequence wherein the percentage of uridine nucleobases of said subsequence as measured using a sliding window that is above a predetermined threshold. In some embodiments, the length of the sliding window is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleobases. In some embodiments, the sliding window is over 40 nucleobases in length. In some embodiments, the threshold is 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% uridine content. In some embodiments, the threshold is above 25%.

In some embodiments, the reference nucleic acid sequence comprises at least two uridine clusters. In some embodiments, the uridine-modified sequence contains fewer uridine-rich clusters than the reference nucleic acid sequence. In some embodiments, the uridine-modified sequence contains more uridine-rich clusters than the reference nucleic acid sequence. In some embodiments, the uridine-modified sequence contains uridine-rich clusters with are shorter in length than corresponding uridine-rich clusters in the reference nucleic acid sequence. In other embodiments, the uridine-modified sequence contains uridine-rich clusters which are longer in length than the corresponding uridine-rich cluster in the reference nucleic acid sequence.

See, Kariko et al. (2005) Immunity 23:165-175; Kormann et al. (2010) Nature Biotechnology 29:154-157; or Sahin et al. (2014) Nature Reviews Drug Discovery 13:759-780; all of which are herein incorporated by reference their entireties.

b. Guanine/Cytosine (G/C) Content

A reference nucleic acid sequence can be sequence optimized using methods comprising altering the Guanine/Cytosine (G/C) content (absolute or relative) of the reference nucleic acid sequence. Such optimization can comprise altering (e.g., increasing or decreasing) the global G/C content (absolute or relative) of the reference nucleic acid sequence; introducing local changes in G/C content in the reference nucleic acid sequence (e.g., increase or decrease G/C in selected regions or subsequences in the reference nucleic acid sequence); altering the frequency, size, and distribution of G/C clusters in the reference nucleic acid sequence, or combinations thereof.

In some embodiments, the sequence optimized nucleic acid encoding an immune response primer, an immune response co-stimulatory signal, or a checkpoint inhibitor polypeptide comprises an overall increase in G/C content (absolute or relative) relative to the G/C content (absolute or relative) of the reference nucleic acid sequence. In some embodiments, the overall increase in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding an immune response primer, an immune response co-stimulatory signal, or a checkpoint inhibitor polypeptide comprises an overall decrease in G/C content (absolute or relative) relative to the G/C content of the reference nucleic acid sequence. In some embodiments, the overall decrease in G/C content (absolute or relative) is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the reference nucleic acid sequence.

In some embodiments, the sequence optimized nucleic acid encoding an immune response primer, an immune response co-stimulatory signal, or a checkpoint inhibitor polypeptide comprises a local increase in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local increase in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

In some embodiments, the sequence optimized nucleic acid encoding an immune response primer, an immune response co-stimulatory signal, or a checkpoint inhibitor polypeptide comprises a local decrease in Guanine/Cytosine (G/C) content (absolute or relative) in a subsequence (i.e., a G/C modified subsequence) relative to the G/C content (absolute or relative) of the corresponding subsequence in the reference nucleic acid sequence. In some embodiments, the local decrease in G/C content (absolute or relative) is by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100% relative to the G/C content (absolute or relative) of the corresponding subsequence in the reference nucleic acid sequence.

In some embodiments, the G/C content (absolute or relative) is increased or decreased in a subsequence which is at least about 5, 10, 15, 20, 25, 30, 35, 40, 45, 50, 55, 60, 65, 70, 75, 80, 85, 90, 95, or 100 nucleobases in length.

In some embodiments, the G/C content (absolute or relative) is increased or decreased in a subsequence which is at least about 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleobases in length.

In some embodiments, the G/C content (absolute or relative) is increased or decreased in a subsequence which is at least about 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900, or 10000 nucleobases in length.

The increases or decreases in G and C content (absolute or relative) described herein can be conducted by replacing synonymous codons with low G/C content with synonymous codons having higher G/C content, or vice versa. For example, L has 6 synonymous codons: two of them have 2 G/C (CUC, CUG), 3 have a single G/C (UUG, CUU, CUA), and one has no G/C (UUA). So if the reference nucleic acid had a CUC codon in a certain position, G/C content at that position could be reduced by replacing CUC with any of the codons having a single G/C or the codon with no G/C.

See, U.S. Publ. Nos. US20140228558, US20050032730 A1; Gustafsson et al. (2012) Protein Expression and Purification 83: 37-46; all of which are incorporated herein by reference in their entireties.

c. Codon Frequency—Codon Usage Bias

Numerous codon optimization methods known in the art are based on the substitution of codons in a reference nucleic acid sequence with codons having higher frequencies. Thus, in some embodiments, a nucleic acid sequence encoding an immune response primer, an immune response co-stimulatory signal, or a checkpoint inhibitor polypeptide disclosed herein can be sequence optimized using methods comprising the use of modifications in the frequency of use of one or more codons relative to other synonymous codons in the sequence optimized nucleic acid with respect to the frequency of use in the non-codon optimized sequence.

As used herein, the term "codon frequency" refers to codon usage bias, i.e., the differences in the frequency of occurrence of synonymous codons in coding DNA/RNA. It is generally acknowledged that codon preferences reflect a balance between mutational biases and natural selection for translational optimization. Optimal codons help to achieve faster translation rates and high accuracy. As a result of these factors, translational selection is expected to be stronger in highly expressed genes. In the field of bioinformatics and computational biology, many statistical methods have been proposed and used to analyze codon usage bias. See, e.g., Comeron & Aguadé (1998) J. Mol. Evol. 47: 268-74.

Methods such as the 'frequency of optimal codons' (Fop) (Ikemura (1981) J. Mol. Biol. 151 (3): 389-409), the Relative Codon Adaptation (RCA) (Fox & Eril (2010) DNA Res. 17 (3): 185-96) or the 'Codon Adaptation Index' (CAI) (Sharp & Li (1987) Nucleic Acids Res. 15 (3): 1281-95) are used to predict gene expression levels, while methods such as the 'effective number of codons' (Nc) and Shannon entropy from information theory are used to measure codon usage evenness. Multivariate statistical methods, such as correspondence analysis and principal component analysis, are widely used to analyze variations in codon usage among genes (Suzuki et al. (2008) DNA Res. 15 (6): 357-65; Sandhu et al., In Silico Biol. 2008; 8(2):187-92).

The nucleic acid sequence encoding an immune response primer, an immune response co-stimulatory signal, or a checkpoint inhibitor polypeptide disclosed herein (e.g., a wild type nucleic acid sequence, a mutant nucleic acid sequence, a chimeric nucleic sequence, etc. which can be, for example, an mRNA), can be codon optimized using methods comprising substituting at least one codon in the reference nucleic acid sequence with an alternative codon having a higher or lower codon frequency in the synonymous codon set; wherein the resulting sequence optimized nucleic acid has at least one optimized property with respect to the reference nucleic acid sequence.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the reference nucleic acid sequence encoding an immune response primer, an immune response co-stimulatory signal, or a checkpoint inhibitor polypeptide are substituted with alternative codons, each alternative codon having a codon frequency higher than the codon frequency of the substituted codon in the synonymous codon set.

In some embodiments, at least one codon in the reference nucleic acid sequence encoding an immune response primer, an immune response co-stimulatory signal, or a checkpoint inhibitor polypeptide is substituted with an alternative codon having a codon frequency higher than the codon frequency of the substituted codon in the synonymous codon set, and at least one codon in the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in the reference nucleic acid sequence encoding an immune response primer, an immune response co-stimulatory signal, or a checkpoint inhibitor polypeptide are substituted with alternative codons, each alternative codon having a codon frequency higher than the codon frequency of the substituted codon in the synonymous codon set.

In some embodiments, at least one alternative codon having a higher codon frequency has the highest codon frequency in the synonymous codon set. In other embodiments, all alternative codons having a higher codon frequency have the highest codon frequency in the synonymous codon set.

In some embodiments, at least one alternative codon having a lower codon frequency has the lowest codon frequency in the synonymous codon set. In some embodiments, all alternative codons having a higher codon frequency have the highest codon frequency in the synonymous codon set.

In some specific embodiments, at least one alternative codon has the second highest, the third highest, the fourth highest, the fifth highest or the sixth highest frequency in the synonymous codon set. In some specific embodiments, at least one alternative codon has the second lowest, the third lowest, the fourth lowest, the fifth lowest, or the sixth lowest frequency in the synonymous codon set.

Optimization based on codon frequency can be applied globally, as described above, or locally to the reference nucleic acid sequence encoding an immune response primer, an immune response co-stimulatory signal, or a checkpoint inhibitor polypeptide. In some embodiments, when applied locally, regions of the reference nucleic acid sequence can modified based on codon frequency, substituting all or a certain percentage of codons in a certain subsequence with codons that have higher or lower frequencies in their respective synonymous codon sets. Thus, in some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in a subsequence of the reference nucleic acid sequence are substituted with alternative codons, each alternative codon having a codon frequency higher than the codon frequency of the substituted codon in the synonymous codon set.

In some embodiments, at least one codon in a subsequence of the reference nucleic acid sequence encoding an immune response primer, an immune response co-stimulatory signal, or a checkpoint inhibitor polypeptide is substituted with an alternative codon having a codon frequency higher than the codon frequency of the substituted codon in the synonymous codon set, and at least one codon in a subsequence of the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in a subsequence of the reference nucleic acid sequence encoding an immune response primer, an immune response co-stimulatory signal, or a checkpoint inhibitor polypeptide are substituted with alternative codons, each alternative codon having a codon frequency higher than the codon frequency of the substituted codon in the synonymous codon set.

In some embodiments, at least one alternative codon substituted in a subsequence of the reference nucleic acid sequence encoding an immune response primer, an immune response co-stimulatory signal, or a checkpoint inhibitor polypeptide and having a higher codon frequency has the highest codon frequency in the synonymous codon set. In other embodiments, all alternative codons substituted in a subsequence of the reference nucleic acid sequence and having a lower codon frequency have the lowest codon frequency in the synonymous codon set.

In some embodiments, at least one alternative codon substituted in a subsequence of the reference nucleic acid sequence encoding an immune response primer, an immune response co-stimulatory signal, or a checkpoint inhibitor polypeptide and having a lower codon frequency has the lowest codon frequency in the synonymous codon set. In some embodiments, all alternative codons substituted in a subsequence of the reference nucleic acid sequence and having a higher codon frequency have the highest codon frequency in the synonymous codon set.

In specific embodiments, a sequence optimized nucleic acid encoding an immune response primer, an immune response co-stimulatory signal, or a checkpoint inhibitor polypeptide can comprise a subsequence having an overall codon frequency higher or lower than the overall codon frequency in the corresponding subsequence of the reference nucleic acid sequence at a specific location, for example, at the 5' end or 3' end of the sequence optimized nucleic acid, or within a predetermined distance from those region (e.g., at least 1, 2, 3, 4, 5, 6, 7, 8, 9, 10, 15, 20, 25, 30, 35, 40, 45, 50, 55, 60, 65, 70, 75, 80, 85, 90, 95 or 100 codons from the 5' end or 3' end of the sequence optimized nucleic acid).

In some embodiments, an sequence optimized nucleic acid encoding an immune response primer, an immune response co-stimulatory signal, or a checkpoint inhibitor polypeptide can comprise more than one subsequence having an overall codon frequency higher or lower than the overall codon frequency in the corresponding subsequence of the reference nucleic acid sequence. A skilled artisan would understand that subsequences with overall higher or lower overall codon frequencies can be organized in innumerable patterns, depending on whether the overall codon frequency is higher or lower, the length of the subsequence, the distance between subsequences, the location of the subsequences, etc.

See, U.S. Pat. Nos. 5,082,767, 8,126,653, 7,561,973, 8,401,798; U.S. Publ. No. US 20080046192, US 20080076161; Int'l. Publ. No. WO2000018778; Welch et al. (2009) PLoS ONE 4(9): e7002; Gustafsson et al. (2012) Protein Expression and Purification 83: 37-46; Chung et al. (2012) BMC Systems Biology 6:134; all of which are incorporated herein by reference in their entireties.

d. Destabilizing Motif Substitution

There is a variety of motifs that can affect sequence optimization, which fall into various non-exclusive categories, for example:

(i) Primary sequence based motifs: Motifs defined by a simple arrangement of nucleotides.

(ii) Structural motifs: Motifs encoded by an arrangement of nucleotides that tends to form a certain secondary structure.

(iii) Local motifs: Motifs encoded in one contiguous subsequence.

(iv) Distributed motifs: Motifs encoded in two or more disjoint subsequences.

(v) Advantageous motifs: Motifs which improve nucleotide structure or function.

(vi) Disadvantageous motifs: Motifs with detrimental effects on nucleotide structure or function.

There are many motifs that fit into the category of disadvantageous motifs. Some examples include, for example, restriction enzyme motifs, which tend to be relatively short, exact sequences such as the restriction site motifs for Xba1 (TCTAGA), EcoRI (GAATTC), EcoRII (CCWGG, wherein W means A or T, per the IUPAC ambiguity codes), or HindIII (AAGCTT); enzyme sites, which tend to be longer and based on consensus not exact sequence, such in the T7 RNA polymerase (GnnnnWnCRnCTCnCnnWnD, wherein n means any nucleotide, R means A or G, W means A or T, D means A or G or T but not C); structural motifs, such as GGGG repeats (Kim et al. (1991) Nature 351(6324):331-2); or other motifs such as CUG-triplet repeats (Querido et al. (2014) J. Cell Sci. 124:1703-1714).

Accordingly, the nucleic acid sequence encoding an immune response primer, an immune response co-stimulatory signal, or a checkpoint inhibitor polypeptide e disclosed herein can be sequence optimized using methods comprising substituting at least one destabilizing motif in a reference nucleic acid sequence, and removing such disadvantageous motif or replacing it with an advantageous motif.

In some embodiments, the optimization process comprises identifying advantageous and/or disadvantageous motifs in the reference nucleic sequence, wherein such motifs are, e.g., specific subsequences that can cause a loss of stability in the reference nucleic acid sequence prior or during the optimization process. For example, substitution of specific bases during optimization may generate a subsequence (motif) recognized by a restriction enzyme. Accordingly, during the optimization process the appearance of disadvantageous motifs can be monitored by comparing the sequence optimized sequence with a library of motifs known to be disadvantageous. Then, the identification of disadvantageous motifs could be used as a post-hoc filter, i.e., to determine whether a certain modification which potentially could be introduced in the reference nucleic acid sequence should be actually implemented or not.

In some embodiments, the identification of disadvantageous motifs can be used prior to the application of the sequence optimization methods disclosed herein, i.e., the identification of motifs in the reference nucleic acid sequence encoding an immune response primer, an immune response co-stimulatory signal, or a checkpoint inhibitor polypeptide and their replacement with alternative nucleic acid sequences can be used as a preprocessing step, for example, before uridine reduction.

In other embodiments, the identification of disadvantageous motifs and their removal is used as an additional sequence optimization technique integrated in a multiparametric nucleic acid optimization method comprising two or more of the sequence optimization methods disclosed herein. When used in this fashion, a disadvantageous motif identified during the optimization process would be removed, for example, by substituting the lowest possible number of nucleobases in order to preserve as closely as possible the original design principle(s) (e.g., low U, high frequency, etc.).

See, e.g., U.S. Publ. Nos. US20140228558, US20050032730, or US20140228558, which are herein incorporated by reference in their entireties.

e. Limited Codon Set Optimization

In some particular embodiments, sequence optimization of a reference nucleic acid sequence encoding an immune response primer, an immune response co-stimulatory signal, or a checkpoint inhibitor polypeptide can be conducted using a limited codon set, e.g., a codon set wherein less than the native number of codons is used to encode the 20 natural amino acids, a subset of the 20 natural amino acids, or an expanded set of amino acids including, for example, non-natural amino acids.

The genetic code is highly similar among all organisms and can be expressed in a simple table with 64 entries which would encode the 20 standard amino acids involved in protein translation plus start and stop codons. The genetic code is degenerate, i.e., in general, more than one codon specifies each amino acid. For example, the amino acid leucine is specified by the UUA, UUG, CUU, CUC, CUA, or CUG codons, while the amino acid serine is specified by UCA, UCG, UCC, UCU, AGU, or AGC codons (difference in the first, second, or third position). Native genetic codes comprise 62 codons encoding naturally occurring amino acids. Thus, in some embodiments of the methods disclosed herein optimized codon sets (genetic codes) comprising less than 62 codons to encode 20 amino acids can comprise 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 30, 29, 28, 27, 26, 25, 24, 23, 22, 21, or 20 codons.

In some embodiments, the limited codon set comprises less than 20 codons. For example, if a protein contains less than 20 types of amino acids, such protein could be encoded by a codon set with less than 20 codons. Accordingly, in some embodiments, an optimized codon set comprises as many codons as different types of amino acids are present in the protein encoded by the reference nucleic acid sequence. In some embodiments, the optimized codon set comprises 19, 18, 17, 16, 15, 14, 13, 12, 11, 10, 9, 8, 7, 6, 5, 4, 3, 2 or even 1 codon.

In some embodiments, at least one amino acid selected from the group consisting of Ala, Arg, Asn, Asp, Cys, Gln, Glu, Gly, His, Ile, Leu, Lys, Phe, Pro, Ser, Thr, Tyr, and Val, i.e., amino acids which are naturally encoded by more than one codon, is encoded with less codons than the naturally occurring number of synonymous codons. For example, in some embodiments, Ala can be encoded in the sequence optimized nucleic acid by 3, 2 or 1 codons; Cys can be encoded in the sequence optimized nucleic acid by 1 codon; Asp can be encoded in the sequence optimized nucleic acid by 1 codon; Glu can be encoded in the sequence optimized nucleic acid by 1 codon; Phe can be encoded in the sequence optimized nucleic acid by 1 codon; Gly can be encoded in the sequence optimized nucleic acid by 3 codons, 2 codons or 1 codon; His can be encoded in the sequence optimized nucleic acid by 1 codon; Ile can be encoded in the sequence optimized nucleic acid by 2 codons or 1 codon; Lys can be encoded in the sequence optimized nucleic acid by 1 codon; Leu can be encoded in the sequence optimized nucleic acid by 5 codons, 4 codons, 3 codons, 2 codons or 1 codon; Asn can be encoded in the sequence optimized nucleic acid by 1 codon; Pro can be encoded in the sequence optimized nucleic acid by 3 codons, 2 codons, or 1 codon; Gln can be encoded in the sequence optimized nucleic acid by 1 codon; Arg can be encoded in the sequence optimized nucleic acid by 5 codons, 4 codons, 3 codons, 2 codons, or 1 codon; Ser can be encoded in the sequence optimized nucleic acid by 5 codons, 4 codons, 3 codons, 2 codons, or 1 codon; Thr can be encoded in the sequence optimized nucleic acid by 3 codons, 2 codons, or 1 codon; Val can be encoded in the sequence optimized nucleic acid by 3 codons, 2 codons, or 1 codon; and, Tyr can be encoded in the sequence optimized nucleic acid by 1 codon.

In some embodiments, at least one amino acid selected from the group consisting of Ala, Arg, Asn, Asp, Cys, Gln, Glu, Gly, His, Ile, Leu, Lys, Phe, Pro, Ser, Thr, Tyr, and Val, i.e., amino acids which are naturally encoded by more than one codon, is encoded by a single codon in the limited codon set.

In some specific embodiments, the sequence optimized nucleic acid is a DNA and the limited codon set consists of 20 codons, wherein each codon encodes one of 20 amino acids. In some embodiments, the sequence optimized nucleic acid is a DNA and the limited codon set comprises at least one codon selected from the group consisting of GCT, GCC, GCA, and GCG; at least a codon selected from the group consisting of CGT, CGC, CGA, CGG, AGA, and AGG; at least a codon selected from AAT or ACC; at least a codon selected from GAT or GAC; at least a codon selected from TGT or TGC; at least a codon selected from CAA or CAG; at least a codon selected from GAA or GAG; at least a codon selected from the group consisting of GGT, GGC, GGA, and GGG; at least a codon selected from CAT or CAC; at least a codon selected from the group consisting of ATT, ATC, and ATA; at least a codon selected from the group consisting of TTA, TTG, CTT, CTC, CTA, and CTG; at least a codon selected from AAA or AAG; an ATG codon; at least a codon selected from TTT or TTC; at least a codon selected from the group consisting of CCT, CCC, CCA, and CCG; at least a codon selected from the group consisting of TCT, TCC, TCA, TCG, AGT, and AGC; at least a codon selected from the group consisting of ACT, ACC, ACA, and ACG; a TGG codon; at least a codon selected from TAT or TAC; and, at least a codon selected from the group consisting of GTT, GTC, GTA, and GTG.

In other embodiments, the sequence optimized nucleic acid is an RNA (e.g., an mRNA) and the limited codon set consists of 20 codons, wherein each codon encodes one of 20 amino acids. In some embodiments, the sequence optimized nucleic acid is an RNA and the limited codon set comprises at least one codon selected from the group consisting of GCU, GCC, GCA, and GCG; at least a codon selected from the group consisting of CGU, CGC, CGA, CGG, AGA, and AGG; at least a codon selected from AAU or ACC; at least a codon selected from GAU or GAC; at least a codon selected from UGU or UGC; at least a codon selected from CAA or CAG; at least a codon selected from GAA or GAG; at least a codon selected from the group consisting of GGU, GGC, GGA, and GGG; at least a codon selected from CAU or CAC; at least a codon selected from the group consisting of AUU, AUC, and AUA; at least a codon selected from the group consisting of UUA, UUG, CUU, CUC, CUA, and CUG; at least a codon selected from AAA or AAG; an AUG codon; at least a codon selected from UUU or UUC; at least a codon selected from the group consisting of CCU, CCC, CCA, and CCG; at least a codon selected from the group consisting of UCU, UCC, UCA, UCG, AGU, and AGC; at least a codon selected from the group consisting of ACU, ACC, ACA, and ACG; a UGG codon; at least a codon selected from UAU or UAC; and, at least a codon selected from the group consisting of GUU, GUC, GUA, and GUG.

In some specific embodiments, the limited codon set has been optimized for in vivo expression of a sequence optimized nucleic acid (e.g., a synthetic mRNA) following administration to a certain tissue or cell.

In some embodiments, the optimized codon set (e.g., a 20 codon set encoding 20 amino acids) complies at least with one of the following properties:

(i) the optimized codon set has a higher average G/C content than the original or native codon set; or, (ii) the optimized codon set has a lower average U content than the original or native codon set; or, (iii) the optimized codon set is composed of codons with the highest frequency; or, (iv) the optimized codon set is composed of codons with the lowest frequency; or, (v) a combination thereof.

In some specific embodiments, at least one codon in the optimized codon set has the second highest, the third highest, the fourth highest, the fifth highest or the sixth highest frequency in the synonymous codon set. In some specific embodiments, at least one codon in the optimized codon has the second lowest, the third lowest, the fourth lowest, the fifth lowest, or the sixth lowest frequency in the synonymous codon set.

As used herein, the term "native codon set" refers to the codon set used natively by the source organism to encode the reference nucleic acid sequence. As used herein, the term "original codon set" refers to the codon set used to encode the reference nucleic acid sequence before the beginning of sequence optimization, or to a codon set used to encode an optimized variant of the reference nucleic acid sequence at the beginning of a new optimization iteration when sequence optimization is applied iteratively or recursively.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest frequency. In other embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest frequency.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest uridine content. In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest uridine content.

In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average G/C content (absolute or relative) of the original codon set. In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average G/C content (absolute or relative) of the original codon set.

In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average uracil content (absolute or relative) of the original codon set. In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average uracil content (absolute or relative) of the original codon set.

See also U.S. Appl. Publ. No. 2011/0082055, and Int'l. Publ. No. WO2000018778, both of which are incorporated herein by reference in their entireties.

VII. CHARACTERIZATION OF SEQUENCE OPTIMIZED NUCLEIC ACIDS

In some embodiments of the disclosure, the polynucleotide (e.g., a RNA, e.g., an mRNA) comprising a sequence optimized nucleic acid disclosed herein encoding an immune response primer, an immune response co-stimulatory signal, or a checkpoint inhibitor polypeptide can be can be tested to determine whether at least one nucleic acid sequence property (e.g., stability when exposed to nucleases) or expression property has been improved with respect to the non-sequence optimized nucleic acid.

As used herein, "expression property" refers to a property of a nucleic acid sequence either in vivo (e.g., translation efficacy of a synthetic mRNA after administration to a subject in need thereof) or in vitro (e.g., translation efficacy of a synthetic mRNA tested in an in vitro model system). Expression properties include but are not limited to the amount of protein produced by an mRNA encoding an immune response primer, an immune response co-stimulatory signal, or a checkpoint inhibitor polypeptide after administration, and the amount of soluble or otherwise functional protein produced. In some embodiments, sequence optimized nucleic acids disclosed herein can be evaluated according to the viability of the cells expressing a protein encoded by a sequence optimized nucleic acid sequence (e.g., a RNA, e.g., an mRNA) encoding an immune response primer, an immune response co-stimulatory signal, or a checkpoint inhibitor polypeptide disclosed herein.

In a particular embodiment, a plurality of sequence optimized nucleic acids disclosed herein (e.g., a RNA, e.g., an mRNA) containing codon substitutions with respect to the non-optimized reference nucleic acid sequence can be characterized functionally to measure a property of interest, for example an expression property in an in vitro model system, or in vivo in a target tissue or cell.

a. Optimization of Nucleic Acid Sequence Intrinsic Properties

In some embodiments of the disclosure, the desired property of the polynucleotide is an intrinsic property of the nucleic acid sequence. For example, the nucleotide sequence (e.g., a RNA, e.g., an mRNA) can be sequence optimized for in vivo or in vitro stability. In some embodiments, the nucleotide sequence can be sequence optimized for expression in a particular target tissue or cell. In some embodiments, the nucleic acid sequence is sequence optimized to increase its plasma half by preventing its degradation by endo and exonucleases.

In other embodiments, the nucleic acid sequence is sequence optimized to increase its resistance to hydrolysis in solution, for example, to lengthen the time that the sequence optimized nucleic acid or a pharmaceutical composition comprising the sequence optimized nucleic acid can be stored under aqueous conditions with minimal degradation.

In other embodiments, the sequence optimized nucleic acid can be optimized to increase its resistance to hydrolysis in dry storage conditions, for example, to lengthen the time that the sequence optimized nucleic acid can be stored after lyophilization with minimal degradation.

b. Nucleic Acids Sequence Optimized for Protein Expression

In some embodiments of the disclosure, the desired property of the polynucleotide is the level of expression of an immune response primer, an immune response co-stimulatory signal, or a checkpoint inhibitor polypeptide encoded by a sequence optimized sequence disclosed herein. Protein expression levels can be measured using one or more expression systems. In some embodiments, expression can be measured in cell culture systems, e.g., CHO cells or HEK293 cells. In some embodiments, expression can be measured using in vitro expression systems prepared from extracts of living cells, e.g., rabbit reticulocyte lysates, or in vitro expression systems prepared by assembly of purified individual components. In other embodiments, the protein expression is measured in an in vivo system, e.g., mouse, rabbit, monkey, etc.

In some embodiments, protein expression in solution form can be desirable. Accordingly, in some embodiments, a reference sequence can be sequence optimized to yield a sequence optimized nucleic acid sequence having optimized levels of expressed proteins in soluble form. Levels of protein expression and other properties such as solubility, levels of aggregation, and the presence of truncation products (i.e., fragments due to proteolysis, hydrolysis, or defective translation) can be measured according to methods known in the art, for example, using electrophoresis (e.g., native or SDS-PAGE) or chromatographic methods (e.g., HPLC, size exclusion chromatography, etc.).

c. Optimization of Target Tissue or Target Cell Viability

In some embodiments, the expression of heterologous therapeutic proteins encoded by a nucleic acid sequence can have deleterious effects in the target tissue or cell, reducing protein yield, or reducing the quality of the expressed product (e.g., due to the presence of protein fragments or precipitation of the expressed protein in inclusion bodies), or causing toxicity.

Accordingly, in some embodiments of the disclosure, the sequence optimization of a nucleic acid sequence disclosed herein, e.g., a nucleic acid sequence encoding an immune response primer, an immune response co-stimulatory signal, or a checkpoint inhibitor polypeptide, can be used to increase the viability of target cells expressing the protein encoded by the sequence optimized nucleic acid.

Heterologous protein expression can also be deleterious to cells transfected with a nucleic acid sequence for autologous or heterologous transplantation. Accordingly, in some embodiments of the present disclosure the sequence optimization of a nucleic acid sequence disclosed herein can be used to increase the viability of target cells expressing the protein encoded by the sequence optimized nucleic acid sequence. Changes in cell or tissue viability, toxicity, and other physiological reaction can be measured according to methods known in the art.

d. Reduction of Immune and/or Inflammatory Response

In some cases, the administration of a sequence optimized nucleic acid encoding an immune response primer, an immune response co-stimulatory signal, a checkpoint inhibitor polypeptide, or a combination thereof may trigger an immune response, which could be caused by (i) the therapeutic agent (e.g., an mRNA combination therapy encoding an immune response primer and/or an immune response co-stimulatory signal and/or a checkpoint inhibitor polypeptide, or a combination thereof), or (ii) the expression product of such therapeutic agent, or (iv) a combination thereof. Accordingly, in some embodiments of the present disclosure the sequence optimization of nucleic acid sequence (e.g., an mRNA) disclosed herein can be used to decrease an immune or inflammatory response triggered by the administration of a nucleic acid encoding an immune response primer, an immune response co-stimulatory signal, or a checkpoint inhibitor polypeptide or by the expression product of the immune response primer, immune response co-stimulatory signal, or checkpoint inhibitor polypeptide encoded by such nucleic acid.

In some aspects, an inflammatory response can be measured by detecting increased levels of one or more inflammatory cytokines using methods known in the art, e.g., ELISA. The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-13 (IL-13), interferon a (IFN-α), etc.

VIII. MICRO-RNA BINDING SITES

The polynucleotide(s), e.g., mRNA(s), encoding the immune response primer, immune response co-stimulatory signal, or checkpoint inhibitor polypeptides in the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) can comprise, in addition to the ORFs encoding immune response primer, immune response co-stimulatory signal, or checkpoint inhibitor polypeptides, one or more microRNA binding sites.

microRNAs (or miRNA) are 19-25 nucleotides long noncoding RNAs that bind to the 3'UTR of nucleic acid molecules and down-regulate gene expression either by reducing nucleic acid molecule stability or by inhibiting translation. By engineering microRNA target sequences into the polynucleotides (e.g., in a 3'UTR like region or other region) of the disclosure, one can target the molecule for degradation or reduced translation, provided the microRNA in question is available. In one embodiment, the miRNA binding site (e.g., miR-122 binding site) binds to the corresponding mature miRNA that is part of an active RNA-induced silencing complex (RISC) containing Dicer. In another embodiment, binding of the miRNA binding site to the corresponding miRNA in RISC degrades the mRNA containing the miRNA binding site or prevents the mRNA from being translated.

As used herein, the term "microRNA binding site" refers to a microRNA target site or a microRNA recognition site, or any nucleotide sequence to which a microRNA binds or associates. It should be understood that "binding" can follow traditional Watson-Crick hybridization rules or can reflect any stable association of the microRNA with the target sequence at or adjacent to the microRNA site.

Some microRNAs, e.g., miR-122, are abundant in normal tissue but are present in much lower levels in cancer or tumor tissue. Thus, engineering microRNA target sequences (i.e., microRNA binding site) into the polynucleotides encoding immune response primers, immune response co-stimulatory signals, or checkpoint inhibitor polypeptides (e.g., in a 3'UTR like region or other region) can effectively target the molecule for degradation or reduced translation in normal tissue (where the microRNA is abundant) while providing high levels of translation in the cancer or tumor tissue (where the microRNA is present in much lower levels). This provides a tumor-targeting approach for the methods and compositions of the disclosure.

In some embodiments, the microRNA binding site (e.g., miR-122 binding site) is fully complementary to miRNA (e.g., miR-122), thereby degrading the mRNA fused to the miRNA binding site. In other embodiments, the miRNA binding site is not fully complementary to the corresponding miRNA. In certain embodiments, the miRNA binding site (e.g., miR-122 binding site) is the same length as the corresponding miRNA (e.g., miR-122). In other embodiments, the microRNA binding site (e.g., miR-122 binding site) is one nucleotide shorter than the corresponding microRNA (e.g., miR-122, which has 22 nts) at the 5' terminus, the 3' terminus, or both. In still other embodiments, the microRNA binding site (e.g., miR-122 binding site) is two nucleotides shorter than the corresponding microRNA (e.g., miR-122) at the 5' terminus, the 3' terminus, or both. In yet other embodiments, the microRNA binding site (e.g., miR-122 binding site) is three nucleotides shorter than the corresponding microRNA (e.g., miR-122) at the 5' terminus, the 3' terminus, or both. In some embodiments, the microRNA binding site (e.g., miR-122 binding site) is four nucleotides shorter than the corresponding microRNA (e.g., miR-122) at the 5' terminus, the 3' terminus, or both. In other embodiments, the microRNA binding site (e.g., miR-122 binding site) is five nucleotides shorter than the corresponding microRNA (e.g., miR-122) at the 5' terminus, the 3' terminus, or both. In some embodiments, the microRNA binding site (e.g., miR-122 binding site) is six nucleotides shorter than the corresponding microRNA (e.g., miR-122) at the 5' terminus, the 3' terminus, or both. In other embodiments, the microRNA binding site (e.g., miR-122 binding site) is seven nucleotides shorter than the corresponding microRNA (e.g., miR-122) at the 5' terminus or the 3' terminus. In other embodiments, the microRNA binding site (e.g., miR-122 binding site) is eight nucleotides shorter than the corresponding microRNA (e.g., miR-122) at the 5' terminus or the 3' terminus. In other embodiments, the microRNA binding site (e.g., miR-122 binding site) is nine nucleotides shorter than the corresponding microRNA (e.g., miR-122) at the 5' terminus or the 3' terminus. In other embodiments, the microRNA binding site (e.g., miR-122 binding site) is ten nucleotides shorter than the corresponding microRNA (e.g., miR-122) at the 5' terminus or the 3' terminus. In other embodiments, the microRNA binding site (e.g., miR-122 binding site) is eleven nucleotides shorter than the corresponding microRNA (e.g., miR-122) at the 5' terminus or the 3' terminus. In other embodiments, the microRNA binding site (e.g., miR-122 binding site) is twelve nucleotides shorter than the corresponding microRNA (e.g., miR-122) at the 5' terminus or the 3' terminus. The miRNA binding sites that are shorter than the corresponding miRNAs are still capable of degrading the mRNA incorporating one or more of the miRNA binding sites or preventing the mRNA from translation.

In some embodiments, the microRNA binding site (e.g., miR-122 binding site) has sufficient complementarity to miRNA (e.g., miR-122) so that a RISC complex comprising the miRNA (e.g., miR-122) cleaves the polynucleotide comprising the microRNA binding site. In other embodiments, the microRNA binding site (e.g., miR-122 binding site) has imperfect complementarity so that a RISC complex comprising the miRNA (e.g., miR-122) induces instability in the polynucleotide comprising the microRNA binding site. In another embodiment, the microRNA binding site (e.g., miR-122 binding site) has imperfect complementarity so that a RISC complex comprising the miRNA (e.g., miR-122) represses transcription of the polynucleotide comprising the microRNA binding site. In one embodiment, the miRNA binding site (e.g., miR-122 binding site) has one mismatch from the corresponding miRNA (e.g., miR-122). In another embodiment, the miRNA binding site has two mismatches from the corresponding miRNA. In other embodiments, the miRNA binding site has three mismatches from the corresponding miRNA. In other embodiments, the miRNA binding site has four mismatches from the corresponding miRNA. In some embodiments, the miRNA binding site has five mismatches from the corresponding miRNA. In other embodiments, the miRNA binding site has six mismatches from the corresponding miRNA. In certain embodiments, the miRNA binding site has seven mismatches from the corresponding miRNA. In other embodiments, the miRNA binding site has eight mismatches from the corresponding miRNA. In other embodiments, the miRNA binding site has nine mismatches from the corresponding miRNA. In other embodiments, the miRNA binding site has ten mismatches from the corresponding miRNA. In other embodiments, the miRNA binding site has eleven mismatches from the corresponding miRNA. In other embodiments, the miRNA binding site has twelve mismatches from the corresponding miRNA.

In certain embodiments, the miRNA binding site (e.g., miR-122 binding site) has at least about ten contiguous nucleotides complementary to at least about ten contiguous nucleotides of the corresponding miRNA (e.g., miR-122), at least about eleven contiguous nucleotides complementary to at least about eleven contiguous nucleotides of the corresponding miRNA, at least about twelve contiguous nucleotides complementary to at least about twelve contiguous nucleotides of the corresponding miRNA, at least about thirteen contiguous nucleotides complementary to at least about thirteen contiguous nucleotides of the corresponding miRNA, or at least about fourteen contiguous nucleotides complementary to at least about fourteen contiguous nucleotides of the corresponding miRNA. In some embodiments, the miRNA binding sites have at least about fifteen contiguous nucleotides complementary to at least about fifteen contiguous nucleotides of the corresponding miRNA, at least about sixteen contiguous nucleotides complementary to at least about sixteen contiguous nucleotides of the corresponding miRNA, at least about seventeen contiguous nucleotides complementary to at least about seventeen contiguous nucleotides of the corresponding miRNA, at least about eighteen contiguous nucleotides complementary to at least about eighteen contiguous nucleotides of the corresponding miRNA, at least about nineteen contiguous nucleotides complementary to at least about nineteen contiguous nucleotides of the corresponding miRNA, at least about twenty contiguous nucleotides complementary to at least about twenty contiguous nucleotides of the corresponding miRNA, or at least about twenty one contiguous nucleotides complementary to at least about twenty one contiguous nucleotides of the corresponding miRNA.

In some embodiments, the polynucleotide comprise an mRNA encoding an immune response primer, an immune response co-stimulatory signal, or a checkpoint inhibitor polypeptide comprising at least one miR-122 binding site, at least two miR-122 binding sites, at least three miR-122 binding sites, at least four miR-122 binding sites, or at least five miR-122 binding sites. In one aspect, the miRNA binding site binds miR-122 or is complementary to miR-122. In another aspect, the miRNA binding site binds to miR-122-3p or miR-122-5p. In a particular aspect, the miRNA binding site comprises a nucleotide sequence at least 80%, at least 85%, at least 90%, at least 95%, or 100% identical to SEQ ID NO: 1213, wherein the miRNA binding site binds to miR-122. In another particular aspect, the miRNA binding site comprises a nucleotide sequence at least 80%, at least 85%, at least 90%, at least 95%, or 100% identical to SEQ ID NO: 1215, wherein the miRNA binding site binds to miR-122. These sequences are shown below in TABLE 19.

TABLE 19 miR-122 and miR-122 binding sites

| SEQ ID NO. | Description | Sequence |
|---|---|---|
| 1211 | miR-122 | CCUUAGCAGAGCUGUGGAGUGUGACAAUGGUGUUUGUGUCUAAACUAUCAAACGCCAUUAUCACACUAAAUAGCUACUGCUAGGC |
| 1212 | miR-122-3p | AACGCCAUUAUCACACUAAAUA |
| 1213 | miR-122-3p binding site | UAUUUAGUGUGAUAAUGGCGUU |
| 1214 | miR-122-5p | UGGAGUGUGACAAUGGUGUUUG |
| 1215 | miR-122-5p binding site | CAAACACCAUUGUCACACUCCA |

In some embodiments, a miRNA binding site (e.g., miR-122 binding site) is inserted in the polynucleotide of the disclosure in any position of the polynucleotide (e.g., 3' UTR); the insertion site in the polynucleotide can be anywhere in the polynucleotide as long as the insertion of the miRNA binding site in the polynucleotide does not interfere with the translation of the functional immune response primer, immune response co-stimulatory signal, or a checkpoint inhibitor polypeptide in the absence of the corresponding miRNA (e.g., miR122); and in the presence of the miRNA (e.g., miR122), the insertion of the miRNA binding site in the polynucleotide and the binding of the miRNA binding site to the corresponding miRNA are capable of degrading the polynucleotide or preventing the translation of the polynucleotide. In one embodiment, a miRNA binding site is inserted in a 3'UTR of the polynucleotide.

In certain embodiments, a miRNA binding site is inserted in at least about 30 nucleotides downstream from the stop codon of the immune response primer, immune response co-stimulatory signal, or checkpoint inhibitor polypeptide-encoding mRNA. In other embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from the stop codon of the polynucleotide, e.g., the immune response primer, immune response co-stimulatory signal, or checkpoint inhibitor polypeptide-encoding mRNA. In other embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon of the polynucleotide, e.g., the immune response primer, immune response co-stimulatory signal, or checkpoint inhibitor polypeptide-encoding mRNA.

IVT Polynucleotide Architecture

In some embodiments, the polynucleotide of the present disclosure (e.g., an mRNA) comprising an ORF encoding an immune response primer, an immune response co-stimulatory signal, or a checkpoint inhibitor polypeptide is an IVT polynucleotide. Traditionally, the basic components of an mRNA molecule include at least a coding region, a 5'UTR, a 3'UTR, a 5' cap and a poly-A tail. The IVT polynucleotides of the present disclosure can function as mRNA but are distinguished from wild-type mRNA in their functional and/or structural design features which serve, e.g., to overcome existing problems of effective polypeptide production using nucleic-acid based therapeutics.

The primary construct of an IVT polynucleotide comprises a first region of linked nucleotides that is flanked by a first flanking region and a second flaking region. This first region can include, but is not limited to, the encoded immune response primers, immune response co-stimulatory signals, or a checkpoint inhibitor polypeptide. The first flanking region can include a sequence of linked nucleosides which function as a 5' untranslated region (UTR) such as the 5' UTR of any of the nucleic acids encoding the native 5' UTR of the polypeptide or a non-native 5'UTR such as, but not limited to, a heterologous 5' UTR or a synthetic 5' UTR. The IVT polynucleotide encoding an immune response primer, immune response co-stimulatory signal, or checkpoint inhibitor polypeptide can comprise at its 5 terminus a signal sequence region encoding one or more signal sequences. The flanking region can comprise a region of linked nucleotides comprising one or more complete or incomplete 5' UTRs sequences. The flanking region can also comprise a 5' terminal cap. The second flanking region can comprise a region of linked nucleotides comprising one or more complete or incomplete 3' UTR which can be the native 3' UTR of the immune response primer, immune response co-stimulatory signal, or checkpoint inhibitor or a non-native 3' UTR such as, but not limited to, a heterologous 3' UTR or a synthetic 3' UTR. The flanking region can also comprise a 3' tailing sequence. The 3' tailing sequence can be, but is not limited to, a polyA tail, a polyA-G quartet and/or a stem loop sequence.

Bridging the 5' terminus of the first region and the first flanking region is a first operational region. Traditionally, this operational region comprises a Start codon. The operational region can alternatively comprise any translation initiation sequence or signal including a Start codon.

Bridging the 3' terminus of the first region and the second flanking region is a second operational region. Traditionally this operational region comprises a Stop codon. The operational region can alternatively comprise any translation initiation sequence or signal including a Stop codon. Multiple serial stop codons can also be used in the IVT polynucleotide. In some embodiments, the operation region of the present disclosure can comprise two stop codons. The first stop codon can be "TGA" or "UGA" and the second stop codon can be selected from the group consisting of "TAA," "TGA," "TAG," "UAA," "UGA" or "UAG."

The IVT polynucleotide primary construct comprises a first region of linked nucleotides that is flanked by a first flanking region and a second flaking region. As used herein, the "first region" can be referred to as a "coding region" or "region encoding" or simply the "first region." This first region can include, but is not limited to, the encoded polypeptide of interest. In one aspect, the first region can include, but is not limited to, the open reading frame encoding at least one polypeptide of interest. The open reading frame can be codon optimized in whole or in part. The flanking region can comprise a region of linked nucleotides comprising one or more complete or incomplete 5' UTRs sequences which can be completely codon optimized or partially codon optimized. The flanking region can include at least one nucleic acid sequence including, but not limited to, miR sequences, TERZAK™ sequences and translation control sequences. The flanking region can also comprise a 5' terminal cap 138. The 5' terminal capping region can include a naturally occurring cap, a synthetic cap or an optimized cap. The second flanking region can comprise a region of linked nucleotides comprising one or more complete or incomplete 3' UTRs. The second flanking region can be completely codon optimized or partially codon optimized. The flanking region can include at least one nucleic acid sequence including, but not limited to, miR sequences and translation control sequences. After the second flanking region the polynucleotide primary construct can comprise a 3' tailing sequence. The 3' tailing sequence can include a synthetic tailing region and/or a chain terminating nucleoside. Non-liming examples of a synthetic tailing region include a polyA sequence, a polyC sequence, a polyA-G quartet. Non-limiting examples of chain terminating nucleosides include 2'-O methyl, F and locked nucleic acids (LNA).

Bridging the 5' terminus of the first region and the first flanking region is a first operational region. Traditionally this operational region comprises a Start codon. The operational region can alternatively comprise any translation initiation sequence or signal including a Start codon.

Bridging the 3' terminus of the first region and the second flanking region is a second operational region. Traditionally this operational region comprises a Stop codon. The operational region can alternatively comprise any translation initiation sequence or signal including a Stop codon. According to the present disclosure, multiple serial stop codons can also be used.

In some embodiments, the first and second flanking regions of the IVT polynucleotide can range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides or at least 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides).

In some embodiments, the tailing sequence of the IVT polynucleotide can range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length can be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides and 160 nucleotides are functional.

In some embodiments, the capping region of the IVT polynucleotide can comprise a single cap or a series of nucleotides forming the cap. In this embodiment the capping region can be from 1 to 10, e.g. 2-9, 3-8, 4-7, 1-5, 5-10, or at least 2, or 10 or fewer nucleotides in length. In some embodiments, the cap is absent.

In some embodiments, the first and second operational regions of the IVT polynucleotide can range from 3 to 40, e.g., 5-30, 10-20, 15, or at least 4, or 30 or fewer nucleotides in length and can comprise, in addition to a Start and/or Stop codon, one or more signal and/or restriction sequences.

In some embodiments, the IVT polynucleotides can be structurally modified or chemically modified. When the IVT polynucleotides are chemically and/or structurally modified the polynucleotides can be referred to as “modified IVT polynucleotides.”

In some embodiments, if the IVT polynucleotides are chemically modified they can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the IVT polynucleotides can have a uniform chemical modification of two, three, or four of the same nucleoside type throughout the entire polynucleotide (such as all uridines and all cytosines, etc. are modified in the same way).

In some embodiments, the IVT polynucleotides can include a sequence encoding a self-cleaving peptide, described herein, such as but not limited to the 2A peptide. The polynucleotide sequence of the 2A peptide in the IVT polynucleotide can be modified or codon optimized by the methods described herein and/or are known in the art. In some embodiments, this sequence can be used to separate the coding region of two or more polypeptides of interest in the IVT polynucleotide.

Chimeric Polynucleotide Architecture

In some embodiments, the polynucleotide of the present disclosure is a chimeric polynucleotide. The chimeric polynucleotides or RNA constructs disclosed herein maintain a modular organization similar to IVT polynucleotides, but the chimeric polynucleotides comprise one or more structural and/or chemical modifications or alterations which impart useful properties to the polynucleotide. As such, the chimeric polynucleotides which are modified mRNA molecules of the present disclosure are termed “chimeric modified mRNA” or “chimeric mRNA.”

Chimeric polynucleotides have portions or regions which differ in size and/or chemical modification pattern, chemical modification position, chemical modification percent or chemical modification population and combinations of the foregoing.

Examples of parts or regions, where the chimeric polynucleotide functions as an mRNA and encodes an immune response primer, immune response co-stimulatory signal, or checkpoint inhibitor polypeptide, but is not limited to, untranslated regions (UTRs, such as the 5' UTR or 3' UTR), coding regions, cap regions, polyA tail regions, start regions, stop regions, signal sequence regions, and combinations thereof. Regions or parts that join or lie between other regions can also be designed to have subregions.

In some embodiments, the chimeric polynucleotides of the disclosure have a structure comprising according to the following schema:

5'[An]x-L1-[Bo]y-L2-[Cp]z-L33' wherein:

each of A and B independently comprise a region of linked nucleosides, e.g., a 5' UTR and/or a 3' UTR;

either A or B or both A and B encode an immune response primer, immune response co-stimulatory signal, or checkpoint inhibitor polypeptide described elsewhere herein, or components thereof;

C is an optional region of linked nucleosides, e.g., a poly A tail;

at least one of regions A, B, or C is positionally modified, wherein said positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications;

n, o and p are independently an integer between 15-1000;

x and y are independently 1-20;

z is 0-5;

L1 and L2 are independently optional linker moieties, said linker moieties being either nucleic acid based or non-nucleic acid based; and L3 is an optional conjugate or an optional linker moiety, said linker moiety being either nucleic acid based or non-nucleic acid based.

In some embodiments, at least one of the regions of linked nucleosides of A comprises a sequence of linked nucleosides which can function as a 5' untranslated region (UTR). The sequence of linked nucleosides can be a natural or synthetic 5' UTR. As a non-limiting example, the chimeric polynucleotide can encode an immune response primer, immune response co-stimulatory signal, or checkpoint inhibitor polypeptide, and the sequence of linked nucleosides of A can encode the native 5' UTR of the immune response primer, immune response co-stimulatory signal, or checkpoint inhibitor polypeptide or a non-heterologous 5' UTR such as, but not limited to a synthetic UTR.

In another embodiment, at least one of the regions of linked nucleosides of A is a cap region. The cap region can be located 5' to a region of linked nucleosides of A functioning as a 5'UTR. The cap region can comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In some embodiments, the polynucleotide of the disclosure comprises a Cap1 5'UTR. In some embodiments, a polynucleotide comprising 5'UTR sequence, e.g., Cap1, for encoding an immune response primer, immune response co-stimulatory signal, or checkpoint inhibitor polypeptide disclosed herein increases expression of the immune response primer, immune response co-stimulatory signal, or checkpoint inhibitor polypeptide compared to a polynucleotide encoding the immune response primer, immune response co-stimulatory signal, or checkpoint inhibitor polypeptide comprising a different 5'UTR (e.g., Cap0, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 or Cap4). In some embodiments, a polynucleotide comprises the Cap1 5'UTR, wherein the polynucleotide encodes an immune response primer, immune response co-stimulatory signal, or checkpoint inhibitor polypeptide. In some embodiments, polynucleotide comprising the Cap1 5'UTR, increases immune response primer, immune response co-stimulatory signal, or checkpoint inhibitor polypeptide expression.

In some embodiments, at least one of the regions of linked nucleosides of B comprises at least one open reading frame of a nucleic acid sequence encoding an immune response primer, immune response co-stimulatory signal, or checkpoint inhibitor polypeptide. The nucleic acid sequence can be codon optimized and/or comprise at least one modification.

In some embodiments, at least one of the regions of linked nucleosides of C comprises a sequence of linked nucleosides which can function as a 3' UTR. The sequence of linked nucleosides can be a natural or synthetic 3' UTR. As a non-limiting example, the chimeric polynucleotide can encode an immune response primer, immune response co-stimulatory signal, or checkpoint inhibitor polypeptide, and the sequence of linked nucleosides of C can encode the native 3' UTR of an immune response primer, immune response co-stimulatory signal, or checkpoint inhibitor polypeptide or a non-heterologous 3' UTR such as, but not limited to a synthetic UTR.

In some embodiments, at least one of the regions of linked nucleosides of A comprises a sequence of linked nucleosides which functions as a 5' UTR and at least one of the regions of linked nucleosides of C comprises a sequence of linked nucleosides which functions as a 3' UTR. In some embodiments, the 5' UTR and the 3' UTR can be from the same or different species. In another embodiment, the 5' UTR and the 3' UTR can encode the native untranslated regions from different proteins from the same or different species.

Chimeric polynucleotides, including the parts or regions thereof, of the present disclosure can be classified as hemimers, gapmers, wingmers, or blockmers.

As used herein, a "hemimer" is a chimeric polynucleotide comprising a region or part which comprises half of one pattern, percent, position or population of a chemical modification(s) and half of a second pattern, percent, position or population of a chemical modification(s). Chimeric polynucleotides of the present disclosure can also comprise hemimer subregions. In some embodiments, a part or region is 50% of one and 50% of another.

In some embodiments, the entire chimeric polynucleotide is 50% of one and 50% of the other. Any region or part of any chimeric polynucleotide of the disclosure can be a hemimer. Types of hemimers include pattern hemimers, population hemimers or position hemimers. By definition, hemimers are 50:50 percent hemimers.

As used herein, a "gapmer" is a chimeric polynucleotide having at least three parts or regions with a gap between the parts or regions. The "gap" can comprise a region of linked nucleosides or a single nucleoside which differs from the chimeric nature of the two parts or regions flanking it. The two parts or regions of a gapmer can be the same or different from each other.

As used herein, a "wingmer" is a chimeric polynucleotide having at least three parts or regions with a gap between the parts or regions. Unlike a gapmer, the two flanking parts or regions surrounding the gap in a wingmer are the same in degree or kind. Such similarity can be in the length of number of units of different modifications or in the number of modifications. The wings of a wingmer can be longer or shorter than the gap. The wing parts or regions can be 20, 30, 40, 50, 60 70, 80, 90 or 95% greater or shorter in length than the region which comprises the gap.

As used herein, a "blockmer" is a patterned polynucleotide where parts or regions are of equivalent size or number and type of modifications. Regions or subregions in a blockmer can be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides long.

Chimeric polynucleotides, including the parts or regions thereof, of the present disclosure having a chemical modification pattern are referred to as "pattern chimeras." Pattern chimeras can also be referred to as blockmers. Pattern chimeras are those polynucleotides having a pattern of modifications within, across or among regions or parts.

Patterns of modifications within a part or region are those which start and stop within a defined region. Patterns of modifications across a part or region are those patterns which start in on part or region and end in another adjacent part or region. Patterns of modifications among parts or regions are those which begin and end in one part or region and are repeated in a different part or region, which is not necessarily adjacent to the first region or part.

The regions or subregions of pattern chimeras or blockmers can have simple alternating patterns such as ABAB [AB]n where each "A" and each "B" represent different chemical modifications (at least one of the base, sugar or backbone linker), different types of chemical modifications (e.g., naturally occurring and non-naturally occurring), different percentages of modifications or different populations of modifications. The pattern can repeat n number of times where n=3-300. Further, each A or B can represent from 1-2500 units (e.g., nucleosides) in the pattern. Patterns can also be alternating multiples such as AABBAABB[AABB]n (an alternating double multiple) or AAABBBAAABBB [AAABBB]n (an alternating triple multiple) pattern. The pattern can repeat n number of times where n=3-300.

Different patterns can also be mixed together to form a second order pattern. For example, a single alternating pattern can be combined with a triple alternating pattern to form a second order alternating pattern A'B'. One example would be [ABABAB][AAABBBAAABBB][ABABAB][AAABBBAAABBB][ABABAB][AAABBBAAABBB], where [ABABAB] is A' and [AAABBBAAABBB] is B'. In like fashion, these patterns can be repeated n number of times, where n=3-300.

Patterns can include three or more different modifications to form an ABCABC[ABC]n pattern. These three component patterns can also be multiples, such as AABBCCAABBCC[AABBCC]n and can be designed as combinations with other patterns such as ABCABCAABBCCABCABCAABBCC, and can be higher order patterns.

Regions or subregions of position, percent, and population modifications need not reflect an equal contribution from each modification type. They can form series such as "1-2-3-4", "1-2-4-8", where each integer represents the number of units of a particular modification type. Alternatively, they can be odd only, such as "1-3-3-1-3-1-5" or even only "2-4-2-4-6-4-8" or a mixture of both odd and even number of units such as "1-3-4-2-5-7-3-3-4".

Pattern chimeras can vary in their chemical modification by degree (such as those described above) or by kind (e.g., different modifications).

Chimeric polynucleotides, including the parts or regions thereof, of the present disclosure having at least one region with two or more different chemical modifications of two or more nucleoside members of the same nucleoside type (A, C, G, T, or U) are referred to as "positionally modified" chimeras. Positionally modified chimeras are also referred to herein as "selective placement" chimeras or "selective placement polynucleotides". As the name implies, selective placement refers to the design of polynucleotides which, unlike polynucleotides in the art where the modification to any A, C, G, T or U is the same by virtue of the method of synthesis, can have different modifications to the individual As, Cs, Gs, Ts or Us in a polynucleotide or region thereof. For example, in a positionally modified chimeric polynucleotide, there can be two or more different chemical modifications to any of the nucleoside types of As, Cs, Gs, Ts, or Us. There can also be combinations of two or more to any two or more of the same nucleoside type. For example, a positionally modified or selective placement chimeric polynucleotide can comprise 3 different modifications to the population of adenines in the molecule and also have 3 different modifications to the population of cytosines in the construct—all of which can have a unique, non-random, placement.

Chimeric polynucleotides, including the parts or regions thereof, of the present disclosure having a chemical modification percent are referred to as "percent chimeras." Percent chimeras can have regions or parts which comprise at least 1%, at least 2%, at least 5%, at least 8%, at least 10%, at least 20%, at least 30%, at least 40%, at least 50%, at least 60%, at least 70%, at least 80%, at least 90%, at least 95%, or at least 99% positional, pattern or population of modifications. Alternatively, the percent chimera can be completely modified as to modification position, pattern, or population. The percent of modification of a percent chimera can be split between naturally occurring and non-naturally occurring modifications.

Chimeric polynucleotides, including the parts or regions thereof, of the present disclosure having a chemical modification population are referred to as "population chimeras." A population chimera can comprise a region or part where nucleosides (their base, sugar or backbone linkage, or combination thereof) have a select population of modifications. Such modifications can be selected from functional populations such as modifications which induce, alter or modulate a phenotypic outcome. For example, a functional population can be a population or selection of chemical modifications which increase the level of a cytokine. Other functional populations can individually or collectively function to decrease the level of one or more cytokines. Use of a selection of these like-function modifications in a chimeric polynucleotide would therefore constitute a "functional population chimera." As used herein, a "functional population chimera" can be one whose unique functional feature is defined by the population of modifications as described above or the term can apply to the overall function of the chimeric polynucleotide itself. For example, as a whole the chimeric polynucleotide can function in a different or superior way as compared to an unmodified or non-chimeric polynucleotide.

It should be noted that polynucleotides which have a uniform chemical modification of all of any of the same nucleoside type or a population of modifications produced by mere downward titration of the same starting modification in all of any of the same nucleoside type, or a measured percent of a chemical modification of all any of the same nucleoside type but with random incorporation, such as where all uridines are replaced by a uridine analog, e.g., pseudouridine or 5-methoxyuridine, are not considered chimeric polynucleotides. Likewise, polynucleotides having a uniform chemical modification of two, three, or four of the same nucleoside type throughout the entire polynucleotide (such as all uridines and all cytosines, etc. are modified in the same way) are not considered chimeric polynucleotides. One example of a polynucleotide which is not chimeric is the canonical pseudouridine/5-methyl cytosine modified polynucleotide. These uniform polynucleotides are arrived at entirely via in vitro transcription (IVT) enzymatic synthesis; and due to the limitations of the synthesizing enzymes, they contain only one kind of modification at the occurrence of each of the same nucleoside type, i.e., adenosine (A), thymidine (T), guanosine (G), cytidine (C) or uridine (U), found in the polynucleotide. Such polynucleotides can be characterized as IVT polynucleotides.

The chimeric polynucleotides of the present disclosure can be structurally modified or chemically modified. When the chimeric polynucleotides of the present disclosure are chemically and/or structurally modified the polynucleotides can be referred to as "modified chimeric polynucleotides."

The regions or parts of the chimeric polynucleotides can be separated by a linker or spacer moiety. Such linkers or spaces can be nucleic acid based or non-nucleosidic.

In some embodiments, the chimeric polynucleotides can include a sequence encoding a self-cleaving peptide described herein, such as, but not limited to, a 2A peptide. The polynucleotide sequence of the 2A peptide in the chimeric polynucleotide can be modified or codon optimized by the methods described herein and/or are known in the art.

Notwithstanding the foregoing, the chimeric polynucleotides of the present disclosure can comprise a region or part which is not positionally modified or not chimeric as defined herein. For example, a region or part of a chimeric polynucleotide can be uniformly modified at one or more A, T, C, G, or U, but the polynucleotides will not be uniformly modified throughout the entire region or part.

Chimeric polynucleotides of the present disclosure can be completely positionally modified or partially positionally modified. They can also have subregions which can be of any pattern or design.

In some embodiments, regions or subregions of the polynucleotides can range from absent to 500 nucleotides in length (e.g., at least 60, 70, 80, 90, 100, 110, 120, 130, 140, 150, 160, 170, 180, 190, 200, 250, 300, 350, 400, 450, or 500 nucleotides). Where the region is a polyA tail, the length can be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides to about 160 nucleotides are functional. The chimeric polynucleotides of the present disclosure which function as an mRNA need not comprise a polyA tail.

According to the present disclosure, chimeric polynucleotides which function as an mRNA can have a capping region. The capping region can comprise a single cap or a series of nucleotides forming the cap. In this embodiment the capping region can be from 1 to 10, e.g. 2-9, 3-8, 4-7, 1-5, 5-10, or at least 2, or 10 or fewer nucleotides in length. In some embodiments, the cap is absent.

The present disclosure contemplates chimeric polynucleotides which are circular or cyclic. As the name implies circular polynucleotides are circular in nature meaning that the termini are joined in some fashion, whether by ligation, covalent bond, common association with the same protein or other molecule or complex or by hybridization.

Chimeric polynucleotides, formulations and compositions comprising chimeric polynucleotides, and methods of making, using and administering chimeric polynucleotides are also described in International Patent Application No. PCT/US2014/53907.

In some embodiments, the chimeric polynucleotide encodes an immune response primer, immune response co-stimulatory signal, or checkpoint inhibitor polypeptide. In some embodiments, the chimeric polynucleotides of the disclosure comprise any one of the immune response primers, immune response co-stimulatory signals, or checkpoint inhibitor nucleic acid sequences provided in the present disclosure. In some embodiments the chimeric polynucleotide of the disclosure encodes any one of the immune response primers, immune response co-stimulatory signals, or checkpoint inhibitor polypeptides provided in the present disclosure.

Circular Polynucleotide

The polynucleotides (e.g., mRNA) encoding the immune response primers, immune response co-stimulatory signals, or checkpoint inhibitor polypeptides in the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) can be circular or cyclic. As used herein, "circular polynucleotides" or "circP" means a single stranded circular polynucleotide which acts substantially like, and has the properties of, an RNA. The term "circular" is also meant to encompass any secondary or tertiary configuration of the circP. Circular polynucleotides are circular in nature meaning that the termini are joined in some fashion, whether by ligation, covalent bond, common association with the same protein or other molecule or complex or by hybridization.

Circular polynucleotides, formulations and compositions comprising circular polynucleotides, and methods of making, using and administering circular polynucleotides are also disclosed in International Patent Application No. PCT/US2014/53904 (published as WO2015034925, see also, US 2016-0194368).

In some embodiments, the circular polynucleotide encodes an immune response primer, immune response co-stimulatory signal, or checkpoint inhibitor polypeptide. In some embodiments, the circular polynucleotides of the disclosure comprise any one of the immune response primer, immune response co-stimulatory signal, or checkpoint inhibitor nucleic acid sequences provided in the present disclosure. In some embodiments, the circular polynucleotides of the disclosure encode any one of the immune response primers, immune response co-stimulatory signals, or checkpoint inhibitor polypeptide provided in the present disclosure. In some embodiments, the circular polynucleotide increases immune response primer, immune response co-stimulatory signal, or checkpoint inhibitor polypeptide expression.

Multimers of Polynucleotides

In some embodiments, multiple distinct chimeric polynucleotides and/or IVT polynucleotides can be linked together through the 3'-end using nucleotides which are modified at the 3'-terminus. Chemical conjugation can be used to control the stoichiometry of delivery into cells. This can be controlled by chemically linking chimeric polynucleotides and/or IVT polynucleotides using a 3'-azido terminated nucleotide on one polynucleotides species and a C5-ethynyl or alkynyl-containing nucleotide on the opposite polynucleotide species. The modified nucleotide is added post-transcriptionally using terminal transferase (New England Biolabs, Ipswich, Mass.) according to the manufacturer's protocol. After the addition of the 3'-modified nucleotide, the two polynucleotides species can be combined in an aqueous solution, in the presence or absence of copper, to form a new covalent linkage via a click chemistry mechanism as described in the literature.

In another example, more than two chimeric polynucleotides and/or IVT polynucleotides can be linked together using a functionalized linker molecule. For example, a functionalized saccharide molecule can be chemically modified to contain multiple chemical reactive groups (SH—, $NH_2$—, $N_3$, etc.) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated chimeric polynucleotides and/or IVT polynucleotides.

In some embodiments, the chimeric polynucleotides and/or IVT polynucleotides can be linked together in a pattern. The pattern can be a simple alternating pattern such as CD[CD]x where each "C" and each "D" represent a chimeric polynucleotide, IVT polynucleotide, different chimeric polynucleotides or different IVT polynucleotides. The pattern can repeat x number of times, where x=1-300. Patterns can also be alternating multiples such as CCDD[CCDD]x (an alternating double multiple) or CCCDDD[CCCDDD]x (an alternating triple multiple) pattern. The alternating double multiple or alternating triple multiple can repeat x number of times, where x=1-300.

Conjugates and Combinations of Polynucleotides

The polynucleotide (e.g., mRNA) encoding an immune response primer, immune response co-stimulatory signal, or checkpoint inhibitor polypeptide of the present disclosure can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation can result in increased stability and/or half-life and can be particularly useful in targeting the polynucleotides to specific sites in the cell, tissue or organism.

A polynucleotide (e.g., mRNA) encoding an immune response primer, immune response co-stimulatory signal, or checkpoint inhibitor polypeptide of the disclosure can further comprise a nucleotide sequence encoding one or more heterologous polypeptides. In one embodiment, the one or more heterologous polypeptides improves a pharmacokinetic property or pharmacodynamics property of the immune response primer, immune response co-stimulatory signal, or checkpoint inhibitor polypeptide, or a polynucleotide (e.g., at least one mRNA) encoding the immune response primer, immune response co-stimulatory signal, or checkpoint inhibitor polypeptide. In another embodiment, the one or more heterologous polypeptides comprise a polypeptide that can extend a half-life of the immune response primer polypeptide, immune response co-stimulatory signal polypeptide, or checkpoint inhibitor polypeptide.

A polynucleotide (e.g., mRNA) encoding an immune response primer, immune response co-stimulatory signal, or checkpoint inhibitor polypeptide of the present disclosure can further comprise one or more regions or parts which act or function as an untranslated region. By definition, wild type untranslated regions (UTRs) of a gene are transcribed but not translated. In mRNA, the 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the polynucleotides of the present disclosure to, among other things, enhance the stability of the molecule. The specific features can also be incorporated to ensure controlled down-regulation of the transcript in case they are misdirected to undesired organs sites. TABLES 20, 21, and 22 provide a listing of exemplary UTRs which can be utilized in the polynucleotides of the present disclosure.

5' UTR and Translation Initiation

In certain embodiments, the polynucleotide (e.g., mRNA) encoding an immune response primer, immune response co-stimulatory signal, or checkpoint inhibitor polypeptide of the present disclosure further comprises a 5' UTR and/or a translation initiation sequence. Natural 5'UTRs bear features which play roles in translation initiation. They harbor signatures like Kozak sequences which are commonly known to be involved in the process by which the ribosome initiates translation of many genes. 5'UTR also have been known to form secondary structures which are involved in elongation factor binding.

By engineering the features typically found in abundantly expressed genes of specific target organs, one can enhance the stability and protein production of the polynucleotides of the disclosure. For example, introduction of 5' UTR of mRNA known to be upregulated in cancers, such as c-myc, could be used to enhance expression of a nucleic acid molecule, such as a polynucleotide, in cancer cells. Untranslated regions useful in the design and manufacture of polynucleotides include, but are not limited, to those disclosed in International Patent Publication No. WO 2014/164253 (see also US20160022840).

Shown in TABLE 20 is a listing of a 5'-untranslated region of the disclosure. Variants of 5' UTRs can be utilized wherein one or more nucleotides are added or removed to the termini, including A, U, C or G.

TABLE 20

5'-Untranslated Regions

| 5' UTR Identifier | Name/ Description | Sequence | SEQ ID NO. |
|---|---|---|---|
| 5UTR-001 | Upstream UTR | GGGAAAUAAGAGAGAAAAGAAGAGUAAGAAGAAAUAUAAGAG CCACC | 1216 |
| 5UTR-002 | Upstream UTR | GGGAGAUCAGAGAGAAAAGAAGAGUAAGAAGAAAUAUAAGAG CCACC | 1217 |
| 5UTR-003 | Upstream UTR | GGAAUAAAAGUCUCAACACAACAUAUACAAAACAAACGAAUC UCAAGCAAUCAAGCAUUCUACUUCUAUUGCAGCAAUUUAAAU CAUUUCUUUUAAAGCAAAAGCAAUUUUCUGAAAAUUUUCACC AUUUACGAACGAUAGCAAC | 1218 |
| 5UTR-004 | Upstream UTR | GGGAGACAAGCUUGGCAUUCCGGUACUGUU GGUAAAGCCACC | 1219 |
| 5UTR-005 | Upstream UTR | GGGAGAUCAGAGAGAAAAGAAGAGUAAGAAGAAAUAUAAGAG CCACC | 1220 |
| 5UTR-006 | Upstream UTR | GGAAUAAAAGUCUCAACACAACAUAUACAAAACAAACGAAUC UCAAGCAAUCAAGCAUUCUACUUCUAUUGCAGCAAUUUAAAU CAUUUCUUUUAAAGCAAAAGCAAUUUUCUGAAAAUUUUCACC AUUUACGAACGAUAGCAAC | 1221 |

TABLE 20-continued

| 5'-Untranslated Regions | | | |
|---|---|---|---|
| 5' UTR Identifier | Name/ Description | Sequence | SEQ ID NO. |
| 5UTR-007 | Upstream UTR | GGGAGACAAGCUUGGCAUUCCGGUACUGUU GGUAAAGCCACC | 1222 |
| 5UTR-008 | Upstream UTR | GGGAAUUAACAGAGAAAAGAAGAGUAAGAAGAAAUAUAAGAG CCACC | 1223 |
| 5UTR-009 | Upstream UTR | GGGAAAUUAGACAGAAAAGAAGAGUAAGAAGAAAUAUAAGAG CCACC | 1224 |
| 5UTR-010 | Upstream UTR | GGGAAAUAAGAGAGUAAAGAACAGUAAGAAGAAAUAUAAGAG CCACC | 1225 |
| 5UTR-011 | Upstream UTR | GGGAAAAAAGAGAGAAAAGAAGACUAAGAAGAAAUAUAAGAG CCACC | 1226 |
| 5UTR-012 | Upstream UTR | GGGAAAUAAGAGAGAAAAGAAGAGUAAGAAGAUAUAUAAGAG CCACC | 1227 |
| 5UTR-013 | Upstream UTR | GGGAAAUAAGAGACAAAACAAGAGUAAGAAGAAAUAUAAGAG CCACC | 1228 |
| 5UTR-014 | Upstream UTR | GGGAAAUUAGAGAGUAAAGAACAGUAAGUAGAAUUAAAAGAG CCACC | 1229 |
| 5UTR-015 | Upstream UTR | GGGAAAUAAGAGAGAAUAGAAGAGUAAGAAGAAAUAUAAGAG CCACC | 1230 |
| 5UTR-016 | Upstream UTR | GGGAAAUAAGAGAGAAAAGAAGAGUAAGAAGAAAAUUAAGAG CCACC | 1231 |
| 5UTR-017 | Upstream UTR | GGGAAAUAAGAGAGAAAAGAAGAGUAAGAAGAAAUUUAAGAG CCACC | 1232 |
| 5UTR-018 | Upstream UTR | GGGAAAUAAGAGAGAAAAGAAGAGUAAGAAGAAAUAUAAGAG CCACC | 1233 |
| 5UTR-019 | Upstream UTR | UCAAGCUUUUGGACCCUCGUACAGAAGCUAAUACGACUCACU AUAGGGAAAUAAGAGAGAAAAGAAGAGUAAGAAGAAAUAUAA GAGCCACC | 1234 |

Other non-UTR sequences can also be used as regions or subregions within the polynucleotides. For example, introns or portions of introns sequences can be incorporated into regions of the polynucleotides. Incorporation of intronic sequences can increase protein production as well as polynucleotide levels.

Combinations of features can be included in flanking regions and can be contained within other features. For example, the ORF can be flanked by a 5' UTR which can contain a strong Kozak translational initiation signal and/or a 3' UTR which can include an oligo(dT) sequence for templated addition of a poly-A tail. 5'UTR can comprise a first polynucleotide fragment and a second polynucleotide fragment from the same and/or different genes such as the 5'UTRs described in U.S. Patent Application Publication No. 2010-0293625.

These UTRs or portions thereof can be placed in the same orientation as in the transcript from which they were selected or can be altered in orientation or location. Hence a 5' or 3' UTR can be inverted, shortened, lengthened, made with one or more other 5' UTRs or 3' UTRs.

In some embodiments, the UTR sequences can be changed in some way in relation to a reference sequence. For example, a 3' or 5' UTR can be altered relative to a wild type or native UTR by the change in orientation or location as taught above or can be altered by the inclusion of additional nucleotides, deletion of nucleotides, swapping or transposition of nucleotides. Any of these changes producing an "altered" UTR (whether 3' or 5') comprise a variant UTR.

In some embodiments, a double, triple or quadruple UTR such as a 5' or 3' UTR can be used. As used herein, a "double" UTR is one in which two copies of the same UTR are encoded either in series or substantially in series. For example, a double beta-globin 3' UTR can be used as described in U.S. Patent Application Publication No. 2010-0129877.

In some embodiments, flanking regions can be heterologous. In some embodiments, the 5' untranslated region can be derived from a different species than the 3' untranslated region. The untranslated region can also include translation enhancer elements (TEE). As a non-limiting example, the TEE can include those described in U.S. Patent Application Publication No. 2009-0226470.

3' UTR and the AU Rich Elements

In certain embodiments, the polynucleotide (e.g., mRNA) encoding an immune response primer, immune response co-stimulatory signal, or checkpoint inhibitor polypeptide further comprises a 3' UTR. 3'-UTR is the section of mRNA that immediately follows the translation termination codon and often contains regulatory regions that post-transcriptionally influence gene expression. Regulatory regions within the 3'-UTR can influence polyadenylation, translation efficiency, localization, and stability of the mRNA. In one embodiment, the 3'-UTR useful for the disclosure comprises a binding site for regulatory proteins or microRNAs. In some embodiments, the 3'-UTR has a silencer region, which binds to repressor proteins and inhibits the expression of the mRNA. In other embodiments, the 3'-UTR comprises an AU-rich element. Proteins bind AREs to affect the stability or decay rate of transcripts in a localized manner or affect translation initiation. In other embodiments, the 3'-UTR comprises the sequence AAUAAA that directs addition of several hundred adenine residues called the poly(A) tail to the end of the mRNA transcript.

TABLE 21 shows a listing of 3'-untranslated regions useful for the mRNAs encoding an immune response primer, immune response co-stimulatory signal, or checkpoint inhibitor polypeptide. Variants of 3' UTRs can be utilized wherein one or more nucleotides are added or removed to the termini, including A, U, C or G.

TABLE 21

Exemplary 3'-Untranslated Regions

| 3' UTR Identifier | Name/ Description | Sequence | SEQ ID NO. |
|---|---|---|---|
| 3UTR-001 | Creatine Kinase | GCGCCUGCCCACCUGCCACCGACUGCUGGAACCCAGCCAGUGGGA GGGCCUGGCCCACCAGAGUCCUGCUCCCUCACUCCUCGCCCCGCC CCCUGUCCCAGAGUCCCACCUGGGGGCUCUCUCCACCCUUCUCAG AGUUCCAGUUUCAACCAGAGUUCCAACCAAUGGGCUCCAUCCUCU GGAUUCUGGCCAAUGAAAUAUCUCCCUGGCAGGGUCCUCUUCUUU UCCCAGAGCUCCACCCCAACCAGGAGCUCUAGUUAAUGGAGAGCU CCCAGCACACUCGGAGCUUGUGCUUUGUCUCCACGCAAAGCGAUA AAUAAAAGCAUUGGUGGCCUUUGGUCUUUGAAUAAAGCCUGAGUA GGAAGUCUAGA | 1235 |
| 3UTR-002 | Myoglobin | GCCCCUGCCGCUCCCACCCCCACCCAUCUGGGCCCCGGGUUCAAG AGAGAGCGGGGUCUGAUCUCGUGUAGCCAUAUAGAGUUUGCUUCU GAGUGUCUGCUUUGUUUAGUAGAGGUGGGCAGGAGGAGCUGAGGG GCUGGGGCUGGGGUGUUGAAGUUGGCUUUGCAUGCCCAGCGAUGC GCCUCCCUGUGGGAUGUCAUCACCCUGGGAACCGGGAGUGGCCCU UGGCUCACUGUGUUCUGCAUGGUUUGGAUCUGAAUUAAUUGUCCU UUCUUCUAAAUCCCAACCGAACUUCUUCCAACCUCCAAACUGGCU GUAACCCCAAAUCCAAGCCAUUAACUACACCUGACAGUAGCAAUU GUCUGAUUAAUCACUGGCCCCUUGAAGACAGCAGAAUGUCCCUUU GCAAUGAGGAGGAGAUCUGGGCUGGGCGGGCCAGCUGGGGAAGCA UUUGACUAUCUGGAACUUGUGUGUGCCUCCUCAGGUAUGGCAGUG ACUCACCUGGUUUUAAUAAAACAACCUGCAACAUCUCAUGGUCUU UGAAUAAAGCCUGAGUAGGAAGUCUAGA | 1236 |
| 3UTR-003 | α-actin | ACACACUCCACCUCCAGCACGCGACUUCUCAGGACGACGAAUCUU CUCAAUGGGGGGGCGGCUGAGCUCCAGCCACCCCGCAGUCACUUU CUUUGUAACAACUUCCGUUGCUGCCAUCGUAAACUGACACAGUGU UUAUAACGUGUACAUACAUUAACUUAUUACCUCAUUUUGUUAUUU UUCGAAACAAAGCCCUGUGGAAGAAAAUGGAAAACUUGAAGAAGC AUUAAAGUCAUUCUGUUAAGCUGCGUAAAUGGUCUUUGAAUAAAG CCUGAGUAGGAAGUCUAGA | 1237 |
| 3UTR-004 | Albumin | CAUCACAUUUAAAAGCAUCUCAGCCUACCAUGAGAAUAAGAGAAA GAAAAUGAAGAUCAAAAGCUUAUUCAUCUGUUUUUCUUUUUCGUU GGUGUAAAGCCAACACCCUGUCUAAAAAACAUAAAUUUCUUUAAU CAUUUUGCCUCUUUUCUCUGUGCUUCAAUUAAUAAAAAAUGGAAA GAAUCUAAUAGAGUGGUACAGCACUGUUAUUUUUCAAAGAUGUGU UGCUAUCCUGAAAAUUCUGUAGGUUCUGUGGAAGUUCCAGUGUUC UCUCUUAUUCCACUUCGGUAGAGGAUUUCUAGUUUCUUGUGGGCU AAUUAAAUAAAUCAUUAAUACUCUUCUAAUGGUCUUUGAAUAAAG CCUGAGUAGGAAGUCUAGA | 1238 |
| 3UTR-005 | α-globin | GCUGCCUUCUGCGGGGCUUGCCUUCUGGCCAUGCCCUUCUUCUCU CCCUUGCACCUGUACCUCUUGGUCUUUGAAUAAAGCCUGAGUAGG AAGGCGGCCGCUCGAGCAUGCAUCUAGA | 1239 |
| 3UTR-006 | G-CSF | GCCAAGCCCUCCCCAUCCCAUGUAUUUAUCUCUAUUUAAUAUUUA UGUCUAUUUAAGCCUCAUAUUUAAAGACAGGGAAGAGCAGAACGG AGCCCCAGGCCUCUGUGUCCUUCCCUGCAUUUCUGAGUUUCAUUC UCCUGCCUGUAGCAGUGAGAAAAAGCUCCUGUCCUCCCAUCCCCU GGACUGGGAGGUAGAUAGGUAAAUACCAAGUAUUUAUUACUAUGA CUGCUCCCCAGCCCUGGCUCUGCAAUGGGCACUGGGAUGAGCCGC UGUGAGCCCCUGGUCCUGAGGGUCCCCACCUGGGACCCUUGAGAG UAUCAGGUCUCCCACGUGGGAGACAAGAAAUCCCUGUUUAAUAUU UAAACAGCAGUGUUCCCCAUCUGGGUCCUUGCACCCCUCACUCUG GCCUCAGCCGACUGCACAGCGGCCCCUGCAUCCCCUUGGCUGUGA GGCCCCUGGACAAGCAGAGGUGGCCAGAGCUGGGAGGCAUGGCCC UGGGGUCCCACGAAUUUGCUGGGGAAUCUCGUUUUUCUUCUUAAG ACUUUUGGGACAUGGUUUGACUCCCGAACAUCACCGACGCGUCUC CUGUUUUUCUGGGUGGCCUCGGGACACCUGCCCUGCCCCCACGAG GGUCAGGACUGUGACUCUUUUUAGGGCCAGGCAGGUGCCUGGACA UUUGCCUUGCUGGACGGGGACUGGGGAUGUGGGAGGGAGCAGACA GGAGGAAUCAUGUCAGGCCUGUGUGUGAAAGGAAGCUCCACUGUC ACCCUCCACCUCUUCACCCCCCACUCACCAGUGUCCCCUCCACUG | 1240 |

TABLE 21-continued

Exemplary 3'-Untranslated Regions

| 3' UTR Identifier | Name/ Description | Sequence | SEQ ID NO. |
|---|---|---|---|
| | | UCACAUUGUAACUGAACUUCAGGAUAAUAAAGUGUUUGCCUCCAU GGUCUUUGAAUAAAGCCUGAGUAGGAAGGCGGCCGCUCGAGCAUG CAUCUAGA | |
| 3UTR-007 | Col1a2; collagen, type I, alpha 2 | ACUCAAUCUAAAUUAAAAAAGAAAGAAAUUUGAAAAAACUUUCUC UUUGCCAUUUCUUCUUCUUCUUUUUUAACUGAAAGCUGAAUCCUU CCAUUUCUUCUGCACAUCUACUUGCUUAAAUUGUGGGCAAAAGAG AAAAAGAAGGAUUGAUCAGAGCAUUGUGCAAUACAGUUUCAUUAA CUCCUUCCCCCGCUCCCCCAAAAAUUUGAAUUUUUUUUUCAACAC UCUUACACCUGUUAUGGAAAAUGUCAACCUUUGUAAGAAAACCAA AAUAAAAAUUGAAAAAUAAAAACCAUAAACAUUUGCACCACUUGU GGCUUUUGAAUAUCUUCCACAGAGGGAAGUUUAAAACCCAAACUU CCAAAGGUUUAAACUACCUCAAAACACUUUCCCAUGAGUGUGAUC CACAUUGUUAGGUGCUGACCUAGACAGAGAUGAACUGAGGUCCUU GUUUUGUUUUGUUCAUAAUACAAAGGUGCUAAUUAAUAGUAUUUC AGAUACUUGAAGAAUGUUGAUGGUGCUAGAAGAAUUUGAGAAGAA AUACUCCUGUAUUGAGUUGUAUCGUGUGGUGUAUUUUUUAAAAAA UUUGAUUUAGCAUUCAUAUUUUCCAUCUUAUUCCCAAUUAAAAGU AUGCAGAUUAUUUGCCCAAAUCUUCUUCAGAUUCAGCAUUUGUUC UUUGCCAGUCUCAUUUUCAUCUUCUUCCAUGGUUCCACAGAAGCU UUGUUUCUUGGGCAAGCAGAAAAAUUAAAUUGUACCUAUUUUGUA UAUGUGAGAUGUUUAAAUAAAUUGUGAAAAAAAUGAAAUAAAGCA UGUUUGGUUUUCCAAAAGAACAUAU | 1241 |
| 3UTR-008 | Col6a2; collagen, type VI, alpha 2 | CGCCGCCGCCCGGGCCCCGCAGUCGAGGGUCGUGAGCCCACCCCG UCCAUGGUGCUAAGCGGGCCCGGGUCCCACACGGCCAGCACCGCU GCUCACUCGGACGACGCCCUGGGCCUGCACCUCUCCAGCUCCUCC CACGGGGUCCCCGUAGCCCCGGCCCCCGCCCAGCCCCAGGUCUCC CCAGGCCCUCCGCAGGCUGCCCGGCCUCCCUCCCCCUGCAGCCAU CCCAAGGCUCCUGACCUACCUGGCCCCUGAGCUCUGGAGCAAGCC CUGACCCAAUAAAGGCUUUGAACCCAU | 1242 |
| 3UTR-009 | RPN1; ribophorin I | GGGGCUAGAGCCCUCUCCGCACAGCGUGGAGACGGGGCAAGGAGG GGGGUUAUUAGGAUUGGUGGUUUUGUUUUGCUUUGUUUAAAGCCG UGGGAAAAUGGCACAACUUUACCUCUGUGGGAGAUGCAACACUGA GAGCCAAGGGGUGGGAGUUGGGAUAAUUUUUAUAUAAAAGAAGUU UUUCCACUUUGAAUUGCUAAAAGUGGCAUUUUUCCUAUGUGCAGU CACUCCUCUCAUUUCUAAAAUAGGGACGUGGCCAGGCACGGUGGC UCAUGCCUGUAAUCCCAGCACUUUGGGAGGCCGAGGCAGGCGGCU CACGAGGUCAGGAGAUCGAGACUAUCCUGGCUAACACGGUAAAAC CCUGUCUCUACUAAAAGUACAAAAAAUUAGCUGGGCGUGGUGGUG GGCACCUGUAGUCCCAGCUACUCGGGAGGCUGAGGCAGGAGAAAG GCAUGAAUCCAAGAGGCAGAGCUUGCAGUGAGCUGAGAUCACGCC AUUGCACUCCAGCCUGGGCAACAGUGUUAAGACUCUGUCUCAAAU AUAAAUAAAUAAAUAAAUAAAUAAAUAAAUAAAUAAAAAUAAAGC GAGAUGUUGCCCUCAAA | 1243 |
| 3UTR-010 | LRP1; low density lipoprotein receptor-related protein 1 | GGCCCUGCCCCGUCGGACUGCCCCCAGAAAGCCUCCUGCCCCCUG CCAGUGAAGUCCUUCAGUGAGCCCCUCCCCAGCCAGCCCUUCCCU GGCCCCGCCGGAUGUAUAAAUGUAAAAAUGAAGGAAUUACAUUUU AUAUGUGAGCGAGCAAGCCGGCAAGCGAGCACAGUAUUAUUUCUC CAUCCCCUCCCUGCCUGCUCCUUGGCACCCCCAUGCUGCCUUCAG GGAGACAGGCAGGGAGGGCUUGGGGCUGCACCUCCUACCCUCCCA CCAGAACGCACCCCACUGGGAGAGCUGGUGGUGCAGCCUUCCCCU CCCUGUAUAAGACACUUUGCCAAGGCUCUCCCCUCUCGCCCCAUC CCUGCUUGCCCGCUCCCACAGCUUCCUGAGGGCUAAUUCUGGGAA GGGAGAGUUCUUUGCUGCCCCUGUCUGGAAGACGUGGCUCUGGGU GAGGUAGGCGGGAAAGGAUGGAGUGUUUUAGUUCUUGGGGGAGGC CACCCCAAACCCCAGCCCCAACUCCAGGGGCACCUAUGAGAUGGC CAUGCUCAACCCCCCUCCCAGACAGGCCCUCCCUGUCUCCAGGGC CCCCACCGAGGUUCCCAGGGCUGGAGACUUCCUCUGGUAAACAUU CCUCCAGCCUCCCCUCCCCUGGGGACGCCAAGGAGGUGGGCCACA CCCAGGAAGGGAAAGCGGGCAGCCCCGUUUUGGGGACGUGAACGU UUUAAUAAUUUUUGCUGAAUUCCUUUACAACUAAAUAACACAGAU AUUGUUAUAAAUAAAAUUGU | 1244 |
| 3UTR-011 | Nnt1; cardiotrophin-like cytokine factor 1 | AUAUUAAGGAUCAAGCUGUUAGCUAAUAAUGCCACCUCUGCAGUU UUGGGAACAGGCAAAUAAAGUAUCAGUAUACAUGGUGAUGUACAU CUGUAGCAAAGCUCUUGGAGAAAAUGAAGACUGAAGAAAGCAAAG CAAAAACUGUAUAGAGAGAUUUUUCAAAAGCAGUAAUCCCUCAAU UUUAAAAAAGGAUUGAAAAUUCUAAAUGUCUUUCUGUGCAUAUUU UUUGUGUUAGGAAUCAAAAGUAUUUUAUAAAAGGAGAAAGAACAG CCUCAUUUUAGAUGUAGUCCUGUUGGAUUUUUUAUGCCUCCUCAG UAACCAGAAAUGUUUUAAAAACUAAGUGUUUAGGAUUUCAAGAC AACAUUAUACAUGGCUCUGAAAUAUCUGACACAAUGUAAACAUUG | 1245 |

TABLE 21-continued

| Exemplary 3'-Untranslated Regions | | | |
|---|---|---|---|
| 3' UTR Identifier | Name/ Description | Sequence | SEQ ID NO. |
| | | CAGGCACCUGCAUUUUAUGUUUUUUUUUUCAACAAAUGUGACUAA<br>UUUGAAACUUUUAUGAACUUCUGAGCUGUCCCCUUGCAAUUCAAC<br>CGCAGUUUGAAUUAAUCAUAUCAAAUCAGUUUUAAUUUUUUAAAU<br>UGUACUUCAGAGUCUAUAUUUCAAGGGCACAUUUUCUCACUACUA<br>UUUUAAUACAUUAAAGGACUAAAUAAUCUUUCAGAGAUGCUGGAA<br>ACAAAUCAUUUGCUUUAUAUGUUUCAUUAGAAUACCAAUGAAACA<br>UACAACUUGAAAAUUAGUAAUAGUAUUUUUGAAGAUCCCAUUUCU<br>AAUUGGAGAUCUCUUUAAUUUCGAUCAACUUAUAAUGUGUAGUAC<br>UAUAUUAAGUGCACUUGAGUGGAAUUCAACAUUUGACUAAUAAAA<br>UGAGUUCAUCAUGUUGGCAAGUGAUGUGGCAAUUAUCUCUGGUGA<br>CAAAAGAGUAAAAUCAAAUAUUUCUGCCUGUUACAAAUAUCAAGG<br>AAGACCUGCUACUAUGAAAUAGAUGACAUUAAUCUGUCUUCACUG<br>UUUAUAAUACGGAUGGAUUUUUUUUCAAAUCAGUGUGUGUUUUGA<br>GGUCUUAUGUAAUUGAUGACAUUUGAGAGAAAUGGUGGCUUUUUU<br>UAGCUACCUCUUUGUUCAUUUAAGCACCAGUAAAGAUCAUGUCUU<br>UUUAUAGAAGUGUAGAUUUUCUUUGUGACUUUGCUAUCGUGCCUA<br>AAGCUCUAAAUAUAGGUGAAUGUGUGAUGAAUACUCAGAUUAUUU<br>GUCUCUCUAUAUAAUUAGUUUGGUACUAAGUUUCUCAAAAAAUUA<br>UUAACACAUGAAAGACAAUCUCUAAACCAGAAAAAGAAGUAGUAC<br>AAAUUUUGUUACUGUAAUGCUCGCGUUUAGUGAGUUUAAAACACA<br>CAGUAUCUUUUGGUUUUAUAAUCAGUUUCUAUUUUGCUGUGCCUG<br>AGAUUAAGAUCUGUGUAUGUGUGUGUGUGUGUGUGUGCGUUUGUG<br>UGUUAAAGCAGAAAAGACUUUUUUAAAAGUUUUAAGUGAUAAAUG<br>CAAUUUGUUAAUUGAUCUUAGAUCACUAGUAAACUCAGGGCUGAA<br>UUAUACCAUGUAUAUUCUAUUAGAAGAAAGUAAACACCAUCUUUA<br>UUCCUGCCCUUUUUCUUCUCUCAAAGUAGUUGUAGUUAUAUCUAG<br>AAAGAAGCAAUUUUGAUUUCUUGAAAAGGUAGUUCCUGCACUCAG<br>UUUAAACUAAAAAUAAUCAUACUUGGAUUUUAUUUAUUUUUGUCA<br>UAGUAAAAAUUUUAAUUUAUAUAUAUUUUUAUUUAGUAUUAUCUU<br>AUUCUUUGCUAUUUGCCAAUCCUUUGUCAUCAAUUGUGUUAAAUG<br>AAUUGAAAAUUCAUGCCCUGUUCAUUUUAUUUUACUUUAUUGGUU<br>AGGAUAUUUAAAGGAUUUUUGUAUAUAUAAUUUCUUAAAUUAAUA<br>UUCCAAAAGGUUAGUGGACUUAGAUUAUAAAUUAUGGCAAAAAUC<br>UAAAAACAACAAAAAUGAUUUUUAUACAUUCUAUUUCAUUAUUCC<br>UCUUUUUCCAAUAAGUCAUACAAUUGGUAGAUAUGACUUAUUUUA<br>UUUUUGUAUUAUUCACUAUAUCUUUAUGAUAUUUAAGUAUAAAUA<br>AUUAAAAAAAUUUAUUGUACCUUAUAGUCUGUCACCAAAAAAAAA<br>AAAUUAUCUGUAGGUAGUGAAAUGCUAAUGUUGAUUUGUCUUUAA<br>GGGCUUGUUAACUAUCCUUUAUUUUCUCAUUUGUCUUAAAUUAGG<br>AGUUUGUGUUUAAAUUACUCAUCUAAGCAAAAAAUGUAUAUAAAU<br>CCCAUUACUGGGUAUAUACCCAAAGGAUUAUAAAUCAUGCUGCUA<br>UAAAGACACAUGCACACGUAUGUUUAUUGCAGCACUAUUCACAAU<br>AGCAAAGACUUGGAACCAACCCAAAUGUCCAUCAAUGAUAGACUU<br>GAUUAAGAAAAUGUGCACAUAUACACCAUGGAAUACUAUGCAGCC<br>AUAAAAAAGGAUGAGUUCAUGUCCUUUGUAGGGACAUGGAUAAAG<br>CUGGAAACCAUCAUUCUGAGCAAACUAUUGCAAGGACAGAAAACC<br>AAACACUGCAUGUUCUCACUCAUAGGUGGGAAUUGAACAAUGAGA<br>ACACUUGGACACAAGGUGGGGAACACCACACACCAGGGCCUGUCA<br>UGGGGUGGGGGGAGUGGGGAGGGAUAGCAUUAGGAGAUAUACCUA<br>AUGUAAAUGAUGAGUUAAUGGGUGCAGCACACCAACAUGGCACAU<br>GUAUACAUAUGUAGCAAACCUGCACGUUGUGCACAUGUACCCUAG<br>AACUUAAAGUAUAAUUAAAAAAAAAAAGAAAACAGAAGCUAUUUA<br>UAAAGAAGUUAUUUGCUGAAAUAAAUGUGAUCUUUCCCAUUAAAA<br>AAAUAAAGAAAUUUUGGGGUAAAAAAACACAAUAUAUUGUAUUCU<br>UGAAAAAUUCUAAGAGAGUGGAUGUGAAGUGUUCUCACCACAAAA<br>GUGAUAACUAAUUGAGGUAAUGCACAUAUUAAUUAGAAAGAUUUU<br>GUCAUUCCACAAUGUAUAUAUACUUAAAAAUAUGUUAUACACAAU<br>AAAUACAUACAUUAAAAAAUAAGUAAAUGUA | |
| 3UTR-012 | Col6a1; collagen, type VI, alpha 1 | CCCACCCUGCACGCCGGCACCAAACCCUGUCCUCCCACCCCUCCC<br>CACUCAUCACUAAACAGAGUAAAAUGUGAUGCGAAUUUUCCCGAC<br>CAACCUGAUUCGCUAGAUUUUUUUUAAGGAAAAGCUUGGAAAGCC<br>AGGACACAACGCUGCUGCCUGCUUUGUGCAGGGUCCUCCGGGGCU<br>CAGCCCUGAGUUGGCAUCACCUGCGCAGGGCCCUCUGGGGCUCAG<br>CCCUGAGCUAGUGUCACCUGCACAGGGCCCUCUGAGGCUCAGCCC<br>UGAGCUGGCGUCACCUGUGCAGGGCCCUCUGGGGCUCAGCCCUGA<br>GCUGGCCUCACCUGGGUUCCCCACCCCGGGCUCUCCUGCCCUGCC<br>CUCCUGCCCGCCCUCCCUCCUGCCUGCGCAGCUCCUUCCCUAGGC<br>ACCUCUGUGCUGCAUCCCACCAGCCUGAGCAAGACGCCCUCUCGG<br>GGCCUGUGCCGCACUAGCCUCCCUCUCCUCUGUCCCCAUAGCUGG<br>UUUUUCCCACCAAUCCUCACCUAACAGUUACUUUACAAUUAAACU<br>CAAAGCAAGCUCUUCUCCUCAGCUUGGGGCAGCCAUUGGCCUCUG<br>UCUCGUUUUGGGAAACCAAGGUCAGGAGGCCGUUGCAGACAUAAA<br>UCUCGGCGACUCGGCCCCGUCUCCUGAGGGUCCUGCUGGUGACCG | 1246 |

TABLE 21-continued

| Exemplary 3'-Untranslated Regions | | | |
|---|---|---|---|
| 3' UTR Identifier | Name/ Description | Sequence | SEQ ID NO. |
| | | GCCUGGACCUUGGCCCUACAGCCCUGGAGGCCGCUGCUGACCAGC ACUGACCCCGACCUCAGAGAGUACUCGCAGGGGCGCUGGCUGCAC UCAAGACCCUCGAGAUUAACGGUGCUAACCCCGUCUGCUCCUCCC UCCCGCAGAGACUGGGGCCUGGACUGGACAUGAGAGCCCCUUGGU GCCACAGAGGGCUGUGUCUUACUAGAAACAACGCAAACCUCUCCU UCCUCAGAAUAGUGAUGUGUUCGACGUUUUAUCAAAGGCCCCCUU UCUAUGUUCAUGUUAGUUUUGCUCCUUCUGUGUUUUUUUCUGAAC CAUAUCCAUGUUGCUGACUUUUCCAAAUAAAGGUUUUCACUCCUC UC | |
| 3UTR-013 | Calr; calreticulin | AGAGGCCUGCCUCCAGGGCUGGACUGAGGCCUGAGCGCUCCUGCC GCAGAGCUGGCCGCGCCAAAUAAUGUCUCUGUGAGACUCGAGAAC UUUCAUUUUUUUCCAGGCUGGUUCGGAUUUGGGGUGGAUUUUGGU UUUGUUCCCCUCCUCCACUCUCCCCCACCCCCUCCCCGCCCUUUU UUUUUUUUUUUUUUAAACUGGUAUUUUAUCUUUGAUUCUCCUUCA GCCCUCACCCCUGGUUCUCAUCUUUCUUGAUCAACAUCUUUUCUU GCCUCUGUCCCCUUCUCUCAUCUCUUAGCUCCCCUCCAACCUGGG GGGCAGUGGUGUGGAGAAGCCACAGGCCUGAGAUUUCAUCUGCUC UCCUUCCUGGAGCCCAGAGGAGGGCAGCAGAAGGGGGUGGUGUCU CCAACCCCCCAGCACUGAGGAAGAACGGGGCUCUUCUCAUUUCAC CCCUCCCUUUCUCCCCUGCCCCCAGGACUGGGCCACUUCUGGGUG GGGCAGUGGGUCCCAGAUUGGCUCACACUGAGAAUGUAAGAACUA CAAACAAAAUUUCUAUUAAAUUAAAUUUUGUGUCUCC | 1247 |
| 3UTR-014 | Col1a1; collagen, type I, alpha 1 | CUCCCUCCAUCCCAACCUGGCUCCCUCCCACCCAACCAACUUUCC CCCCAACCCGGAAACAGACAAGCAACCCAAACUGAACCCCCUCAA AAGCCAAAAAAUGGGAGACAAUUUCACAUGGACUUUGGAAAAUAU UUUUUUCCUUUGCAUUCAUCUCUCAAACUUAGUUUUUAUCUUUGA CCAACCGAACAUGACCAAAAACCAAAAGUGCAUUCAACCUUACCA AAAAAAAAAAAAAAAAAGAAUAAAUAAAUAACUUUUUAAAAAAG GAAGCUUGGUCCACUUGCUUGAAGACCCAUGCGGGGGUAAGUCCC UUUCUGCCCGUUGGGCUUAUGAAACCCCAAUGCUGCCCUUUCUGC UCCUUUCUCCACACCCCCCUUGGGGCCUCCCCUCCACUCCUUCCC AAAUCUGUCUCCCCAGAAGACACAGGAAACAAUGUAUUGUCUGCC CAGCAAUCAAAGGCAAUGCUCAAACACCCAAGUGGCCCCCACCCU CAGCCCGCUCCUGCCCGCCCAGCACCCCCAGGCCCUGGGGGACCU GGGGUUCUCAGACUGCCAAAGAAGCCUUGCCAUCUGGCGCUCCCA UGGCUCUUGCAACAUCUCCCCUUCGUUUUUGAGGGGGUCAUGCCG GGGGAGCCACCAGCCCCUCACUGGGUUCGGAGGAGAGUCAGGAAG GGCCACGACAAAGCAGAAACAUCGGAUUUGGGGAACGCGUGUCAA UCCCUUGUGCCGCAGGGCUGGGCGGGAGAGACUGUUCUGUUCCUU GUGUAACUGUGUUGCUGAAAGACUACCUCGUUCUUGUCUUGAUGU GUCACCGGGGCAACUGCCUGGGGGCGGGGAUGGGGGCAGGGUGGA AGCGGCUCCCCAUUUUAUACCAAAGGUGCUACAUCUAUGUGAUGG GUGGGGUGGGGAGGGAAUCACUGGUGCUAUAGAAAUUGAGAUGCC CCCCCAGGCCAGCAAAUGUUCCUUUUUGUUCAAAGUCUAUUUUUA UUCCUUGAUAUUUUUCUUUUUUUUUUUUUUUUUUUGUGGAUGGGG ACUUGUGAAUUUUUCUAAAGGUGCUAUUUAACAUGGGAGGAGAGC GUGUGCGGCUCCAGCCCAGCCCGCUGCUCACUUUCCACCCUCUCU CCACCUGCCUCUGGCUUCUCAGGCCUCUGCUCUCCGACCUCUCUC CUCUGAAACCCUCCUCCACAGCUGCAGCCCAUCCUCCCGGCUCCC UCCUAGUCUGUCCUGCGUCCUCUGUCCCCGGGUUUCAGAGACAAC UUCCCAAAGCACAAAGCAGUUUUUCCCCCUAGGGGUGGGAGGAAG CAAAAGACUCUGUACCUAUUUUGUAUGUGUAUAAUAAUUUGAGAU GUUUUUAAUUAUUUUGAUUGCUGGAAUAAAGCAUGUGGAAAUGAC CCAAACAUAAUCCGCAGUGGCCUCCUAAUUUCCUUCUUUGGAGUU GGGGGAGGGGUAGACAUGGGGAAGGGGCUUUGGGGUGAUGGGCUU GCCUUCCAUUCCUGCCCUUUCCCUCCCCACUAUUCUCUUCUAGAU CCCUCCAUAACCCCACUCCCCUUUCUCUCACCCUUCUUAUACCGC AAACCUUUCUACUUCCUCUUUCAUUUUCUAUUCUUGCAAUUUCCU UGCACCUUUUCCAAAUCCUCUUCUCCCCUGCAAUACCAUACAGGC AAUCCACGUGCACAACACACACACACACUCUUCACAUCUGGGGUU GUCCAAACCUCAUACCCACUCCCCUUCAAGCCCAUCCACUCUCCA CCCCCUGGAUGCCCUGCACUUGGUGGCGGUGGGAUGCUCAUGGAU ACUGGGAGGGUGAGGGGAGUGGAACCCGUGAGGAGGACCUGGGGG CCUCUCCUUGAACUGACAUGAAGGGUCAUCUGGCCUCUGCUCCCU UCUCACCCACGCUGACCUCCUGCCGAAGGAGCAACGCAACAGGAG AGGGGUCUGCUGAGCCUGGCGAGGGUCUGGGAGGGACCAGGAGGA AGGCGUGCUCCCUGCUCGCUGUCCUGGCCCUGGGGGAGUGAGGGA GACAGACACCUGGGAGAGCUGUGGGGAAGGCACUCGCACCGUGCU CUUGGGAAGGAAGGAGACCUGGCCCUGCUCACCACGGACUGGGUG CCUCGACCUCCUGAAUCCCCAGAACACAACCCCCCUGGGCUGGGG UGGUCUGGGGAACCAUCGUGCCCCCGCCUCCCGCCUACUCCUUUU UAAGCUU | 1248 |

TABLE 21-continued

Exemplary 3'-Untranslated Regions

| 3' UTR Identifier | Name/ Description | Sequence | SEQ ID NO. |
|---|---|---|---|
| 3UTR-015 | Plod1; procollagen-lysine, 2-oxoglutarate 5-dioxygenase 1 | UUGGCCAGGCCUGACCCUCUUGGACCUUUCUUCUUUGCCGACAACCACUGCCCAGCAGCCUCUGGGACCUCGGGGUCCCAGGGAACCCAGUCCAGCCUCCUGGCUGUUGACUUCCCAUUGCUCUUGGAGCCACCAAUCAAAGAGAUUCAAAGAGAUUCCUGCAGGCCAGAGGCGGAACACACCUUUAUGGCUGGGGCUCUCCGUGGUGUUCUGGACCCAGCCCCUGGAGACACCAUUCACUUUUACUGCUUUGUAGUGACUCGUGCUCUCCAACCUGUCUUCCUGAAAAACCAAGGCCCCCUUCCCCCACCUCUUCCAUGGGGUGAGACUUGAGCAGAACAGGGGCUUCCCCAAGUUGCCCAGAAAGACUGUCUGGGUGAGAAGCCAUGGCCAGAGCUUCUCCCAGGCACAGGUGUUGCACCAGGGACUUCUGCUUCAAGUUUUGGGGUAAAGACACCUGGAUCAGACUCCAAGGGCUGCCCUGAGUCUGGGACUUCUGCCUCCAUGGCUGGUCAUGAGAGCAAACCGUAGUCCCCUGGAGACAGCGACUCCAGAGAACCUCUUGGGAGACAGAAGAGGCAUCUGUGCACAGCUCGAUCUUCUACUUGCCUGUGGGGAGGGGAGUGACAGGUCCACACACCACACUGGGUCACCCUGUCCUGGAUGCCUCUGAAGAGAGGGACAGACCGUCAGAAACUGGAGAGUUUCUAUUAAAGGUCAUUUAAACCA | 1249 |
| 3UTR-016 | Nucb1; nucleobindin 1 | UCCUCCGGGACCCCAGCCCUCAGGAUUCCUGAUGCUCCAAGGCGACUGAUGGGCGCUGGAUGAAGUGGCACAGUCAGCUUCCCUGGGGGCUGGUGUCAUGUUGGGCUCCUGGGGCGGGGGCACGGCCUGGCAUUUCACGCAUUGCUGCCACCCCAGGUCCACCUGUCUCCACUUUCACAGCCUCCAAGUCUGUGGCUCUUCCCUUCUGUCCUCCGAGGGGCUUGCCUUCUCUCGUGUCCAGUGAGGUGCUCAGUGAUCGGCUUAACUUAGAGAAGCCCGCCCCCUCCCCUUCUCCGUCUGUCCCAAGAGGGUCUGCUCUGAGCCUGCGUUCCUAGGUGGCUCGGCCUCAGCUGCCUGGGUUGUGGCCGCCCUAGCAUCCUGUAUGCCCACAGCUACUGGAAUCCCCGCUGCUGCUCCGGGCCAAGCUUCUGGUUGAUUAAUGAGGGCAUGGGGUGGUCCCUCAAGACCUUCCCCUACCUUUUGUGGAACCAGUGAUGCCUCAAAGACAGUGUCCCCUCCACAGCUGGGUGCCAGGGGCAGGGGAUCCUCAGUAUAGCCGGUGAACCCUGAUACCAGGAGCCUGGGCCUCCCUGAACCCCUGGCUUCCAGCCAUCUCAUCGCCAGCCUCCUCCUGGACCUCUUGGCCCCCAGCCCCUUCCCCACACAGCCCCAGAAGGGUCCCAGAGCUGACCCCACUCCAGGACCUAGGCCCAGCCCCUCAGCCUCAUCUGGAGCCCCUGAAGACCAGUCCCACCCACCUUUCUGGCCUCAUCUGACACUGCUCCGCAUCCUGCUGUGUGUCCUGUUCCAUGUUCCGGUUCCAUCCAAAUACACUUUCUGGAACAAA | 1250 |
| 3UTR-017 | α-globin | GCUGGAGCCUCGGUGGCCAUGCUUCUUGCCCCUUGGGCCUCCCCCCAGCCCCUCCUCCCCUUCCUGCACCCGUACCCCCGUGGUCUUUGAAUAAAGUCUGAGUGGGCGGC | 1251 |
| 3UTR-018 | Downstream UTR | UAAUAGGCUGGAGCCUCGGUGGCCAUGCUUCUUGCCCCUUGGGCCUCCCCCCAGCCCCUCCUCCCCUUCCUGCACCCGUACCCCCGUGGUCUUUGAAUAAAGUCUGAGUGGGCGGC | 1252 |
| 3UTR-019 | Downstream UTR | UGAUAAUAGGCUGGAGCCUCGGUGGCCAUGCUUCUUGCCCCUUGGGCCUCCCCCCAGCCCCUCCUCCCCUUCCUGCACCCGUACCCCCAAACACCAUUGUCACACUCCAGUGGUCUUUGAAUAAAGUCUGAGUGGGCGGC | 1253 |

In certain embodiments, the 3' UTR sequence useful for the disclosure comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of SEQ ID NOS: 45-62 and any combination thereof. In a particular embodiment, the 3' UTR sequence further comprises a miRNA binding site, e.g., miR122 binding site. In other embodiments, a 3'UTR sequence useful for the disclosure comprises 3' UTR-018 (SEQ ID NO: 1252).

In certain embodiments, the 3' UTR sequence comprises one or more miRNA binding sites, e.g., miR-122 binding sites, or any other heterologous nucleotide sequences therein, without disrupting the function of the 3' UTR. Some examples of 3' UTR sequences comprising a miRNA binding site are listed in TABLE 22.

TABLE 22

Exemplary 3' UTR with miRNA Binding Sites

| 3' UTR Identifier/miRNA BS | Name/ Description | Sequence | SEQ ID NO. |
|---|---|---|---|
| 3UTR-018 + miR-122-5p binding site | Downstream UTR | UAAUAGGCUGGAGCCUCGGUGGCCAUGCUUCUUGCC CCUUGGGCCUCCCCCCAGCCCCUCCUCCCCUUCCUG CACCCGUACCCCC**CAAACACCAUUGUCACACUCCA**G UGGUCUUUGAAUAAAGUCUGAGUGGGCGGC | 1254 |
| 3UTR-018 + miR-122-3p binding site | Downstream UTR | UAAUAGGCUGGAGCCUCGGUGGCCAUGCUUCUUGCC CCUUGGGCCUCCCCCCAGCCCCUCCUCCCCUUCCUG CACCCGUACCCCC**UAUUUAGUGUGAUAAUGGCGU**U UGGUCUUUGAAUAAAGUCUGAGUGGGCGGC | 1255 |
| 3UTR-019 + miR122 binding site | Downstream UTR | UGAUAAUAGGCUGGAGCCUCGGUGGCCAUGCUUCUU GCCCCUUGGGCCUCCCCCCAGCCCCUCCUCCCCUUC CUGCACCCGUACCCCCCAAACACCAUUGUCACACUC CAGUGGUCUUUGAAUAAAGUCUGAGUGGGCGGC | 1256 |

*miRNA binding site is boxed or underlined.

In certain embodiments, the 3' UTR sequence useful for the disclosure comprises a nucleotide sequence at least about 60%, at least about 70%, at least about 80%, at least about t90%, at least about 95%, at least about 96%, at least about 97%, at least about 98%, at least about 99%, or about 100% identical to the sequence set forth as SEQ ID NO: 1254 or SEQ ID NO:1255.

Regions Having a 5' Cap

The polynucleotide comprising an mRNA encoding an immune response primer, immune response co-stimulatory signal, or checkpoint inhibitor polypeptide of the present disclosure can further comprise a 5' cap. The 5' cap useful for the immune response primer, immune response co-stimulatory signal, or checkpoint inhibitor polypeptide-encoding mRNA can bind the mRNA Cap Binding Protein (CBP), thereby increasing mRNA stability. The cap can further assist the removal of 5' proximal introns removal during mRNA splicing.

In some embodiments, the polynucleotide comprising an mRNA encoding an immune response primer, immune response co-stimulatory signal, or checkpoint inhibitor polypeptide of the present disclosure comprises a non-hydrolyzable cap structure preventing decapping and thus increasing mRNA half-life. Because cap structure hydrolysis requires cleavage of 5'-ppp-5' phosphorodiester linkages, modified nucleotides can be used during the capping reaction. For example, a Vaccinia Capping Enzyme from New England Biolabs (Ipswich, Mass.) can be used with a-thio-guanosine nucleotides according to the manufacturer's instructions to create a phosphorothioate linkage in the 5'-ppp-5' cap. Additional modified guanosine nucleotides can be used such as a-methyl-phosphonate and seleno-phosphate nucleotides.

In certain embodiments, the 5' cap comprises 2'-O-methylation of the ribose sugars of 5'-terminal and/or 5'-anteterminal nucleotides on the 2'-hydroxyl group of the sugar ring. In other embodiments, the caps for the immune response primer, immune response co-stimulatory signal, or checkpoint inhibitor polypeptide-encoding mRNA include cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs can be chemically (i.e. non-enzymatically) or enzymatically synthesized and/or linked to the polynucleotides of the disclosure.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine ($m^7$G-3'mppp-G; which can equivalently be designated 3' O-Me-m7G(5')ppp(5')G). The 3'-0 atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, $m^7$Gm-ppp-G).

In some embodiments, the cap is a dinucleotide cap analog. As a non-limiting example, the dinucleotide cap analog can be modified at different phosphate positions with a boranophosphate group or a phophoroselenoate group such as the dinucleotide cap analogs described in U.S. Pat. No. 8,519,110.

In another embodiment, the cap is a cap analog is a N7-(4-chlorophenoxyethyl) substituted dinucleotide form of a cap analog known in the art and/or described herein. Non-limiting examples of a N7-(4-chlorophenoxyethyl) substituted dinucleotide form of a cap analog include a N7-(4-chlorophenoxyethyl)-G(5')ppp(5')G and a N7-(4-chlorophenoxyethyl)-$m^{3'-O}$G(5')ppp(5')G cap analog. See, e.g., the various cap analogs and the methods of synthesizing cap analogs described in Kore et al. (2013) Bioorganic & Medicinal Chemistry 21:4570-4574. In another embodiment, a cap analog of the present disclosure is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, can lead to reduced translational competency and reduced cellular stability.

The immune response primer, immune response co-stimulatory signal, or checkpoint inhibitor polypeptide-encoding mRNA of the present disclosure can also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects.

Non-limiting examples of more authentic 5' cap structures of the present disclosure are those which, among other things, have enhanced binding of cap binding proteins, increased half-life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N,pN2p (cap 0), 7mG(5')ppp(5')N1mpNp (cap 1), and 7mG(5')-ppp(5')N1mpN2mp (cap 2).

According to the present disclosure, 5' terminal caps can include endogenous caps or cap analogs. According to the present disclosure, a 5' terminal cap can comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Poly-A Tails

In some embodiments, a polynucleotide comprising an mRNA encoding an immune response primer, immune response co-stimulatory signal, or checkpoint inhibitor polypeptide of the present disclosure further comprises a poly A tail. In further embodiments, terminal groups on the poly-A tail can be incorporated for stabilization. In other embodiments, a poly-A tail comprises des-3' hydroxyl tails. The useful poly-A tails can also include structural moieties or 2'-Omethyl modifications as taught by Li et al. (2005) Current Biology 15:1501-1507.

In one embodiment, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides).

In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall polynucleotide or the length of a particular region of the polynucleotide. This design can be based on the length of a coding region, the length of a particular feature or region or based on the length of the ultimate product expressed from the polynucleotides.

In this context, the poly-A tail can be 10, 20, 30, 40, 50, 60, 70, 80, 90, or 100% greater in length than the polynucleotide or feature thereof. The poly-A tail can also be designed as a fraction of the polynucleotides to which it belongs. In this context, the poly-A tail can be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein can enhance expression.

Additionally, multiple distinct polynucleotides can be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the polynucleotides of the present disclosure are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

Start Codon Region

In some embodiments, the polynucleotide comprising an mRNA encoding an immune response primer, immune response co-stimulatory signal, or checkpoint inhibitor polypeptide of the present disclosure further comprises regions that are analogous to or function like a start codon region.

In some embodiments, the translation of a polynucleotide initiates on a codon which is not the start codon AUG. Translation of the polynucleotide can initiate on an alternative start codon such as, but not limited to, ACG, AGG, AAG, CTG/CUG, GTG/GUG, ATA/AUA, ATT/AUU, TTG/UUG. See Touriol et al. (2003) Biology of the Cell 95:169-178 and Matsuda and Mauro (2010) PLoS ONE 5:11. As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. See, e.g., Matsuda and Mauro (2010) PLoS ONE 5:11. Masking any of the nucleotides flanking a codon that initiates translation can be used to alter the position of translation initiation, translation efficiency, length and/or structure of a polynucleotide.

In some embodiments, a masking agent is used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs). See, e.g., Matsuda and Mauro (2010) PLoS ONE 5:11, describing masking agents LNA polynucleotides and EJCs.

In another embodiment, a masking agent is used to mask a start codon of a polynucleotide in order to increase the likelihood that translation will initiate on an alternative start codon. In some embodiments, a masking agent is used to mask a first start codon or alternative start codon in order to increase the chance that translation will initiate on a start codon or alternative start codon downstream to the masked start codon or alternative start codon.

In some embodiments, a start codon or alternative start codon is located within a perfect complement for a miR binding site. The perfect complement of a miR binding site can help control the translation, length and/or structure of the polynucleotide similar to a masking agent. As a non-limiting example, the start codon or alternative start codon is located in the middle of a perfect complement for a miR-122 binding site. The start codon or alternative start codon can be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide is removed from the polynucleotide sequence in order to have the translation of the polynucleotide begin on a codon which is not the start codon. Translation of the polynucleotide can begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed can further comprise at least one masking agent for the downstream start codon and/or alternative start codons in order to control or attempt to control the initiation of translation, the length of the polynucleotide and/or the structure of the polynucleotide.

Stop Codon Region

In some embodiments, the polynucleotide comprising an mRNA encoding an immune response primer, immune response co-stimulatory signal, or checkpoint inhibitor polypeptide of the present disclosure can further comprise at least one stop codon or at least two stop codons before the 3' untranslated region (UTR). The stop codon can be selected from UGA, UAA, and UAG. In some embodiments, the polynucleotides of the present disclosure include the stop codon UGA and one additional stop codon. In a further embodiment the addition stop codon can be UAA. In another embodiment, the polynucleotides of the present disclosure include three stop codons, four stop codons, or more.

IX. METHODS OF MAKING POLYNUCLEOTIDES

The present disclosure also provides methods for making a polynucleotide disclosed herein or a complement thereof. In some aspects, a polynucleotide (e.g., an mRNA) disclosed herein, and encoding an immune response primer, immune response co-stimulatory signal, or checkpoint inhibitor polypeptide of the present disclosure can be constructed using in vitro transcription.

In other aspects, a polynucleotide (e.g., an mRNA) disclosed herein, and encoding an immune response primer, immune response co-stimulatory signal, or checkpoint inhibitor polypeptide of the present disclosure can be constructed by chemical synthesis using an oligonucleotide synthesizer. In other aspects, a polynucleotide (e.g., an mRNA) disclosed herein, and encoding an immune response primer, immune response co-stimulatory signal, or checkpoint inhibitor polypeptide of the present disclosure is made by using a host cell. In certain aspects, a polynucleotide (e.g., an mRNA) disclosed herein, and encoding an immune response primer, immune response co-stimulatory signal, or checkpoint inhibitor polypeptide of the present disclosure is made by one or more combination of the IVT, chemical synthesis, host cell expression, or any other methods known in the art.

Naturally occurring nucleosides, non-naturally occurring nucleosides, or combinations thereof, can totally or partially naturally replace occurring nucleosides present in the candidate nucleotide sequence and can be incorporated into a sequence-optimized nucleotide sequence (e.g., an mRNA) encoding an immune response primer, immune response co-stimulatory signal, or checkpoint inhibitor polypeptide of the present disclosure. The resultant mRNAs can then be examined for their ability to produce protein and/or produce a therapeutic outcome.

In Vitro Transcription-Enzymatic Synthesis

A polynucleotide disclosed herein can be transcribed using an in vitro transcription (IVT) system. The system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate modified nucleic acids. See U.S. Publ. No. US2013-0259923.

The IVT system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate polynucleotides disclosed herein.

Any number of RNA polymerases or variants can be used in the synthesis of the polynucleotides of the present disclosure.

RNA polymerases can be modified by inserting or deleting amino acids of the RNA polymerase sequence. As a non-limiting example, the RNA polymerase is modified to exhibit an increased ability to incorporate a 2'-modified nucleotide triphosphate compared to an unmodified RNA polymerase. See International Publication WO2008078180 and U.S. Pat. No. 8,101,385.

Variants can be obtained by evolving an RNA polymerase, optimizing the RNA polymerase amino acid and/or nucleic acid sequence and/or by using other methods known in the art. As a non-limiting example, T7 RNA polymerase variants are evolved using the continuous directed evolution system set out by Esvelt et al. (2011) Nature 472:499-503, where clones of T7 RNA polymerase can encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants can encode at least mutation as described in U.S. Pub. Nos. 20100120024 and 20070117112. Variants of RNA polymerase can also include, but are not limited to, substitutional variants, conservative amino acid substitution, insertional variants, deletional variants and/or covalent derivatives.

In one aspect, the polynucleotide can be designed to be recognized by the wild type or variant RNA polymerases. In doing so, the polynucleotide can be modified to contain sites or regions of sequence changes from the wild type or parent chimeric polynucleotide.

Polynucleotide or nucleic acid synthesis reactions can be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of *E. coli, Bacillus* DNA polymerase I, *Thermus aquaticus* (Taq) DNA polymerases, and the T7 RNA and DNA polymerases, is among the best studied of these families. Another large family is DNA polymerase a (pol a) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA. Cheng et al. (1994) Proc. Natl. Acad. Sci. USA 91:5695-5699. RNA polymerases from bacteriophage T3, T7, and SP6 have been widely used to prepare RNAs for biochemical and biophysical studies. RNA polymerases, capping enzymes, and poly-A polymerases are disclosed in International Publication No. WO2014028429 (see also US 20150211039).

In one aspect, the RNA polymerase which can be used in the synthesis of the polynucleotides described herein is a Syn5 RNA polymerase. See Zhu et al. (2013) Nucleic Acids Research 288:3545-3552. The Syn5 RNA polymerase was recently characterized from marine cyanophage Syn5 by Zhu et al. where they also identified the promoter sequence. See Zhu et al. (2013) Nucleic Acids Research 288:3545-3552. Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one aspect, a Syn5 RNA polymerase can be used in the synthesis of the polynucleotides described herein. As a non-limiting example, a Syn5 RNA polymerase can be used in the synthesis of the polynucleotide requiring a precise 3'-termini.

In one aspect, a Syn5 promoter can be used in the synthesis of the polynucleotides. As a non-limiting example, the Syn5 promoter can be 5'-ATTGGGCACCCGTAAGGG-3' (SEQ ID NO:1257) as described by Zhu et al. (2013) Nucleic Acids Research 288:3545-3552.

In one aspect, a Syn5 RNA polymerase can be used in the synthesis of polynucleotides comprising at least one chemical modification described herein and/or known in the art. (see e.g., the incorporation of pseudo-UTP and 5Me-CTP described in Zhu et al. (2013) Nucleic Acids Research 288:3545-3552.

In one aspect, the polynucleotides described herein can be synthesized using a Syn5 RNA polymerase which has been purified using modified and improved purification procedure described by Zhu et al. (2013) Nucleic Acids Research 288:3545-3552.

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods can be applied in the manufacture of the polynucleotides of the disclosure.

Polymerase chain reaction (PCR) has wide applications in rapid amplification of a target gene, as well as genome mapping and sequencing. The key components for synthesizing DNA comprise target DNA molecules as a template, primers complementary to the ends of target DNA strands, deoxynucleoside triphosphates (dNTPs) as building blocks, and a DNA polymerase. As PCR progresses through denaturation, annealing and extension steps, the newly produced DNA molecules can act as a template for the next circle of replication, achieving exponentially amplification of the target DNA. PCR requires a cycle of heating and cooling for denaturation and annealing. Variations of the basic PCR include asymmetric PCR (Innis et al. (1988) Proc. Natl. Acad. Sci. USA 85:9436-9440), inverse PCR (Ochman et al. (1988) Genetics 120:621-623), reverse transcription PCR (RT-PCR) (Freeman et al. (1999) BioTechniques 26:112-22, 124-5). In RT-PCR, a single stranded RNA is the desired target and is converted to a double stranded DNA first by reverse transcriptase.

A variety of isothermal in vitro nucleic acid amplification techniques have been developed as alternatives or complements of PCR. For example, strand displacement amplification (SDA) is based on the ability of a restriction enzyme to form a nick. Walker et al. (1992) Proc. Natl. Acad. Sci. USA 89:392-396, the contents of which are incorporated herein by reference in their entirety.

A restriction enzyme recognition sequence is inserted into an annealed primer sequence. Primers are extended by a DNA polymerase and dNTPs to form a duplex. Only one strand of the duplex is cleaved by the restriction enzyme. Each single strand chain is then available as a template for subsequent synthesis. SDA does not require the complicated temperature control cycle of PCR.

Nucleic acid sequence-based amplification (NASBA), also called transcription mediated amplification (TMA), is also an isothermal amplification method that utilizes a combination of DNA polymerase, reverse transcriptase, RNAse H, and T7 RNA polymerase. Compton (1991) Nature 350:91-92. A target RNA is used as a template and a reverse transcriptase synthesizes its complementary DNA strand. RNAse H hydrolyzes the RNA template, making space for a DNA polymerase to synthesize a DNA strand complementary to the first DNA strand which is complementary to the RNA target, forming a DNA duplex. T7 RNA polymerase continuously generates complementary RNA strands of this DNA duplex. These RNA strands act as templates for new cycles of DNA synthesis, resulting in amplification of the target gene.

Rolling-circle amplification (RCA) amplifies a single stranded circular polynucleotide and involves numerous rounds of isothermal enzymatic synthesis where D29 DNA polymerase extends a primer by continuously progressing around the polynucleotide circle to replicate its sequence over and over again. Therefore, a linear copy of the circular template is achieved. A primer can then be annealed to this linear copy and its complementary chain can be synthesized. See Lizardi et al. (1998) Nature Genetics 19:225-232. A single stranded circular DNA can also serve as a template for RNA synthesis in the presence of an RNA polymerase. Daubendiek et al. (1995) JACS 117:7818-7819. An inverse rapid amplification of cDNA ends (RACE) RCA is described by Polidoros et al. A messenger RNA (mRNA) is reverse transcribed into cDNA, followed by RNAse H treatment to separate the cDNA. The cDNA is then circularized by CircLigase into a circular DNA. The amplification of the resulting circular DNA is achieved with RCA. Polidoros et al. (2006) BioTechniques 41:35-42.

Any of the foregoing methods can be utilized in the manufacture of one or more regions of the polynucleotides of the present disclosure.

Assembling polynucleotides or nucleic acids by a ligase is also widely used. DNA or RNA ligases promote intermolecular ligation of the 5' and 3' ends of polynucleotide chains through the formation of a phosphodiester bond. Ligase chain reaction (LCR) is a promising diagnosing technique based on the principle that two adjacent polynucleotide probes hybridize to one strand of a target gene and couple to each other by a ligase. If a target gene is not present, or if there is a mismatch at the target gene, such as a single-nucleotide polymorphism (SNP), the probes cannot ligase. Wiedmann et al. (1994) PCR Methods and Application 3(4):s51-s64. LCR can be combined with various amplification techniques to increase sensitivity of detection or to increase the amount of products if it is used in synthesizing polynucleotides and nucleic acids.

Several library preparation kits for nucleic acids are now commercially available. They include enzymes and buffers to convert a small amount of nucleic acid samples into an indexed library for downstream applications. For example, DNA fragments can be placed in a NEBNEXT® ULTRA™ DNA Library Prep Kit by NEWENGLAND BIOLABS® for end preparation, ligation, size selection, clean-up, PCR amplification and final clean-up.

Continued development is going on to improvement the amplification techniques. For example, U.S. Pat. No. 8,367,328 to Asada et al., teaches utilizing a reaction enhancer to increase the efficiency of DNA synthesis reactions by DNA polymerases. The reaction enhancer comprises an acidic substance or cationic complexes of an acidic substance. U.S. Pat. No. 7,384,739 to Kitabayashi et al., teaches a carboxylate ion-supplying substance that promotes enzymatic DNA synthesis, wherein the carboxylate ion-supplying substance is selected from oxalic acid, malonic acid, esters of oxalic acid, esters of malonic acid, salts of malonic acid, and esters of maleic acid. U.S. Pat. No. 7,378,262 to Sobek et al., discloses an enzyme composition to increase fidelity of DNA amplifications. The composition comprises one enzyme with 3' exonuclease activity but no polymerase activity and another enzyme that is a polymerase. Both of the enzymes are thermostable and are reversibly modified to be inactive at lower temperatures.

U.S. Pat. No. 7,550,264 to Getts et al. teaches multiple round of synthesis of sense RNA molecules are performed by attaching oligodeoxynucleotides tails onto the 3' end of cDNA molecules and initiating RNA transcription using RNA polymerase. U.S. Pat. Publication No. 2013/0183718 to Rohayem teaches RNA synthesis by RNA-dependent RNA polymerases (RdRp) displaying an RNA polymerase activity on single-stranded DNA templates. Oligonucleotides with non-standard nucleotides can be synthesized with enzymatic polymerization by contacting a template comprising non-standard nucleotides with a mixture of nucleotides that are complementary to the nucleotides of the template as disclosed in U.S. Pat. No. 6,617,106 to Benner.

Chemical Synthesis

Standard methods can be applied to synthesize an isolated polynucleotide sequence encoding an immune response primer, immune response co-stimulatory signal, or checkpoint inhibitor polypeptide of the present disclosure. For example, a single DNA or RNA oligomer containing a codon-optimized nucleotide sequence coding for the particular isolated polypeptide can be synthesized. In other aspects, several small oligonucleotides coding for portions of the desired polypeptide can be synthesized and then ligated. In some aspects, the individual oligonucleotides typically contain 5' or 3' overhangs for complementary assembly.

A polynucleotide disclosed herein (e.g., mRNA) can be chemically synthesized using chemical synthesis methods and potential nucleobase substitutions known in the art. See, for example, International Publication Nos. WO2014093924 (see also US20150307542), WO2013052523 (see also US20130115272); WO2013039857, WO2012135805 (see also US20120251618), WO2013151671 (see also US20150044277); U.S. Publ. No. US20130115272; or U.S. Pat. Nos. 8,999,380, 8,710,200.

Purification

Purification of the polynucleotides (e.g., mRNA) encoding an immune response primer, immune response co-stimulatory signal, or checkpoint inhibitor polypeptide described herein can include, but is not limited to, polynucleotide clean-up, quality assurance and quality control. Clean-up can be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified polynucleotide" refers to one that is separated from at least one contaminant. As used herein, a "contaminant" is any substance which makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

In some embodiments, purification of a polynucleotide (e.g., mRNA) encoding an immune response primer, immune response co-stimulatory signal, or checkpoint inhibitor polypeptide of the disclosure removes impurities that can reduce or remove an unwanted immune response, e.g., reducing cytokine activity.

In some embodiments, the polynucleotide (e.g., mRNA) encoding an immune response primer, immune response co-stimulatory signal, or checkpoint inhibitor polypeptide of the disclosure is purified prior to administration using column chromatography (e.g., strong anion exchange HPLC, weak anion exchange HPLC, reverse phase HPLC (RP-HPLC), and hydrophobic interaction HPLC (HIC-HPLC), or (LCMS)). In some embodiments, a column chromatography (e.g., strong anion exchange HPLC, weak anion exchange HPLC, reverse phase HPLC (RP-HPLC), and hydrophobic interaction HPLC (HIC-HPLC), or (LCMS)) purified polynucleotide, which encodes an immune response primer, immune response co-stimulatory signal, or checkpoint inhibitor polypeptide disclosed herein increases expression of the immune response primer, immune response co-stimulatory signal, or checkpoint inhibitor polypeptide compared to polynucleotides encoding the immune response primer, immune response co-stimulatory signal, or checkpoint inhibitor polypeptide purified by a different purification method.

In some embodiments, a column chromatography (e.g., strong anion exchange HPLC, weak anion exchange HPLC, reverse phase HPLC (RP-HPLC), and hydrophobic interaction HPLC (HIC-HPLC), or (LCMS)) purified polynucleotide encodes an immune response primer, immune response co-stimulatory signal, or checkpoint inhibitor polypeptide. In some embodiments, the purified polynucleotide encodes a mammalian immune response primer, immune response co-stimulatory signal, or checkpoint inhibitor polypeptide. In some embodiments, the purified polynucleotide encodes a human immune response primer, immune response co-stimulatory signal, or checkpoint inhibitor polypeptide.

In some embodiments, the purified polynucleotide encoding an immune response primer, immune response co-stimulatory signal, or checkpoint inhibitor polypeptide is at least about 80% pure, at least about 85% pure, at least about 90% pure, at least about 95% pure, at least about 96% pure, at least about 97% pure, at least about 98% pure, at least about 99% pure, or about 100% pure.

A quality assurance and/or quality control check can be conducted using methods such as, but not limited to, gel electrophoresis, UV absorbance, or analytical HPLC.

In another embodiment, the polynucleotide encoding an immune response primer, immune response co-stimulatory signal, or checkpoint inhibitor polypeptide can be sequenced by methods including, but not limited to reverse-transcriptase-PCR.

X. CHEMICAL MODIFICATIONS

As used herein in polynucleotides comprising an mRNA encoding an immune response primer, immune response co-stimulatory signal, or checkpoint inhibitor polypeptide, or combinations thereof according to the present disclosure, the terms "chemical modification" or, as appropriate, "chemically modified" refer to modification with respect to adenosine (A), guanosine (G), uridine (U), thymidine (T) or cytidine (C) ribo- or deoxyribonucleotides in one or more of their position, pattern, percent or population. Generally, herein, these terms are not intended to refer to the ribonucleotide modifications in naturally occurring 5'-terminal mRNA cap moieties.

In a polypeptide, the term "modification" refers to a modification as compared to the canonical set of 20 amino acids.

The modifications can be various distinct modifications. In some embodiments, the regions can contain one, two, or more (optionally different) nucleoside or nucleotide (nucleobase) modifications. In some embodiments, a modified polynucleotide, introduced to a cell can exhibit reduced degradation in the cell, as compared to an unmodified polynucleotide. In other embodiments, the modification is in the nucleobase and/or the sugar structure. In yet other embodiments, the modification is in the backbone structure.

Chemical Modifications

Some embodiments of the present disclosure provide a combination of mRNAs encoding an immune response primer, an immune response co-stimulatory signal, a checkpoint inhibitor polypeptide, or a combination thereof (e.g., a doublet or triplet of mRNAs to be used in a combination therapy) in which at least one of the mRNAs includes at least one chemical modification.

In some embodiments, the chemical modification is selected from pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine,), 5-methoxyuridine, and 2'-O-methyl uridine.

A "nucleoside" as used herein refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" as used herein refers to a nucleoside, including a phosphate group. Modified nucleotides can be synthesized by any useful method, such as, for example, chemically, enzymatically, or recombinantly, to include one or more modified or non-natural nucleosides. Polynucleotides can comprise a region or regions of linked nucleosides. Such regions can have variable backbone linkages. The linkages can be standard phosphodiester linkages, in which case the polynucleotides would comprise regions of nucleotides.

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker can be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the polynucleotides, compositions, methods and synthetic processes of the present disclosure include, but are not limited to the following nucleotides, nucleosides, and nucleobases: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6, N6 (dimethyl)adenine; N6-cis-hydroxy-isopentenyl-adenosine; a-thio-adenosine; 2-(amino)adenine; 2-(aminopropyl)adenine; 2-(methylthio) N6 (isopentenyl)adenine; 2-(alkyl)adenine; 2-(aminoalkyl) adenine; 2-(aminopropyl)adenine; 2-(halo)adenine; 2-(halo) adenine; 2-(propyl)adenine; 2'-amino-2'-deoxy-ATP; 2'-azido-2'-deoxy-ATP; 2'-deoxy-2'-a-aminoadenosine TP; 2'-Deoxy-2'-a-azidoadenosine TP; 6-(alkyl)adenine; 6-(methyl)adenine; 6-(alkyl)adenine; 6-(methyl)adenine; 7-(deaza)adenine; 8-(alkenyl)adenine; 8-(alkynyl)adenine; 8-(amino)adenine; 8-(thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl) adenine; 8-(thiol)adenine; 8-azido-adenosine; aza-adenine; deaza-adenine; N6-(methyl)adenine; N6-(isopentyl)adenine; 7-deaza-8-aza-adenosine; 7-methyladenine; 1-deazaadenosine TP; 2'-fluoro-N6-Bz-deoxyadenosine TP; 2'-OMe-2-amino-ATP; 2'O-methyl-N6-Bz-deoxyadenosine TP; 2'-a-ethynyladenosine TP; 2-aminoadenine; 2-aminoadenosine TP; 2-amino-ATP; 2'-a-trifluoromethyladenosine TP; 2-azidoadenosine TP; 2'-b-ethynyladenosine TP; 2-bromoadenosine TP; 2'-b-trifluoromethyladenosine TP; 2-chloroadenosine TP; 2'-deoxy-2',2'-difluoroadenosine TP; 2'-deoxy-2'-a-mercaptoadenosine TP; 2'-deoxy-2'-a-thiomethoxyadenosine TP; 2'-deoxy-2'-b-aminoadenosine TP; 2'-deoxy-2'-b-azidoadenosine TP; 2'-deoxy-2'-b-bromoadenosine TP; 2'-deoxy-2'-b-chloroadenosine TP; 2'-deoxy-2'-b-fluoroadenosine TP; 2'-deoxy-2'-b-iodoadenosine TP; 2'-deoxy-2'-b-mercaptoadenosine TP; 2'-deoxy-2'-b-thiomethoxyadenosine TP; 2-fluoroadenosine TP; 2-iodoadenosine TP; 2-mercaptoadenosine TP; 2-methoxy-adenine; 2-methylthio-adenine; 2-trifluoromethyladenosine TP; 3-deaza-3-bromoadenosine TP; 3-deaza-3-chloroadenosine TP; 3-deaza-3-fluoroadenosine TP; 3-deaza-3-iodoadenosine TP; 3-deazaadenosine TP; 4'-azidoadenosine TP; 4'-carbocyclic adenosine TP; 4'-ethynyladenosine TP; 5'-homo-adenosine TP; 8-aza-ATP; 8-bromo-adenosine TP; 8-trifluoromethyladenosine TP; 9-deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; lysidine; N4,2'-O-dimethylcytidine; N4-acetyl-2'-O-methylcytidine; N4-methylcytidine; N4,N4-dimethyl-2'-OMe-cytidine TP; 4-methylcytidine; 5-aza-cytidine; pseudo-iso-cytidine; pyrrolo-cytidine; a-thio-cytidine; 2-(thio)cytosine; 2'-amino-2'-deoxy-CTP; 2'-azido-2'-deoxy-CTP; 2'-deoxy-2'-a-aminocytidine TP; 2'-deoxy-2'-a-azidocytidine TP; 3-(deaza)-5-(aza)cytosine; 3-(methyl)cytosine; 3-(alkyl)cytosine; 3-(deaza)-5-(aza)cytosine; 3-(methyl)cytidine; 4,2'-O-dimethylcytidine; 5-(halo)cytosine; 5-(methyl)cytosine; 5-(propynyl)cytosine; 5-(trifluoromethyl)cytosine; 5-(alkyl)cytosine; 5-(alkynyl)cytosine; 5-(halo)cytosine; 5-(propynyl) cytosine; 5-(trifluoromethyl)cytosine; 5-bromo-cytidine; 5-iodo-cytidine; 5-propynyl cytosine; 6-(azo)cytosine; 6-aza-cytidine; aza-cytosine; deaza-cytosine; N4-(acetyl)cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; zebularine; (E)-5-(2-bromo-vinyl)cytidine TP; 2,2'-anhydro-cytidine TP hydrochloride; 2'fluor-N4-Bz-cytidine TP; 2'fluoro-N4-acetyl-cytidine TP; 2'-O-methyl-N4-acetyl-cytidine TP; 2'O-methyl-N4-Bz-cytidine TP; 2'-a-ethynylcytidine TP; 2'-a-trifluoromethylcytidine TP; 2'-b-ethynylcytidine TP; 2'-b-trifluoromethylcyti dine TP; 2'-deoxy-2',2'-difluorocytidine TP; 2'-deoxy-2'-a-mercaptocytidine TP; 2'-deoxy-2'-a-thiomethoxycytidine TP; 2'-deoxy-2'-b-aminocytidine TP; 2'-deoxy-2'-b-azidocytidine TP; 2'-deoxy-2'-b-bromocytidine TP; 2'-deoxy-2'-b-chlorocytidine TP; 2'-deoxy-2'-b-fluorocytidine TP; 2'-deoxy-2'-b-iodocytidine TP; 2'-deoxy-2'-b-mercaptocytidine TP; 2'-deoxy-2'-b-thiomethoxycytidine TP; 2'-O-methyl-5-(1-propynyl)cytidine TP; 3'-ethynylcytidine TP; 4'-azidocytidine TP; 4'-carbocyclic cytidine TP; 4'-ethynylcytidine TP; 5-(1-propynyl)ara-cytidine TP; 5-(2-chloro-phenyl)-2-thiocytidine TP; 5-(4-Amino-phenyl)-2-thiocytidine TP; 5-aminoallyl-CTP; 5-cyanocytidine TP; 5-ethynylara-cytidine TP; 5-ethynylcytidine TP; 5'-homo-cytidine TP; 5-methoxycytidine TP; 5-trifluoromethyl-cytidine TP; N4-amino-cytidine TP; N4-benzoyl-cytidine TP; pseudoisocytidine; 7-methylguanosine; N2,2'-O-dimethylguanosine; N2-methylguanosine; wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; archaeosine; methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; a-thio-guanosine; 2 (propyl)guanine; 2-(alkyl)guanine; 2'-amino-2'-deoxy-GTP; 2'-azido-2'-deoxy-GTP; 2'-deoxy-2'-a-aminoguanosine TP; 2'-deoxy-2'-a-azidoguanosine TP; 6-(methyl)guanine; 6-(alkyl)guanine; 6-(methyl)guanine; 6-methyl-guanosine; 7-(alkyl)guanine; 7-(deaza)guanine; 7-(methyl)guanine; 7-(alkyl)guanine; 7-(deaza)guanine; 7-(methyl)guanine; 8-(alkyl)guanine; 8-(alkynyl)guanine;

8-(halo)guanine; 8-(thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza-guanine; deaza-guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'fluoro-N2-isobutyl-guanosine TP; 2'O-methyl-N2-isobutyl-guanosine TP; 2'-a-ethynylguanosine TP; 2'-a-trifluoromethylguanosine TP; 2'-b-ethynylguanosine TP; 2'-b-trifluoromethylguanosine TP; 2'-deoxy-2',2'-difluoroguanosine TP; 2'-deoxy-2'-a-mercaptoguanosine TP; 2'-deoxy-2'-a-thiomethoxyguanosine TP; 2'-deoxy-2'-b-aminoguanosine TP; 2'-deoxy-2'-b-azidoguanosine TP; 2'-deoxy-2'-b-bromoguanosine TP; 2'-deoxy-2'-b-chloroguanosine TP; 2'-deoxy-2'-b-fluoroguanosine TP; 2'-deoxy-2'-b-iodoguanosine TP; 2'-deoxy-2'-b-mercaptoguanosine TP; 2'-deoxy-2'-b-thiomethoxyguanosine TP; 4'-azidoguanosine TP; 4'-carbocyclic guanosine TP; 4'-ethynylguanosine TP; 5'-homo-guanosine TP; 8-bromo-guanosine TP; 9-deaza-guanosine TP; N2-isobutyl-guanosine TP; 1-methylinosine; Inosine; 1,2'-O-dimethylinosine; 2'-O-methylinosine; 7-methylinosine; 2'-O-methylinosine; epoxyqueuosine; galactosyl-queuosine; mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; dihydrouridine; pseudouridine; (3-(3-amino-3-carboxypropyl)uridine; 1-methyl-3-(3-amino-5-carboxypropyl)pseudouridine; 1-methylpseduouridine; 1-ethyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-methyl-pseudo-uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carb amoylmethyluridine; 5-carboxyhydroxymethyluridine; 5-carboxyhydroxymethyluridine methyl ester; 5-carboxymethylaminomethyl-2'-O-methyluridine; 5-carboxymethyl aminomethyl-2-thiouridine; 5-carboxymethylaminomethyl-2-thiouridine; 5-carboxymethylaminomethyluridine; 5-carboxymethylaminomethyluridine; 5-carbamoylmethyluridine TP; 5-methoxycarbonylmethyl-2'-O-methyluridine; 5-methoxycarbonylmethyl-2-thiouridine; 5-methoxycarbonylmethyluridine; 5-methyluridine,), 5-methoxyuridine; 5-methyl-2-thiouridine; 5-methylaminomethyl-2-selenouridine; 5-methylaminomethyl-2-thiouridine; 5-methyl aminomethyluridine; 5-methyldihydrouridine; 5-oxyacetic-acid-uridine TP; 5-oxyacetic acid-methyl ester-Uridine TP; N1-methyl-pseudo-uracil; N1-ethyl-pseudo-uracil; uridine 5-oxyacetic acid; uridine 5-oxyacetic acid methyl ester; 3-(3-amino-3-carboxypropyl)-uridine TP; 5-(iso-pentenylaminomethyl)-2-thiouridine TP; 5-(iso-pentenylaminomethyl)-2'-O-methyluridine TP; 5-(iso-pentenylaminomethyl) uridine TP; 5-propynyl uracil; a-thio-uridine; 1-(aminoalkylamino-carbonylethylenyl)-2(thio)-pseudouracil; 1-(aminoalkylaminocarbonyl ethylenyl)-2,4-(dithio) pseudouracil; 1-(aminoalkylaminocarbonyl ethylenyl)-4-(thio)pseudouracil; 1-(aminoalkylaminocarbonyl ethylenyl)-pseudouracil; 1-(aminocarbonylethylenyl)-2 (thio)-pseudouracil; 1-(aminocarbonylethylenyl)-2,4-(dithio)pseudouracil; 1-(aminocarbonylethylenyl)-4 (thio) pseudouracil; 1-(aminocarbonylethyl enyl)-pseudouracil; 1 substituted 2(thio)-pseudouracil; 1 substituted 2,4-(dithio) pseudouracil; 1 substituted 4 (thio)pseudouracil; 1 substituted pseudouracil; 1-(aminoalkylamino-carbonylethylenyl)-2-(thio)-pseudouracil; 1-methyl-3-(3-amino-3-carboxypropyl) pseudouridine TP; 1-Methyl-3-(3-amino-3-carboxypropyl)pseudo-UTP; 1-methyl-pseudo-UTP; 1-ethyl-pseudo-UTP; 2 (thio)pseudouracil; 2' deoxy uridine; 2' fluorouridine; 2-(thio)uracil; 2,4-(dithio)pseudouracil; 2' methyl, 2'amino, 2'azido, 2'fluro-guanosine; 2'-amino-2'-deoxy-UTP; 2'-azido-2'-deoxy-UTP; 2'-azido-deoxyuridine TP; 2'-O-methylpseudouridine; 2' deoxy-uridine; 2' fluorouridine; 2'-deoxy-2'-a-aminouridine TP; 2'-deoxy-2'-a-azidouridine TP; 2-methylpseudouridine; 3-(3-amino-3-carboxypropyl)uracil; 4-(thio)pseudouracil; 4-(thio) pseudouracil; 4-(thio)uracil; 4-thiouracil; 5 (1,3-diazole-1-alkyl)uracil; 5-(2-aminopropyl)uracil; 5-(aminoalkyl)uracil; 5-(dimethylaminoalkyl)uracil; 5-(guanidiniumalkyl)uracil; 5-(methoxycarbonylmethyl)-2-(thio)uracil; 5-(methoxycarbonyl-methyl)uracil; 5-(methyl)-2-(thio)uracil; 5-(methyl)-2,4-(dithio)uracil; 5-(methyl)-4-(thio)uracil; 5-(methylaminomethyl)-2-(thio)uracil; 5-(methylaminomethyl)-2,4-(dithio)uracil; 5-(methylaminomethyl)-4-(thio)uracil; 5-(propynyl)uracil; 5-(trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio)pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl)uracil; 5-(guanidiniumalkyl)uracil; 5-(halo)uracil; 5-(1,3-diazole-1-alkyl)uracil; 5-(methoxy)uracil; 5-(methoxycarbonylmethyl)-2-(thio) uracil; 5-(methoxycarbonyl-methyl)uracil; 5-(methyl) 2(thio)uracil; 5-(methyl)-2,4-(dithio)uracil; 5-(methyl)-4-(thio)uracil; 5-(methyl)-2-(thio)pseudouracil; 5-(methyl)-2,4-(dithio)pseudouracil; 5-(methyl)-4-(thio)pseudouracil; 5-(methyl)pseudouracil; 5-(methylaminomethyl)-2-(thio) uracil; 5-(methylaminomethyl)-2,4(dithio)uracil; 5-(methylaminomethyl)-4-(thio)uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza-uracil; deaza-uracil; N3 (methyl)uracil; pseudo-UTP-1-2-ethanoic acid; pseudouracil; 4-thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; dihydropseudouridine; (±)1-(2-hydroxypropyl)pseudouridine TP; (2R)-1-(2-hydroxypropyl)pseudouridine TP; (2S)-1-(2-hydroxypropyl) pseudouridine TP; (E)-5-(2-bromo-vinyl)ara-uridine TP; (E)-5-(2-bromo-vinyl)uridine TP; (Z)-5-(2-bromo-vinyl) ara-uridine TP; (Z)-5-(2-bromo-vinyl)uridine TP; 1-(2,2,2-trifluoroethyl)-pseudo-UTP; 1-(2,2,3,3,3-pentafluoropropyl)pseudouridine TP; 1-(2,2-diethoxyethyl)pseudouridine TP; 1-(2,4,6-trimethylbenzyl)pseudouridine TP; 1-(2,4,6-trimethyl-benzyl)pseudo-UTP; 1-(2,4,6-trimethyl-phenyl) pseudo-UTP; 1-(2-amino-2-carboxyethyl)pseudo-UTP; 1-(2-amino-ethyl)pseudo-UTP; 1-(2-hydroxyethyl) pseudouridine TP; 1-(2-methoxyethyl)pseudouridine TP; 1-(3,4-bis-trifluoromethoxybenzyl)pseudouridine TP; 1-(3,4-dimethoxybenzyl)pseudouridine TP; 1-(3-amino-3-carboxypropyl)pseudo-UTP; 1-(3-amino-propyl)pseudo-UTP; 1-(3-cyclopropyl-prop-2-ynyl)pseudouridine TP; 1-(4-amino-4-carboxybutyl)pseudo-UTP; 1-(4-amino-benzyl) pseudo-UTP; 1-(4-amino-butyl)pseudo-UTP; 1-(4-amino-phenyl)pseudo-UTP; 1-(4-azidobenzyl)pseudouridine TP; 1-(4-bromobenzyl)pseudouridine TP; 1-(4-chlorobenzyl) pseudouridine TP; 1-(4-fluorobenzyl)pseudouridine TP; 1-(4-iodobenzyl)pseudouridine TP; 1-(4-methanesulfonylbenzyl)pseudouridine TP; 1-(4-methoxybenzyl)pseudouridine TP; 1-(4-methoxy-benzyl)pseudo-UTP; 1-(4-methoxy-phenyl)pseudo-UTP; 1-(4-methylbenzyl)pseudouridine TP; 1-(4-methyl-benzyl)pseudo-UTP; 1-(4-nitrobenzyl) pseudouridine TP; 1-(4-nitro-benzyl)pseudo-UTP; 1(4-nitro-phenyl)pseudo-UTP; 1-(4-thiomethoxybenzyl)pseudouridine TP; 1-(4-trifluoromethoxybenzyl)pseudouridine TP; 1-(4-trifluoromethylbenzyl)pseudouridine TP; 1-(5-amino-pentyl)pseudo-UTP; 1-(6-amino-hexyl)pseudo-UTP; 1,6-dimethyl-pseudo-UTP; 1-[3-(2-{2-[2-(2-aminoethoxy)-ethoxy]-ethoxy}-ethoxy)-propionyl]pseudouridine TP; 1-{3-[2-(2-aminoethoxy)-ethoxy]-propionyl}pseudouridine TP; 1-acetylpseudouridine TP; 1-alkyl-6-(1-propynyl)-pseudo-UTP; 1-alkyl-6-(2-propynyl)-pseudo-UTP; 1-alkyl-6-allyl-pseudo-UTP; 1-alkyl-6-ethynyl-pseudo-UTP; 1-alkyl-6-homoallyl-pseudo-UTP; 1-alkyl-6-vinyl-pseudo-UTP; 1-allylpseudouridine TP; 1-aminomethyl-pseudo-UTP; 1-benzoylpseudouridine TP; 1-benzyloxymethylpseudouridine TP; 1-benzyl-pseudo-UTP; 1-biotinyl-PEG2-pseudouridine TP; 1-biotinylpseudouridine TP; 1-butyl-pseudo-UTP; 1-cyanomethylpseudouridine TP; 1-cyclobutylmethyl-pseudo-UTP; 1-cyclobutyl-pseudo-UTP; 1-cycloheptylmethyl-pseudo-UTP; 1-cycloheptyl-pseudo-UTP; 1-cyclohexylmethyl-pseudo-UTP; 1-cyclohexyl-pseudo-UTP; 1-cyclooctylmethyl-pseudo-UTP; 1-cyclooctyl-pseudo-UTP; 1-cyclopentylmethyl-pseudo-UTP; 1-cyclopentyl-pseudo-UTP; 1-cyclopropylmethyl-pseudo-UTP; 1-cyclopropyl-pseudo-UTP; 1-ethyl-pseudo-UTP; 1-hexyl-pseudo-UTP; 1-homoallylpseudouridine TP; 1-hydroxymethylpseudouridine TP; 1-iso-propyl-pseudo-UTP; 1-methyl-2-thio-pseudo-UTP; 1-methyl-4-thio-pseudo-UTP; 1-methyl-alpha-thio-pseudo-UTP; 1-methanesulfonylmethylpseudouridine TP; 1-methoxymethylpseudouridine TP; 1-methyl-6-(2,2,2-Trifluoroethyl)pseudo-UTP; 1-methyl-6-(4-morpholino)-pseudo-UTP; 1-methyl-6-(4-thiomorpholino)-pseudo-UTP; 1-methyl-6-(substituted phenyl)pseudo-UTP; 1-methyl-6-amino-pseudo-UTP; 1-methyl-6-azido-pseudo-UTP; 1-methyl-6-bromo-pseudo-UTP; 1-methyl-6-butyl-pseudo-UTP; 1-methyl-6-chloro-pseudo-UTP; 1-methyl-6-cyano-pseudo-UTP; 1-methyl-6-dimethylamino-pseudo-UTP; 1-methyl-6-ethoxy-pseudo-UTP; 1-methyl-6-ethylcarboxylate-pseudo-UTP; 1-methyl-6-ethyl-pseudo-UTP; 1-methyl-6-fluoro-pseudo-UTP; 1-methyl-6-formyl-pseudo-UTP; 1-methyl-6-hydroxyamino-pseudo-UTP; 1-methyl-6-hydroxy-pseudo-UTP; 1-methyl-6-iodo-pseudo-UTP; 1-methyl-6-iso-propyl-pseudo-UTP; 1-methyl-6-methoxy-pseudo-UTP; 1-methyl-6-methyl amino-pseudo-UTP; 1-methyl-6-phenyl-pseudo-UTP; 1-methyl-6-propyl-pseudo-UTP; 1-methyl-6-tert-butyl-pseudo-UTP; 1-methyl-6-trifluoromethoxy-pseudo-UTP; 1-methyl-6-trifluoromethyl-pseudo-UTP; 1-morpholinomethylpseudouridine TP; 1-pentyl-pseudo-UTP; 1-phenyl-pseudo-UTP; 1-pivaloylpseudouridine TP; 1-propargylpseudouridine TP; 1-propyl-pseudo-UTP; 1-propynyl-pseudouridine; 1-p-tolyl-pseudo-UTP; 1-tert-butyl-pseudo-UTP; 1-thiomethoxymethylpseudouridine TP; 1-thiomorpholinomethylpseudouridine TP; 1-trifluoroacetylpseudouridine TP; 1-trifluoromethyl-pseudo-UTP; 1-vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-ethynyluridine TP; 2'-a-trifluoromethyluridine TP; 2'-b-ethynyluridine TP; 2'-b-trifluoromethyluridine TP; 2'-deoxy-2',2'-difluorouridine TP; 2'-deoxy-2'-a-mercaptouridine TP; 2'-deoxy-2'-a-thiomethoxyuridine TP; 2'-deoxy-2'-b-aminouridine TP; 2'-deoxy-2'-b-azidouridine TP; 2'-deoxy-2'-b-bromouridine TP; 2'-deoxy-2'-b-chlorouridine TP; 2'-deoxy-2'-b-fluorouridine TP; 2'-deoxy-2'-b-iodouridine TP; 2'-deoxy-2'-b-mercaptouridine TP; 2'-deoxy-2'-b-thiomethoxyuridine TP; 2-methoxy-4-thio-uridine; 2-methoxyuridine; 2'-O-Methyl-5-(1-propynyl)uridine TP; 3-alkyl-pseudo-UTP; 4'-azidouridine TP; 4'-carbocyclic uridine TP; 4'-ethynyluridine TP; 5-(1-propynyl)ara-uridine TP; 5-(2-furanyl)uridine TP; 5-cyanouridine TP; 5-dimethylaminouridine TP; 5'-homo-uridine TP; 5-iodo-2'-fluoro-deoxyuridine TP; 5-phenylethynyluridine TP; 5-trideuteromethyl-6-deuterouridine TP; 5-trifluoromethyl-uridine TP; 5-vinylarauridine TP; 6-(2,2,2-trifluoroethyl)-pseudo-UTP; 6-(4-morpholino)-pseudo-UTP; 6-(4-thiomorpholino)-pseudo-UTP; 6-(substituted-phenyl)-pseudo-UTP; 6-amino-pseudo-UTP; 6-azido-pseudo-UTP; 6-bromo-pseudo-UTP; 6-butyl-pseudo-UTP; 6-chloro-pseudo-UTP; 6-cyano-pseudo-UTP; 6-dimethylamino-pseudo-UTP; 6-ethoxy-pseudo-UTP; 6-ethylcarboxylate-pseudo-UTP; 6-ethyl-pseudo-UTP; 6-fluoro-pseudo-UTP; 6-formyl-pseudo-UTP; 6-hydroxyamino-pseudo-UTP; 6-hydroxy-pseudo-UTP; 6-iodo-pseudo-UTP; 6-iso-propyl-pseudo-UTP; 6-methoxy-pseudo-UTP; 6-methylamino-pseudo-UTP; 6-methyl-pseudo-UTP; 6-phenyl-pseudo-UTP; 6-phenyl-pseudo-UTP; 6-propyl-pseudo-UTP; 6-tert-butyl-pseudo-UTP; 6-trifluoromethoxy-pseudo-UTP; 6-trifluoromethyl-pseudo-UTP; alpha-thio-pseudo-UTP; pseudouridine-1-(4-methylbenzenesulfonic acid) TP; pseudouridine 1-(4-methylbenzoic acid) TP; pseudouridine TP 1-[3-(2-ethoxy)]propionic acid; pseudouridine TP 1-[3-{2-(2-[2-(2-ethoxy)-ethoxy]-ethoxy)-ethoxy}]propionic acid; pseudouridine TP 1-[3-{2-(2-[2-{2(2-ethoxy)-ethoxy}-ethoxy]-ethoxy)-ethoxy}]propionic acid; pseudouridine TP 1-[3-{2-(2-[2-ethoxy]-ethoxy)-ethoxy}]propionic acid; pseudouridine TP 1-[3-{2-(2-ethoxy)-ethoxy}] propionic acid; pseudouridine TP 1-methylphosphonic acid; pseudouridine TP 1-methylphosphonic acid diethyl ester; pseudo-UTP-N1-3-propionic acid; pseudo-UTP-N1-4-butanoic acid; pseudo-UTP-N1-5-pentanoic acid; pseudo-UTP-N1-6-hexanoic acid; pseudo-UTP-N1-7-heptanoic acid; pseudo-UTP-N1-methyl-p-benzoic acid; pseudo-UTP-N1-p-benzoic acid; wybutosine; hydroxywybutosine; isowyosine; peroxywybutosine; undermodified hydroxywybutosine; 4-demethylwyosine; 2,6-(diamino)purine; 1-(aza)-2-(thio)-3-(aza)-phenoxazin-1-yl: 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2-(amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)- phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; aminoindolyl; anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; difluorotolyl; hypoxanthine; imidizopyridinyl; inosinyl; isocarbostyrilyl; isoguanisine; N2-substituted purines; N6-methyl-2-amino-purine; N6-substituted purines; N-alkylated derivative; napthalenyl; nitrobenzimidazolyl; nitroimidazolyl; nitroindazolyl; nitropyrazolyl; nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; pentacenyl; phenanthracenyl; phenyl; propynyl-7-(aza)indolyl; pyrenyl; pyridopyrimidin-3-yl; pyridopyrimidin-3-yl, 2-oxo-7-amino-pyridopyrimidin-3-yl; pyrrolo-pyrimidin-2-on-3-yl; pyrrolopyrimidinyl; pyrrolopyrizinyl; stilbenzyl; substituted 1,2,4-triazoles; tetracenyl; tubercidine; xanthine; xanthosine-5'-TP; 2-thio-zebularine; 5-aza-2-thio-zebularine; 7-deaza-2-amino-purine; pyridin-4-one ribonucleoside; 2-amino-riboside-TP; formycin A TP; formycin B TP; pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, the polynucleotides of the combination therapies of the present disclosure include a combination of at least two (e.g., 2, 3, 4 or more) of the aforementioned modified nucleobases. Thus, polynucleotides comprising an mRNA encoding an immune response primer of the present disclosure can include a combination of at least two (e.g., 2, 3, 4 or more) of the aforementioned modified nucleobases; polynucleotides comprising an mRNA encoding an immune response co-stimulatory signal of the present disclosure can include a combination of at least two (e.g., 2, 3, 4 or more) of the aforementioned modified nucleobases; and polynucleotides comprising an mRNA encoding a checkpoint inhibitor of the present disclosure can include a combination of at least two (e.g., 2, 3, 4 or more) of the aforementioned modified nucleobases. In some embodiments, all the mRNAs in a combination therapy disclosed herein include a combination of at least two (e.g., 2, 3, 4 or more) of the aforementioned modified nucleobases. In other embodiments, only some of the mRNA in a combination therapy disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide) include a combination of at least two (e.g., 2, 3, 4 or more) of the aforementioned modified nucleobases.

In some embodiments, modified nucleobases in a polynucleotide comprising an mRNA encoding an immune response primer of the present disclosure, and/or modified nucleobases in a polynucleotide comprising an mRNA encoding an immune response co-stimulatory signal of the present disclosure, and/or modified nucleobases in a polynucleotide comprising an mRNA encoding a checkpoint inhibitor of the present disclosure, or a combination thereof, are selected from the group consisting of pseudouridine (ψ), 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine,), 5-methoxyuridine, 2'-O-methyl uridine 1-methyl-pseudouridine (m1ψ), 1-ethyl-pseudouridine (e1ψ), 5-methoxy-uridine (mo5U), 5-methyl-cytidine (m5C), α-thio-guanosine, α-thio-adenosine, 5-cyano uridine, 4'-thio uridine 7-deaza-adenine, 1-methyl-adenosine (m1A), 2-methyl-adenine (m2A), N6-methyl-adenosine (m6A), and 2,6-diaminopurine, (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine, 2,8-dimethyladenosine, 2-geranylthiouridine, 2-lysidine, 2-selenouridine, 3-(3-amino-3-carboxypropyl)-5,6-dihydrouridine, 3-(3-amino-3-carboxypropyl)pseudouridine, 3-methylpseudouridine, 5-(carboxyhydroxymethyl)-2'-O-methyluridine methyl ester, 5-aminomethyl-2-geranylthiouridine, 5-aminomethyl-2-selenouridine, 5-aminomethyluridine, 5-carbamoylhydroxymethyluridine, 5-carbamoylmethyl-2-thiouridine, 5-carboxymethyl-2-thiouridine, 5-carboxymethylaminomethyl-2-geranylthiouridine, 5-carboxymethylaminomethyl-2-selenouridine, 5-cyanomethyluridine, 5-hydroxycytidine, 5-methylaminomethyl-2-geranylthiouridine, 7-aminocarboxypropyl-demethylwyosine, 7-aminocarboxypropylwyosine, 7-aminocarboxypropylwyosine methyl ester, 8-methyladenosine, N4,N4-dimethylcytidine, N6-formyladenosine, N6-hydroxymethyladenosine, agmatidine, cyclic N6-threonylcarbamoyladenosine, glutamylqueuosine, methylated undermodified hydroxywybutosine, N4,N4,2'-O-trimethylcytidine, geranylated 5-methylaminomethyl-2-thiouridine, geranylated 5-carboxymethylaminomethyl-2-thiouridine, Qbase, preQ0base, preQ1base, and two or more combinations thereof.

In some embodiments, the at least one chemically modified nucleoside is selected from the group consisting of pseudouridine, 1-methyl-pseudouridine, 1-ethyl-pseudouridine, 5-methylcytosine, 5-methoxyuridine, and a combination thereof.

Base Modifications

In certain embodiments, the chemical modification is at nucleobases in the polynucleotides (e.g., RNA polynucleotide, such as mRNA polynucleotide). In some embodiments, modified nucleobases in the polynucleotide (e.g., RNA polynucleotide, such as mRNA polynucleotide) are selected from the group consisting of 1-methyl-pseudouridine (m1ψ), 1-ethyl-pseudouridine (e1ψ),5-methoxy-uridine (mo5U), 5-methyl-cytidine (m5C), pseudouridine (ψ), α-thio-guanosine and α-thio-adenosine.

In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-ethyl-pseudouridine (e1ψ). In some embodiments, the polynucleotide (e.g., RNA polynucleotide, such as mRNA polynucleotide) comprises 1-methyl-pseudouridine (m1ψ) and 5-methyl-cytidine (m5C). In some embodiments, the polynucleotide (e.g., RNA polynucleotide, such as mRNA polynucleotide) comprises 1-ethyl-pseudouridine (e1ψ) and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the chemically modified nucleosides in the open reading frame are selected from the group consisting of uridine, adenine, cytosine, guanine, and any combination thereof.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenine (m6A), and 2,6-diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the nucleobase modified nucleotides in the polynucleotide (e.g., RNA polynucleotide, such as mRNA polynucleotide) are 5-methoxyuridine.

In some embodiments, the polynucleotide (e.g., RNA polynucleotide, such as mRNA polynucleotide) includes a combination of at least two (e.g., 2, 3, 4 or more) of modified nucleobases.

In some embodiments, at least 95% of a type of nucleobases (e.g., uracil) in a polynucleotide of the disclosure (e.g., an mRNA polynucleotide encoding an immune response primer, an immune response co-stimulatory signal, or a checkpoint inhibitor polypeptide) are modified nucleobases. In some embodiments, at least 95% of uracil in a polynucleotide of the present disclosure (e.g., e.g., an mRNA polynucleotide encoding an immune response primer, an immune response co-stimulatory signal, or a checkpoint inhibitor polypeptide) is 5-methoxyuracil.

In some embodiments, the polynucleotide (e.g., RNA polynucleotide, such as an mRNA polynucleotide) comprises 5-methoxyuridine (5mo5U) and 5-methyl-cytidine (m5C).

In some embodiments, the polynucleotide (e.g., an RNA polynucleotide, such as an mRNA polynucleotide) is uniformly modified (e.g., fully modified, modified throughout the entire sequence) for a particular modification. For example, a polynucleotide can be uniformly modified with 5-methoxyuridine, meaning that substantially all uridine residues in the mRNA sequence are replaced with 5-methoxyuridine. Similarly, a polynucleotide can be uniformly modified for any type of nucleoside residue present in the sequence by replacement with a modified residue such as any of those set forth above.

In some embodiments, the modified nucleobase is a modified cytosine.

In some embodiments, a modified nucleobase is a modified uracil. Example nucleobases and nucleosides having a modified uracil include 5-methoxyuracil.

In some embodiments, a modified nucleobase is a modified adenine.

In some embodiments, a modified nucleobase is a modified guanine.

In some embodiments, the nucleobases, sugar, backbone, or any combination thereof in an open reading frame encoding an immune response primer, an immune response co-stimulatory signal, or a checkpoint inhibitor polypeptide of the present disclosure, are chemically modified by at least 10%, at least 20%, at least 30%, at least 40%, at least 50%, at least 60%, at least 70%, at least 80%, at least 90%, at least 95%, at least 99%, or 100%. In some embodiments, the nucleobases, sugar, backbone, or any combination thereof in all the polynucleotides encoding an immune response primer and/or an immune response co-stimulatory signal and/or a checkpoint inhibitor polypeptide, and/or any combination thereof, in a combination therapy of the present disclosure, are chemically modified by at least 10%, at least 20%, at least 30%, at least 40%, at least 50%, at least 60%, at least 70%, at least 80%, at least 90%, at least 95%, at least 99%, or 100%.

In some embodiments, the uridine nucleosides in the open reading frame encoding an immune response primer, an immune response co-stimulatory signal, or a checkpoint inhibitor polypeptide of the present disclosure, are chemically modified by at least 10%, at least 20%, at least 30%, at least 40%, at least 50%, at least 60%, at least 70%, at least 80%, at least 90%, at least 95%, at least 99%, or 100%. In some embodiments, the uridine nucleosides in all the polynucleotides encoding an immune response primer and/or an immune response co-stimulatory signal and/or a checkpoint inhibitor polypeptide, and/or any combination thereof, in a combination therapy of the present disclosure, are chemically modified by at least 10%, at least 20%, at least 30%, at least 40%, at least 50%, at least 60%, at least 70%, at least 80%, at least 90%, at least 95%, at least 99%, or 100%.

In some embodiments, the adenosine nucleosides in the open reading frame encoding an immune response primer, an immune response co-stimulatory signal, or a checkpoint inhibitor polypeptide of the present disclosure, are chemically modified by at least 10%, at least 20%, at least 30%, at least 40%, at least 50%, at least 60%, at least 70%, at least 80%, at least 90%, at least 95%, at least 99%, or 100%. In some embodiments, the adenosine nucleosides in all the polynucleotides encoding an immune response primer and/or an immune response co-stimulatory signal and/or a checkpoint inhibitor polypeptide, and/or any combination thereof, in a combination therapy of the present disclosure, are chemically modified by at least 10%, at least 20%, at least 30%, at least 40%, at least 50%, at least 60%, at least 70%, at least 80%, at least 90%, at least 95%, at least 99%, or 100%.

In some embodiments, the cytidine nucleosides in the open reading frame encoding an immune response primer, an immune response co-stimulatory signal, or a checkpoint inhibitor polypeptide of the present disclosure, are chemically modified by at least at least 10%, at least 20%, at least 30%, at least 40%, at least 50%, at least 60%, at least 70%, at least 80%, at least 90%, at least 95%, at least 99%, or 100%. In some embodiments, the cytidine nucleosides in all the polynucleotides encoding an immune response primer and/or an immune response co-stimulatory signal and/or a checkpoint inhibitor polypeptide, and/or any combination thereof, in a combination therapy of the present disclosure, are chemically modified by at least 10%, at least 20%, at least 30%, at least 40%, at least 50%, at least 60%, at least 70%, at least 80%, at least 90%, at least 95%, at least 99%, or 100%.

In some embodiments, the guanosine nucleosides in the open reading frame encoding an immune response primer, an immune response co-stimulatory signal, or a checkpoint inhibitor polypeptide of the present disclosure, are chemically modified by at least at least 10%, at least 20%, at least 30%, at least 40%, at least 50%, at least 60%, at least 70%, at least 80%, at least 90%, at least 95%, at least 99%, or 100%. In some embodiments, the guanosine nucleosides in all the polynucleotides encoding an immune response primer and/or an immune response co-stimulatory signal and/or a checkpoint inhibitor polypeptide, and/or any combination thereof, in a combination therapy of the present disclosure, are chemically modified by at least 10%, at least 20%, at least 30%, at least 40%, at least 50%, at least 60%, at least 70%, at least 80%, at least 90%, at least 95%, at least 99%, or 100%.

In some embodiments, the polynucleotides can include any useful linker between the nucleosides. Such linkers, including backbone modifications, that are useful in the composition of the present disclosure include, but are not limited to the following: 3'-alkylene phosphonates, 3'-amino phosphoramidate, alkene containing backbones, aminoalkylphosphoramidates, aminoalkylphosphotriesters, boranophosphates, $—CH_2—O—N(CH_3)—CH_2—$, $—CH_2—N(CH_3)—N(CH_3)—CH_2—$, $—CH_2—NH—CH_2—$, chiral phosphonates, chiral phosphorothioates, formacetyl and thioformacetyl backbones, methylene (methylimino), methylene formacetyl and thioformacetyl backbones, methyleneimino and methylenehydrazino backbones, morpholino linkages, $—N(CH_3)—CH_2—CH_2—$, oligonucleosides with heteroatom internucleoside linkage, phosphinates, phosphoramidates, phosphorodithioates, phosphorothioate internucleoside linkages, phosphorothioates, phosphotriesters, PNA, siloxane backbones, sulfamate backbones, sulfide sulfoxide and sulfone backbones, sulfonate and sulfonamide backbones, thionoalkylphosphonates, thionoalkylphosphotriesters, and thionophosphoramidates.

In some embodiments, modified nucleobases in the polynucleotide comprising an mRNA encoding an immune response primer, an immune response co-stimulatory signal, or a checkpoint inhibitor polypeptide of the present disclosure, are selected from the group consisting of 1-methyl-pseudouridine (m1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide comprising an mRNA encoding an immune response primer, an immune response co-stimulatory signal, or a checkpoint inhibitor polypeptide of the present disclosure, comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide comprising an mRNA encoding an IL23 polypeptide, the polynucleotide comprising an mRNA encoding an IL36-gamma polypeptide, the polynucleotide comprising an mRNA encoding an OX40L polypeptide, or any combination thereof, comprise 1-methyl-pseudouridine (m1ψ) and 5-methyl-cytidine (m5C).

In some embodiments, the polynucleotide comprising an mRNA encoding an immune response primer, an immune response co-stimulatory signal, or a checkpoint inhibitor polypeptide of the present disclosure, comprises 2-thiouridine (s2U). In some embodiments, the polynucleotide comprising an mRNA encoding an immune response primer, an immune response co-stimulatory signal, or a checkpoint inhibitor polypeptide of the present disclosure, comprises 2-thiouridine and 5-methyl-cytidine (m5C).

In some embodiments, the polynucleotide comprising an mRNA encoding an immune response primer, an immune response co-stimulatory signal, or a checkpoint inhibitor polypeptide of the present disclosure, comprises methoxy-uridine (mo5U). In some embodiments, the polynucleotide comprising an mRNA encoding an immune response primer, an immune response co-stimulatory signal, or a checkpoint inhibitor polypeptide of the present disclosure, comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine.

In some embodiments, the polynucleotide comprising an mRNA encoding an immune response primer, an immune response co-stimulatory signal, or a checkpoint inhibitor polypeptide of the present disclosure, comprises 2'-O-methyl uridine and 5-methyl-cytidine (m5C). In some embodiments, the polynucleotide comprising an mRNA encoding an immune response primer, an immune response co-stimulatory signal, or a checkpoint inhibitor polypeptide of the present disclosure, comprises N6-methyl-adenosine (m6A). In some embodiments, the polynucleotide comprising an immune response primer, an immune response co-stimulatory signal, or a checkpoint inhibitor polypeptide of the present disclosure, comprises N6-methyl-adenosine (m6A) and 5-methyl-cytidine (m5C).

In some embodiments, the polynucleotide comprising an mRNA encoding an immune response primer, an immune response co-stimulatory signal, or a checkpoint inhibitor polypeptide of the present disclosure, are uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenosine (m6A), and 2,6-diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, or 7-methyl-8-oxo-guanosine.

Other modifications which can be useful in the polynucleotide comprising an mRNA encoding an immune response primer, an immune response co-stimulatory signal, or a checkpoint inhibitor polypeptide of the present disclosure are listed in TABLE 23.

TABLE 23

Additional Modification types

| Name | Type |
|---|---|
| 2,6-(diamino)purine | Other |
| 1-(aza)-2-(thio)-3-(aza)-phenoxazin-1-yl | Other |
| 1,3-(diaza)-2-(oxo)-phenthiazin-1-yl | Other |
| 1,3-(diaza)-2-(oxo)-phenoxazin-1-yl | Other |
| 1,3,5-(triaza)-2,6-(dioxa)-naphthalene | Other |
| 2 (amino)purine | Other |

TABLE 23-continued

Additional Modification types

| Name | Type |
|---|---|
| 2,4,5-(trimethyl)phenyl | Other |
| 2' methyl, 2'amino, 2'azido, 2'fluro-cytidine | Other |
| 2' methyl, 2'amino, 2'azido, 2'fluro-adenine | Other |
| 2'methyl, 2'amino, 2'azido, 2'fluro-uridine | Other |
| 2'-amino-2'-deoxyribose | Other |
| 2-amino-6-Chloro-purine | Other |
| 2-aza-inosinyl | Other |
| 2'-azido-2'-deoxyribose | Other |
| 2'fluoro-2'-deoxyribose | Other |
| 2'-fluoro-modified bases | Other |
| 2'-O-methyl-ribose | Other |
| 2-oxo-7-aminopyridopyrimidin-3-yl | Other |
| 2-oxo-pyridopyrimidine-3-yl | Other |
| 2-pyridinone | Other |
| 3 nitropyrrole | Other |
| 3-(methyl)-7-(propynyl)isocarbostyrilyl | Other |
| 3-(methyl)isocarbostyrilyl | Other |
| 4-(fluoro)-6-(methyl)benzimidazole | Other |
| 4-(methyl)benzimidazole | Other |
| 4-(methyl)indolyl | Other |
| 4,6-(dimethyl)indolyl | Other |
| 5 nitroindole | Other |
| 5 substituted pyrimidines | Other |
| 5-(methyl)isocarbostyrilyl | Other |
| 5-nitroindole | Other |
| 6-(aza)pyrimidine | Other |
| 6-(azo)thymine | Other |
| 6-(methyl)-7-(aza)indolyl | Other |
| 6-chloro-purine | Other |
| 6-phenyl-pyrrolo-pyrimidin-2-on-3-yl | Other |
| 7-(aminoalkylhydroxy)-1-(aza)-2-(thio)-3-(aza)-phenthiazin-1-yl | Other |
| 7-(aminoalkylhydroxy)-1-(aza)-2-(thio)-3-(aza)-phenoxazin-1-yl | Other |
| 7-(aminoalkylhydroxy)-1,3-(diaza)-2-(oxo)-phenoxazin-1-yl | Other |
| 7-(aminoalkylhydroxy)-1,3-(diaza)-2-(oxo)-phenthiazin-1-yl | Other |
| 7-(aminoalkylhydroxy)-1,3-(diaza)-2-(oxo)-phenoxazin-1-yl | Other |
| 7-(aza)indolyl | Other |
| 7-(guanidiniumalkylhydroxy)-1-(aza)-2-(thio)-3-(aza)-phenoxazinl-yl | Other |
| 7-(guanidiniumalkylhydroxy)-1-(aza)-2-(thio)-3-(aza)-phenthiazin-1-yl | Other |
| 7-(guanidiniumalkylhydroxy)-1-(aza)-2-(thio)-3-(aza)-phenoxazin-1-yl | Other |
| 7-(guanidiniumalkylhydroxy)-1,3-(diaza)-2-(oxo)-phenoxazin-1-yl | Other |
| 7-(guanidiniumalkyl-hydroxy)-1,3-(diaza)-2-(oxo)-phenthiazin-1-yl | Other |
| 7-(guanidiniumalkylhydroxy)-1,3-(diaza)-2-(oxo)-phenoxazin-1-yl | Other |
| 7-(propynyl)isocarbostyrilyl | Other |
| 7-(propynyl)isocarbostyrilyl, propynyl-7-(aza)indolyl | Other |
| 7-deaza-inosinyl | Other |
| 7-substituted 1-(aza)-2-(thio)-3-(aza)-phenoxazin-1-yl | Other |
| 7-substituted 1,3-(diaza)-2-(oxo)-phenoxazin-1-yl | Other |
| 9-(methyl)-imidizopyridinyl | Other |
| Aminoindolyl | Other |
| Anthracenyl | Other |
| bis-ortho-(aminoalkylhydroxy)-6-phenyl-pyrrolo-pyrimidin-2-on-3-yl | Other |
| bis-ortho-substituted-6-phenyl-pyrrolo-pyrimidin-2-on-3-yl | Other |
| Difluorotolyl | Other |
| Hypoxanthine | Other |
| Imidizopyridinyl | Other |
| Inosinyl | Other |
| Isocarbostyrilyl | Other |
| Isoguanisine | Other |
| N2-substituted purines | Other |
| N6-methyl-2-amino-purine | Other |
| N6-substituted purines | Other |
| N-alkylated derivative | Other |
| Napthalenyl | Other |
| Nitrobenzimidazolyl | Other |
| Nitroimidazolyl | Other |
| Nitroindazolyl | Other |
| Nitropyrazolyl | Other |
| Nubularine | Other |
| O6-substituted purines | Other |

TABLE 23-continued

| Additional Modification types | |
|---|---|
| Name | Type |
| O-alkylated derivative | Other |
| ortho-(aminoalkylhydroxy)-6-phenyl-pyrrolo-pyrimidin-2-on-3-yl | Other |
| ortho-substituted-6-phenyl-pyrrolo-pyrimidin-2-on-3-yl | Other |
| Oxoformycin TP | Other |
| para-(aminoalkylhydroxy)-6-phenyl-pyrrolo-pyrimidin-2-on-3-yl | Other |
| para-substituted-6-phenyl-pyrrolo-pyrimidin-2-on-3-yl | Other |
| Pentacenyl | Other |
| Phenanthracenyl | Other |
| Phenyl | Other |
| propynyl-7-(aza)indolyl | Other |
| Pyrenyl | Other |
| pyridopyrimidin-3-yl | Other |
| pyridopyrimidin-3-yl, 2-oxo-7-amino-pyridopyrimidin-3-yl | Other |
| pyrrolo-pyrimidin-2-on-3-yl | Other |
| Pyrrolopyrimidinyl | Other |
| Pyrrolopyrizinyl | Other |
| Stilbenzyl | Other |
| substituted 1,2,4-triazoles | Other |
| Tetracenyl | Other |
| Tubercidine | Other |
| Xanthine | Other |
| Xanthosine-5'-TP | Other |
| 2-thio-zebularine | Other |
| 5-aza-2-thio-zebularine | Other |
| 7-deaza-2-amino-purine | Other |
| pyridin-4-one ribonucleoside | Other |
| 2-Amino-riboside-TP | Other |
| Formycin A TP | Other |
| Formycin B TP | Other |
| Pyrrolosine TP | Other |
| 2'-OH-ara-adenosine TP | Other |
| 2'-OH-ara-cytidine TP | Other |
| 2'-OH-ara-uridine TP | Other |
| 2'-OH-ara-guanosine TP | Other |
| 5-(2-carbomethoxyvinyl)uridine TP | Other |
| N6-(19-Amino-pentaoxanonadecyl)adenosine TP | Other |

The polynucleotide comprising an mRNA encoding an immune response primer, an immune response co-stimulatory signal, or a checkpoint inhibitor polypeptide of the present disclosure can include any useful linker between the nucleosides. Such linkers, including backbone modifications are given in TABLE 24.

TABLE 24

| Linker modifications | |
|---|---|
| Name | TYPE |
| 3'-alkylene phosphonates | Linker |
| 3'-amino phosphoramidate | Linker |
| alkene containing backbones | Linker |
| Aminoalkylphosphoramidates | Linker |
| Aminoalkylphosphotriesters | Linker |
| Boranophosphates | Linker |
| —CH2-0-N(CH3)—CH2— | Linker |
| —CH2—N(CH3)—N(CH3)—CH2— | Linker |
| —CH2—NH—CH2— | Linker |
| chiral phosphonates | Linker |
| chiral phosphorothioates | Linker |
| formacetyl and thioformacetyl backbones | Linker |
| methylene (methylimino) | Linker |
| methylene formacetyl and thioformacetyl backbones | Linker |
| methyleneimino and methylenehydrazino backbones | Linker |
| morpholino linkages | Linker |
| —N(CH3)—CH2—CH2— | Linker |
| oligonucleosides with heteroatom internucleoside linkage | Linker |
| Phosphinates | Linker |
| phosphoramidates | Linker |
| Phosphorodithioates | Linker |
| phosphorothioate internucleoside linkages | Linker |
| Phosphorothioates | Linker |

TABLE 24-continued

| Linker modifications | |
|---|---|
| Name | TYPE |
| Phosphotriesters | Linker |
| PNA | Linker |
| siloxane backbones | Linker |
| sulfamate backbones | Linker |
| sulfide sulfoxide and sulfone backbones | Linker |
| sulfonate and sulfonamide backbones | Linker |
| Thionoalkylphosphonates | Linker |
| Thionoalkylphosphotriesters | Linker |
| Thionophosphoramidates | Linker |

The polynucleotide comprising an mRNA encoding an immune response primer, an immune response co-stimulatory signal, or a checkpoint inhibitor polypeptide of the present disclosure, can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase can be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present disclosure can be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs), hexitol nucleic acids (HNAs), or hybrids thereof. Additional modifications are described herein. Modified nucleic acids and their synthesis are disclosed in International Patent Publication No. WO2013052523 (see also US20130115272).

In some embodiments, the polynucleotide comprising an mRNA encoding an immune response primer, an immune response co-stimulatory signal, or a checkpoint inhibitor polypeptide of the present disclosure, do not substantially induce an innate immune response of a cell into which the mRNA is introduced. Features of an induced innate immune response include 1) increased expression of pro-inflammatory cytokines, 2) activation of intracellular PRRs (RIG-I, MDA5, etc, and/or 3) termination or reduction in protein translation.

Any of the regions of the polynucleotide comprising an mRNA encoding an immune response primer, an immune response co-stimulatory signal, or a checkpoint inhibitor polypeptide of the present disclosure, can be chemically modified as taught herein or as taught in International Patent Publication No. WO2013052523 (see also US20130115272).

In some embodiments, a modified polynucleotide, e.g., mRNA comprising at least one modification described herein, of the disclosure encodes an immune response primer, an immune response co-stimulatory signal, or a checkpoint inhibitor polypeptide of the present disclosure. In some embodiments, the modified polynucleotide, e.g., mRNA comprising at least one modification described herein, encodes an immune response primer, an immune response co-stimulatory signal, or a checkpoint inhibitor polypeptide of the present disclosure.

In some embodiments, the modified polynucleotide, e.g., mRNA comprising at least one modification described herein, of the disclosure encodes a polypeptide comprising the amino acid sequence of an immune response primer, immune response co-stimulatory signal, or checkpoint inhibitor provided in the present disclosure. In some embodiments, the modified polynucleotide, e.g., mRNA comprising at least one modification described herein, of the disclosure encodes a polypeptide comprising the amino acid sequence of an immune response primer, immune response co-stimulatory signal, or checkpoint inhibitor provided in the present disclosure.

In some embodiments, the modified polynucleotide, e.g., an mRNA comprising at least one modification described herein, encodes at least one immune response primer, immune response co-stimulatory signal, or checkpoint inhibitor polypeptide of the present disclosure, a mutant, a fragment, or variant thereof, or a combination thereof.

In some embodiments, the modified polynucleotide, e.g., mRNA comprising at least one modification described herein, of the disclosure is selected from the immune response primer, immune response co-stimulatory signal, and checkpoint inhibitor nucleic acid sequences provided in the present disclosure.

The polynucleotide comprising an mRNA encoding an immune response primer, immune response co-stimulatory signal, or checkpoint inhibitor polypeptide of the present disclosure can also include building blocks, e.g., modified ribonucleosides, and modified ribonucleotides, of polynucleotide molecules. For example, these building blocks can be useful for preparing the polynucleotides of the disclosure. Such building blocks are taught in International Patent Publication No. WO2013052523 (see also US20130115272) and International Application Publication No. WO2014093924 (see also US20150307542).

Modifications on the Sugar

The modified nucleosides and nucleotides (e.g., building block molecules), which can be incorporated into a polynucleotide (e.g., RNA or mRNA, as described herein) comprising an mRNA encoding an immune response primer, immune response co-stimulatory signal, or checkpoint inhibitor polypeptide of the present disclosure, can be modified on the sugar of the ribonucleic acid.

For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_1$-12 (heterocyclyl)oxy; a sugar (e.g., ribose, pentose, or any described herein); a polyethyleneglycol (PEG), $—O(CH_2CH_2O)_nCH_2CH_2OR$, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught in International Patent Publication No. WO2013052523 (see also US20130115272) and International Application Publication No. WO2014093924 (see also US20150307542).

Combinations of Modified Sugars, Nucleobases, and Internucleoside Linkages

A polynucleotide comprising an mRNA encoding an immune response primer, immune response co-stimulatory signal, or checkpoint inhibitor of the present disclosure, or any combination thereof, can include a combination of modifications to the sugar, the nucleobase, and/or the internucleoside linkage. These combinations can include any one or more modifications described herein.

Examples of modified nucleotides and modified nucleotide combinations are provided below in TABLE 25. These combinations of modified nucleotides can be used to form the polynucleotides of the disclosure. Unless otherwise noted, the modified nucleotides can be completely substituted for the natural nucleotides of the polynucleotides of the disclosure. As a non-limiting example, the natural nucleotide uridine can be substituted with a modified nucleoside described herein. In another non-limiting example, the natural nucleotide uridine can be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker can be incorporated into the polynucleotides of the disclosure and such modifications are taught in International Patent Publication No. WO2013052523 (see also US20130115272) and International Application Publication No. WO2014093924 (see also US20150307542).

TABLE 25

| Combinations | |
|---|---|
| Modified Nucleotide | Modified Nucleotide Combination |
| α-thio-cytidine | α-thio-cytidine/5-iodo-uridine |
| | α-thio-cytidine/N1-methyl-pseudouridine |
| | α-thio-cytidine/α-thio-uridine |
| | α-thio-cytidine/5-methyl-uridine |
| | α-thio-cytidine/pseudo-uridine |
| | about 50% of the cytosines are α-thio-cytidine |
| Pseudo-isocytidine | pseudoisocytidine/5-iodo-uridine |
| | pseudoisocytidine/N1-methyl-pseudouridine |
| | pseudoisocytidine/α-thio-uridine |
| | pseudoisocytidine/5-methyl-uridine |
| | pseudoisocytidine/pseudouridine |
| | about 25% of cytosines are pseudoisocytidine |
| | pseudoisocytidine/about 50% of uridines are N1-methyl-pseudouridine and about 50% of uridines are pseudouridine |
| | pseudoisocytidine/about 25% of uridines are N1-methyl-pseudouridine and about 25% of uridines are pseudouridine |

TABLE 25-continued

| Combinations | |
|---|---|
| Modified Nucleotide | Modified Nucleotide Combination |
| pyrrolo-cytidine | pyrrolo-cytidine/5-iodo-uridine |
| | pyrrolo-cytidine/N1-methyl-pseudouridine |
| | pyrrolo-cytidine/α-thio-uridine |
| | pyrrolo-cytidine/5-methyl-uridine |
| | pyrrolo-cytidine/pseudouridine |
| | about 50% of the cytosines are pyrrolo-cytidine |
| 5-methyl-cytidine | 5-methyl-cytidine/5-iodo-uridine |
| | 5-methyl-cytidine/N1-methyl-pseudouridine |
| | 5-methyl-cytidine/α-thio-uridine |
| | 5-methyl-cytidine/5-methyl-uridine |
| | 5-methyl-cytidine/pseudouridine |
| | about 25% of cytosines are 5-methyl-cytidine |
| | about 50% of cytosines are 5-methyl-cytidine |
| | 5-methyl-cytidine/5-methoxy-uridine |
| | 5-methyl-cytidine/5-bromo-uridine |
| | 5-methyl-cytidine/2-thio-uridine |
| | 5-methyl-cytidine/about 50% of uridines are 2-thio-uridine |
| | about 50% of uridines are 5-methyl-cytidine/about 50% of uridines are 2-thio-uridine |
| N4-acetyl-cytidine | N4-acetyl-cytidine/5-iodo-uridine |
| | N4-acetyl-cytidine/N1-methyl-pseudouridine |
| | N4-acetyl-cytidine/α-thio-uridine |
| | N4-acetyl-cytidine/5-methyl-uridine |
| | N4-acetyl-cytidine/pseudouridine |
| | about 50% of cytosines are N4-acetyl-cytidine |
| | about 25% of cytosines are N4-acetyl-cytidine |
| | N4-acetyl-cytidine/5-methoxy-uridine |
| | N4-acetyl-cytidine/5-bromo-uridine |
| | N4-acetyl-cytidine/2-thio-uridine |
| | about 50% of cytosines are N4-acetyl-cytidine/about 50% of uridines are 2-thio-uridine |

Additional examples of modified nucleotides and modified nucleotide combinations are provided below in TABLE 26.

TABLE 26

| Additional combinations | | | |
|---|---|---|---|
| Uracil | Cytosine | Adenine | Guanine |
| 5-methoxy-UTP | CTP | ATP | GTP |
| 5-Methoxy-UTP | N4Ac-CTP | ATP | GTP |
| 5-Methoxy-UTP | 5-Methyl-CTP | ATP | GTP |
| 5-Methoxy-UTP | 5-Trifluoromethyl-CTP | ATP | GTP |
| 5-Methoxy-UTP | 5-Hydroxymethyl-CTP | ATP | GTP |
| 5-Methoxy-UTP | 5-Bromo-CTP | ATP | GTP |
| 5-Methoxy-UTP | N4Ac-CTP | ATP | GTP |
| 5-Methoxy-UTP | CTP | ATP | GTP |
| 5-Methoxy-UTP | 5-Methyl-CTP | ATP | GTP |
| 5-Methoxy-UTP | 5-Trifluoromethyl-CTP | ATP | GTP |
| 5-Methoxy-UTP | 5-Hydroxymethyl-CTP | ATP | GTP |
| 5-Methoxy-UTP | 5-Bromo-CTP | ATP | GTP |
| 5-Methoxy-UTP | N4—Ac-CTP | ATP | GTP |
| 5-Methoxy-UTP | 5-Iodo-CTP | ATP | GTP |
| 5-Methoxy-UTP | 5-Bromo-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |

TABLE 26-continued

| Additional combinations | | | |
|---|---|---|---|
| Uracil | Cytosine | Adenine | Guanine |
| 25% 5-Methoxy-UTP + 75% UTP | CTP | ATP | GTP |
| 5-Methoxy-UTP | CTP | ATP | GTP |
| 5-Methoxy-UTP | CTP | ATP | GTP |
| 5-Methoxy-UTP | CTP | ATP | GTP |
| 5-Methoxy-UTP | 5-Methyl-CTP | ATP | GTP |
| 5-Methoxy-UTP | 5-Methyl-CTP | ATP | GTP |
| 5-Methoxy-UTP | 5-Methyl-CTP | ATP | GTP |
| 5-Methoxy-UTP | CTP | Alpha-thio-ATP | GTP |
| 5-Methoxy-UTP | 5-Methyl-CTP | Alpha-thio-ATP | GTP |
| 5-Methoxy-UTP | CTP | ATP | Alpha-thio-GTP |
| 5-Methoxy-UTP | 5-Methyl-CTP | ATP | Alpha-thio-GTP |
| 5-Methoxy-UTP | CTP | N6—Me-ATP | GTP |
| 5-Methoxy-UTP | 5-Methyl-CTP | N6—Me-ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | 5-Ethyl-CTP | ATP | GTP |
| 5-Methoxy-UTP | 5-Methoxy-CTP | ATP | GTP |
| 5-Methoxy-UTP | 5-Ethynyl-CTP | ATP | GTP |
| 5-Methoxy-UTP | CTP | ATP | GTP |
| 5-Methoxy-UTP | 5-Methyl-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% 1-Methyl-pseudo-UTP | 5-Methyl-CTP | ATP | GTP |
| 50% 5-Methoxy-UTP + 50% 1-Methyl-pseudo-UTP | 5-Methyl-CTP | ATP | GTP |
| 25% 5-Methoxy-UTP + 75% 1-Methyl-pseudo-UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% 1-Methyl-pseudo-UTP | 75% 5-Methyl-CTP + 25% CTP | ATP | GTP |
| 75% 5-Methoxy-UTP + 25% 1-Methyl-pseudo-UTP | 50% 5-Methyl-CTP + 50% CTP | ATP | GTP |

TABLE 26-continued

| Additional combinations | | | |
|---|---|---|---|
| Uracil | Cytosine | Adenine | Guanine |
| 75% 5-Methoxy-UTP + 25% 1-Methyl-pseudo-UTP | 25% 5-Methyl-CTP + 75% CTP | ATP | GTP |
| 50% 5-Methoxy-UTP + 50% 1-Methyl-pseudo-UTP | 75% 5-Methyl-CTP + 25% CTP | ATP | GTP |
| 50% 5-Methoxy-UTP + 50% 1-Methyl-pseudo-UTP | 50% 5-Methyl-CTP + 50% CTP | ATP | GTP |
| 50% 5-Methoxy-UTP + 50% 1-Methyl-pseudo-UTP | 25% 5-Methyl-CTP + 75% CTP | ATP | GTP |
| 25% 5-Methoxy-UTP + 75% 1-Methyl-pseudo-UTP | 75% 5-Methyl-CTP + 25% CTP | ATP | GTP |
| 25% 5-Methoxy-UTP + 75% 1-Methyl-pseudo-UTP | 50% 5-Methyl-CTP + 50% CTP | ATP | GTP |
| 25% 5-Methoxy-UTP + 75% 1-Methyl-pseudo-UTP | 25% 5-Methyl-CTP + 75% CTP | ATP | GTP |
| 75% 5-Methoxy-UTP + 25% 1-Methyl-pseudo-UTP | CTP | ATP | GTP |
| 50% 5-Methoxy-UTP + 50% 1-Methyl-pseudo-UTP | CTP | ATP | GTP |
| 25% 5-Methoxy-UTP + 75% 1-Methyl-pseudo-UTP | CTP | ATP | GTP |
| 5-methoxy-UTP (In House) | CTP | ATP | GTP |
| 5-methoxy-UTP (Hongene) | CTP | ATP | GTP |
| 5-methoxy-UTP (Hongene) | 5-Methyl-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |

TABLE 26-continued

| Additional combinations | | | |
|---|---|---|---|
| Uracil | Cytosine | Adenine | Guanine |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |

TABLE 26-continued

| Additional combinations | | | |
|---|---|---|---|
| Uracil | Cytosine | Adenine | Guanine |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | 5-Fluoro-CTP | ATP | GTP |
| 5-Methoxy-UTP | 5-Phenyl-CTP | ATP | GTP |
| 5-Methoxy-UTP | N4-Bz-CTP | ATP | GTP |
| 5-Methoxy-UTP | CTP | N6-Isopentenyl-ATP | GTP |
| 5-Methoxy-UTP | N4—Ac-CTP | ATP | GTP |
| 25% 5-Methoxy-UTP + 75% UTP | 25% N4—Ac-CTP + 75% CTP | ATP | GTP |
| 25% 5-Methoxy-UTP + 75% UTP | 75% N4—Ac-CTP + 25% CTP | ATP | GTP |
| 75% 5-Methoxy-UTP + 25% UTP | 25% N4—Ac-CTP + 75% CTP | ATP | GTP |
| 75% 5-Methoxy-UTP + 25% UTP | 75% N4—Ac-CTP + 25% CTP | ATP | GTP |
| 5-Methoxy-UTP | 5-Hydroxymethyl-CTP | ATP | GTP |
| 25% 5-Methoxy-UTP + 75% UTP | 25% 5-Hydroxymethyl-CTP + 75% CTP | ATP | GTP |
| 25% 5-Methoxy-UTP + 75% UTP | 75% 5-Hydroxymethyl-CTP + 25% CTP | ATP | GTP |
| 75% 5-Methoxy-UTP + 25% UTP | 25% 5-Hydroxymethyl-CTP + 75% CTP | ATP | GTP |
| 75% 5-Methoxy-UTP + 25% UTP | 75% 5-Hydroxymethyl-CTP + 25% CTP | ATP | GTP |
| 5-Methoxy-UTP | N4-Methyl CTP | ATP | GTP |
| 25% 5-Methoxy-UTP + 75% UTP | 25% N4-Methyl CTP + 75% CTP | ATP | GTP |
| 25% 5-Methoxy-UTP + 75% UTP | 75% N4-Methyl CTP + 25% CTP | ATP | GTP |
| 75% 5-Methoxy-UTP + 25% UTP | 25% N4-Methyl CTP + 75% CTP | ATP | GTP |
| 75% 5-Methoxy-UTP + 25% UTP | 75% N4-Methyl CTP + 25% CTP | ATP | GTP |
| 5-Methoxy-UTP | 5-Trifluoromethyl-CTP | ATP | GTP |
| 25% 5-Methoxy-UTP + 75% UTP | 25% 5-Trifluoromethyl-CTP + 75% CTP | ATP | GTP |
| 25% 5-Methoxy-UTP + 75% UTP | 75% 5-Trifluoromethyl-CTP + 25% CTP | ATP | GTP |
| 75% 5-Methoxy-UTP + 25% UTP | 25% 5-Trifluoromethyl-CTP + 75% CTP | ATP | GTP |
| 75% 5-Methoxy-UTP + 25% UTP | 75% 5-Trifluoromethyl-CTP + 25% CTP | ATP | GTP |
| 5-Methoxy-UTP | 5-Bromo-CTP | ATP | GTP |
| 25% 5-Methoxy-UTP + 75% UTP | 25% 5-Bromo-CTP + 75% CTP | ATP | GTP |
| 25% 5-Methoxy-UTP + 75% UTP | 75% 5-Bromo-CTP + 25% CTP | ATP | GTP |
| 75% 5-Methoxy-UTP + 25% UTP | 25% 5-Bromo-CTP + 75% CTP | ATP | GTP |
| 75% 5-Methoxy-UTP + 25% UTP | 75% 5-Bromo-CTP + 25% CTP | ATP | GTP |
| 5-Methoxy-UTP | 5-Iodo-CTP | ATP | GTP |
| 25% 5-Methoxy-UTP + 75% UTP | 25% 5-Iodo-CTP + 75% CTP | ATP | GTP |
| 25% 5-Methoxy-UTP + 75% UTP | 75% 5-Iodo-CTP + 25% CTP | ATP | GTP |
| 75% 5-Methoxy-UTP + 25% UTP | 25% 5-Iodo-CTP + 75% CTP | ATP | GTP |
| 75% 5-Methoxy-UTP + 25% UTP | 75% 5-Iodo-CTP + 25% CTP | ATP | GTP |
| 5-Methoxy-UTP | 5-Ethyl-CTP | ATP | GTP |
| 25% 5-Methoxy-UTP + 75% UTP | 25% 5-Ethyl-CTP + 75% CTP | ATP | GTP |
| 25% 5-Methoxy-UTP + 75% UTP | 75% 5-Ethyl-CTP + 25% CTP | ATP | GTP |
| 75% 5-Methoxy-UTP + 25% UTP | 25% 5-Ethyl-CTP + 75% CTP | ATP | GTP |
| 75% 5-Methoxy-UTP + 25% UTP | 75% 5-Ethyl-CTP + 25% CTP | ATP | GTP |
| 5-Methoxy-UTP | 5-Methoxy-CTP | ATP | GTP |

TABLE 26-continued

| Additional combinations | | | |
|---|---|---|---|
| Uracil | Cytosine | Adenine | Guanine |
| 25% 5-Methoxy-UTP + 75% UTP | 25% 5-Methoxy-CTP + 75% CTP | ATP | GTP |
| 25% 5-Methoxy-UTP + 75% UTP | 75% 5-Methoxy-CTP + 25% CTP | ATP | GTP |
| 75% 5-Methoxy-UTP + 25% UTP | 25% 5-Methoxy-CTP + 75% CTP | ATP | GTP |
| 75% 5-Methoxy-UTP + 25% UTP | 75% 5-Methoxy-CTP + 25% CTP | ATP | GTP |
| 5-Methoxy-UTP | 5-Ethynyl-CTP | ATP | GTP |
| 25% 5-Methoxy-UTP + 75% UTP | 25% 5-Ethynyl-CTP + 75% CTP | ATP | GTP |
| 25% 5-Methoxy-UTP + 75% UTP | 75% 5-Ethynyl-CTP + 25% CTP | ATP | GTP |
| 75% 5-Methoxy-UTP + 25% UTP | 25% 5-Ethynyl-CTP + 75% CTP | ATP | GTP |
| 75% 5-Methoxy-UTP + 25% UTP | 75% 5-Ethynyl-CTP + 25% CTP | ATP | GTP |
| 5-Methoxy-UTP | 5-Pseudo-iso-CTP | ATP | GTP |
| 25% 5-Methoxy-UTP + 75% UTP | 25% 5-Pseudo-iso-CTP + 75% CTP | ATP | GTP |
| 25% 5-Methoxy-UTP + 75% UTP | 75% 5-Pseudo-iso-CTP + 25% CTP | ATP | GTP |
| 75% 5-Methoxy-UTP + 25% UTP | 25% 5-Pseudo-iso-CTP + 75% CTP | ATP | GTP |
| 75% 5-Methoxy-UTP + 25% UTP | 75% 5-Pseudo-iso-CTP + 25% CTP | ATP | GTP |
| 5-Methoxy-UTP | 5-Formyl-CTP | ATP | GTP |
| 25% 5-Methoxy-UTP + 75% UTP | 25% 5-Formyl-CTP + 75% CTP | ATP | GTP |
| 25% 5-Methoxy-UTP + 75% UTP | 75% 5-Formyl-CTP + 25% CTP | ATP | GTP |
| 75% 5-Methoxy-UTP + 25% UTP | 25% 5-Formyl-CTP + 75% CTP | ATP | GTP |
| 75% 5-Methoxy-UTP + 25% UTP | 75% 5-Formyl-CTP + 25% CTP | ATP | GTP |
| 5-Methoxy-UTP | 5-Aminoallyl-CTP | ATP | GTP |
| 25% 5-Methoxy-UTP + 75% UTP | 25% 5-Aminoallyl-CTP + 75% CTP | ATP | GTP |
| 25% 5-Methoxy-UTP + 75% UTP | 75% 5-Aminoallyl-CTP + 25% CTP | ATP | GTP |
| 75% 5-Methoxy-UTP + 25% UTP | 25% 5-Aminoallyl-CTP + 75% CTP | ATP | GTP |
| 75% 5-Methoxy-UTP + 25% UTP | 75% 5-Aminoallyl-CTP + 25% CTP | ATP | GTP |

XI. PHARMACEUTICAL COMPOSITIONS: FORMULATION, ADMINISTRATION, DELIVERY AND DOSING

The present disclosure provides pharmaceutical formulations comprising any of the compositions disclosed herein, e.g., combination therapies comprising at least two mRNAs, wherein each mRNAs encodes an immune response primer polypeptide, an immune response co-stimulatory signal polypeptide, a checkpoint inhibitor polypeptide, or a combination thereof (e.g., a first polynucleotide comprising an mRNA encoding a first protein comprising an IL23 polypeptide, a second polynucleotide comprising an mRNA encoding a second protein comprising an IL36-gamma polypeptide, and/or a third polynucleotide comprising an mRNA encoding a third protein, wherein the third protein comprises an OX40L polypeptide) as described elsewhere herein.

In some embodiments of the disclosure, the polynucleotides are formulated in compositions and complexes in combination with one or more pharmaceutically acceptable excipients. Pharmaceutical compositions can optionally comprise one or more additional active substances, e.g. therapeutically and/or prophylactically active substances. Pharmaceutical compositions of the present disclosure can be sterile and/or pyrogen-free. General considerations in the formulation and/or manufacture of pharmaceutical agents can be found, for example, in *Remington: The Science and Practice of Pharmacy* 21$^{st}$ ed., Lippincott Williams & Wilkins, 2005.

In some embodiments, compositions are administered to humans, human patients or subjects. For the purposes of the present disclosure, the phrase "active ingredient" generally refers to polynucleotides to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals.

In some embodiments, the polynucleotide of the present disclosure is formulated for subcutaneous, intravenous, intraperitoneal, intratumoral, intramuscular, intra-articular, intra-synovial, intrasternal, intrathecal, intrahepatic, intralesional, intracranial, intraventricular, oral, inhalation spray, topical, rectal, nasal, buccal, vaginal, intratumoral, or implanted reservoir intramuscular, subcutaneous, intratumoral, or intradermal delivery. In other embodiments, the polynucleotide is formulated for intratumoral, intraperitoneal, or intravenous delivery. In a particular embodiment, the polynucleotide of the present disclosure is formulated for intratumoral delivery.

Formulations of the pharmaceutical compositions described herein can be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the disclosure will vary, depending upon the identity, size, and/or condition of the subject treated and further depending upon the route by which the composition is to be administered. By way of example, the composition can comprise between 0.1% and 100%, e.g., between 0.5% and 50%, between 1% and 30%, between 5% and 80%, or at least 80% (w/w) active ingredient.

Formulations

The polynucleotides of the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide), i.e., compositions comprising at least two mRNAs, wherein each mRNA encodes an immune response primer, an immune response co-stimulatory signal, a checkpoint inhibitor, or a combination thereof (e.g., a first polynucleotide comprising an mRNA encoding a first protein comprising an IL23 polypeptide, a second polynucleotide comprising an mRNA encoding a second protein comprising an IL36-gamma polypeptide, and/or a third polynucleotide comprising an mRNA encoding a third protein, wherein the third protein comprises an OX40L polypeptide), can be formulated using one or more excipients.

The function of the one or more excipients is, e.g., to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present disclosure can include, without limitation, lipidoids, liposomes, lipid nanoparticles, polymers, lipoplexes, core-shell nanoparticles, peptides, proteins, cells transfected with polynucleotides (e.g., for transplantation into a subject), hyaluronidase, nanoparticle mimics and combinations thereof. Accordingly, the formulations of the disclosure can include one or more excipients, each in an amount that together increases the stability of the polynucleotide, increases cell transfection by the polynucleotide, increases the expression of polynucleotides encoded protein, and/or alters the release profile of polynucleotide encoded proteins. Further, the polynucleotides of the present disclosure can be formulated using self-assembled nucleic acid nanoparticles.

Formulations of the pharmaceutical compositions described herein can be prepared by any method known or hereafter developed in the art of pharmacology. In general, such preparatory methods include the step of associating the active ingredient with an excipient and/or one or more other accessory ingredients.

A pharmaceutical composition in accordance with the present disclosure can be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure can vary, depending upon the identity, size, and/or condition of the subject being treated and further depending upon the route by which the composition is to be administered. For example, the composition can comprise between 0.1% and 99% (w/w) of the active ingredient. By way of example, the composition can comprise between 0.1% and 100%, e.g., between 0.5 and 50%, between 1-30%, between 5-80%, at least 80% (w/w) active ingredient.

In some embodiments, the formulations described herein contain at least one polynucleotide. As a non-limiting example, the formulations contain 1, 2, 3, 4 or 5 polynucleotides. In other embodiments, the polynucleotide of the disclosure is formulated for intratumoral delivery in a tumor of a patient in need thereof.

Pharmaceutical formulations can additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21st Edition, A. R. Gennaro, Lippincott, Williams & Wilkins, Baltimore, Md., 2006). The use of a conventional excipient medium can be contemplated within the scope of the present disclosure, except insofar as any conventional excipient medium can be incompatible with a substance or its derivatives, such as by producing any undesirable biological effect or otherwise interacting in a deleterious manner with any other component(s) of the pharmaceutical composition.

In some embodiments, the particle size of the lipid nanoparticle is increased and/or decreased. The change in particle size can be able to help counter biological reaction such as, but not limited to, inflammation or can increase the biological effect of the modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients can optionally be included in the pharmaceutical formulations of the disclosure.

In some embodiments, the polynucleotides is administered in or with, formulated in or delivered with nanostructures that can sequester molecules such as cholesterol. Non-limiting examples of these nanostructures and methods of making these nanostructures are described in US Patent Publication No. US20130195759. Exemplary structures of these nanostructures are shown in US Patent Publication No. US20130195759, and can include a core and a shell surrounding the core.

Lipidoids

A polynucleotide of any of the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide), e.g., an mRNA encoding an immune response primer polypeptide, an mRNA encoding an immune response co-stimulatory signal polypeptide, an mRNA encoding a checkpoint inhibitor polypeptide, or a combination thereof, can be formulated with lipidoids. The synthesis of lipidoids has been extensively described and formulations containing these compounds are particularly suited for delivery of polynucleotides (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010), the present disclosure describes their formulation and use in delivering polynucleotides.

Complexes, micelles, liposomes or particles can be prepared containing these lipidoids and therefore, can result in an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intraperitoneal, intratumoral, intramuscular, or subcutaneous routes.

In vivo delivery of nucleic acids can be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879). As an example, small changes in the anchor chain length of poly(ethylene glycol) (PEG) lipids can result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010)), $C_{12}$-200 (including derivatives and variants), and MD 1, can be tested for in vivo activity.

The lipidoid referred to herein as “98N12-5” is disclosed by Akinc et al., Mol Ther. (2009) 17:872-879.

The lipidoid referred to herein as “C12-200” is disclosed by Love et al., Proc. Natl. Acad. Sci. USA (2010) 107:1864-1869 and Liu and Huang (2010) Molecular Therapy. 2010: 669-670. The lipidoid formulations can include particles comprising either 3 or 4 or more components in addition to polynucleotides.

Lipidoids and polynucleotide formulations comprising lipidoids are described in International Application Publication No. WO2014093924 (see also US20150307542).

Liposomes, Lipoplexes, and Lipid Nanoparticles

A polynucleotide of any of the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide), e.g., an mRNA encoding an immune response primer polypeptide, an mRNA encoding an immune response co-stimulatory signal polypeptide, an mRNA encoding a checkpoint inhibitor polypeptide, or a combination thereof, can be formulated using one or more liposomes, lipoplexes, or lipid nanoparticles.

In one specific embodiment, a pharmaceutical composition comprising a polynucleotide of any of the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide), e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in liposomes. Liposomes are artificially-prepared vesicles which can primarily be composed of a lipid bilayer and can be used as a delivery vehicle for the administration of pharmaceutical formulations. Liposomes can be of different sizes such as, but not limited to, a multilamellar vesicle (MLV) which can be hundreds of nanometers in diameter and can contain a series of concentric bilayers separated by narrow aqueous compartments, a small unicellular vesicle (SUV) which can be smaller than 50 nm in diameter, and a large unilamellar vesicle (LUV) which can be between 50 and 500 nm in diameter. Liposome design can include, but is not limited to, opsonins or ligands in order to improve the attachment of liposomes to unhealthy tissue or to activate events such as, but not limited to, endocytosis. Liposomes can contain a low or a high pH in order to improve the delivery of the pharmaceutical formulations.

The formation of liposomes can depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes such as synthetic membrane vesicles are prepared by the methods, apparatus and devices described in US Patent Publication No. US20130177638, US20130177637, US20130177636, US20130177635, US20130177634, US20130177633, US20130183375, US20130183373 and US20130183372.

In one embodiment, pharmaceutical compositions described herein include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (as described in US20100324120) and liposomes which can deliver small molecule drugs such as, but not limited to, DOXIL® from Janssen Biotech, Inc. (Horsham, Pa.).

In one embodiment, pharmaceutical compositions described herein can include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In other embodiments, formulations comprise a percentage of cholesterol selected from the group consisting of 28.5%, 31.5%, 33.5%, 36.5%, 37.0%, 38.5%, 39.0% and 43.5%. In some embodiments, formulations comprise from about 5.0% to about 10.0% DSPC and/or from about 7.0% to about 15.0% DSPC.

In one embodiment, pharmaceutical compositions include liposomes which are formed to deliver a polynucleotide of any of the combination therapies disclosed herein (i.e., at least two polynucleotides, wherein each polynucleotide comprises an ORF encoding an immune response primer polypeptide, an immune response co-stimulatory signal polypeptide, or an a checkpoint inhibitor polypeptide), e.g., an mRNA encoding an immune response primer polypeptide, an mRNA encoding an immune response co-stimulatory signal polypeptide, an mRNA encoding a checkpoint inhibitor polypeptide, or a combination thereof. The polynucleotides can be encapsulated by the liposome and/or it can be contained in an aqueous core which can then be encapsulated by the liposome. See International Pub. Nos. WO2012031046 (see also US20130189351), WO2012031043 (see also US20130202684), WO2012030901 (see also US20130195969) and WO2012006378 (see also US20130171241) and US Patent Publication No. US20130189351, US20130195969 and US20130202684).

In another embodiment, liposomes is formulated for targeted delivery. As a non-limiting example, the liposome is formulated for targeted delivery to the liver. The liposome used for targeted delivery can include, but is not limited to, the liposomes described in and methods of making liposomes described in US Patent Publication No. US20130195967.

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a cationic oil-in-water emulsion where the emulsion particle comprises an oil core and a cationic lipid which can interact with the polynucleotide anchoring the molecule to the emulsion particle. See International Pub. No. WO2012006380 (see also US20160256541).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a water-in-oil emulsion comprising a continuous hydrophobic phase in which the hydrophilic phase is dispersed. As a non-limiting example, the emulsion can be made by the methods described in International Publication No. WO2013087791 (see also US20140294904).

In another embodiment, the lipid formulation includes at least cationic lipid, a lipid which can enhance transfection and a least one lipid which contains a hydrophilic head group linked to a lipid moiety. See International Pub. No. WO2011076807 and U.S. Pub. No. 20110200582.

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a lipid vesicle which can have crosslinks between functionalized lipid bilayers (see U.S. Pub. No. 20120177724).

In one embodiment, the polynucleotides are formulated in a liposome as described in International Patent Publication No. WO2013086526 (see also US20140356416). The polynucleotides can be encapsulated in a liposome using reverse pH gradients and/or optimized internal buffer compositions as described in International Patent Publication No. WO2013086526.

In one embodiment, the polynucleotide pharmaceutical compositions are formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713)) and hyaluronan-coated liposomes (Quiet Therapeutics, Israel).

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a lipid vesicle which can have crosslinks between functionalized lipid bilayers.

In other embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a liposome comprising a cationic lipid. The liposome can have a molar ratio of nitrogen atoms in the cationic lipid to the phosphates in the polynucleotide (N:P ratio) of between 1:1 and 20:1 as described in International Publication No. WO2013006825. In another embodiment, the liposome can have a N:P ratio of greater than 20:1 or less than 1:1. In one embodiment, the cationic lipid is a low molecular weight cationic lipid such as those described in US Patent Application No. 20130090372.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a lipid-polycation complex. The formation of the lipid-polycation complex can be accomplished by methods known in the art and/or as described in U.S. Pub. No. 20120178702. As a non-limiting example, the polycation includes a cationic peptide or a polypeptide such as, but not limited to, polylysine, polyornithine and/or polyarginine and the cationic peptides described in International Pub. No. WO2012013326 or US Patent Pub. No. US20130142818. In another embodiment, the polynucleotides are formulated in a lipid-polycation complex which can further include a non-cationic lipid such as, but not limited to, cholesterol or dioleoyl phosphatidylethanolamine (DOPE).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in an aminoalcohol lipidoid. Aminoalcohol lipidoids which can be used in the present disclosure can be prepared by the methods described in U.S. Pat. No. 8,450,298.

The liposome formulation can be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200). In some embodiments, liposome formulations comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes is from about 5:1 to about 20:1, from about 10:1 to about 25:1, from about 15:1 to about 30:1 and/or at least 30:1.

In some embodiments, the ratio of PEG in the lipid nanoparticle (LNP) formulations is increased or decreased and/or the carbon chain length of the PEG lipid is modified from C14 to C18 to alter the pharmacokinetics and/or biodistribution of the LNP formulations. As a non-limiting example, LNP formulations contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In another embodiment the PEG-c-DOMG can be replaced with a PEG lipid such as, but not limited to, PEG-DSG (1,2-distearoyl-sn-glycerol, methoxypolyethylene glycol), PEG-DMG (1,2-dimyristoyl-sn-glycerol) and/or PEG-DPG (1,2-dipalmitoyl-sn-glycerol, methoxypolyethylene glycol). The cationic lipid can be selected from any lipid known in the art such as, but not limited to, DLin-MC3-DMA, DLin-DMA, C12-200 and DLin-KC2-DMA.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a lipid nanoparticle such as those described in International Publication No. WO2012170930 (see also US20140294938).

In another embodiment, the formulation comprising the polynucleotide(s) is a nanoparticle which can comprise at least one lipid. The lipid can be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid is a cationic lipid such as, but not limited to, DLin-DMA, DLin-D-DMA, DLin-MC3-DMA, DLin-KC2-DMA, DODMA and amino alcohol lipids. The amino alcohol cationic lipid can be the lipids described in and/or made by the methods described in U.S. Patent Application Publication No. US20130150625. As a non-limiting example, the cationic lipid can be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl} propan-1-ol (Compound 4 in US20130150625); or any pharmaceutically acceptable salt or stereoisomer thereof.

The present disclosure provides pharmaceutical compositions with advantageous properties. In particular, the present application provides pharmaceutical compositions comprising:

(a) at least two polynucleotides in combination (combination therapy), wherein the at least two polynucleotides are selected from the group consisting of (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof; and, (b) a lipid composition comprising:

(i) a compound having the formula (I)

(I)

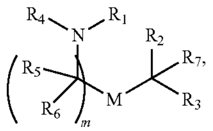

wherein $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a carbocycle, heterocycle, —OR, $—O(CH_2)_nN(R)_2$, —C(O)OR, —OC(O)R, $—CX_3$, $—CX_2H$, $—CXH_2$, —CN, $—N(R)_2$, $—C(O)N(R)_2$, —N(R)C(O)R, $—N(R)S(O)_2R$, $—N(R)C(O)N(R)_2$, $—N(R)C(S)N(R)_2$, and $—C(R)N(R)_2C(O)OR$, and each n is independently selected from 1, 2, 3, 4, and 5;

each $R_5$ is independently selected from the group consisting of $C_{1-3}$ alkyl, $C_{2-3}$ alkenyl, and H;

each R6 is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof, wherein alkyl and alkenyl groups may be linear or branched.

In some embodiments, a subset of compounds of Formula (I) includes those in which when $R_4$ is $—(CH_2)_nQ$, $—(CH_2)_nCHQR$, —CHQR, or $—CQ(R)_2$, then (i) Q is not $—N(R)_2$ when n is 1, 2, 3, 4 or 5, or (ii) Q is not 5, 6, or 7-membered heterocycloalkyl when n is 1 or 2.

In another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, $—O(CH_2)_nN(R)_2$, —C(O)OR, —OC(O)R, $—CX_3$, $—CX_2H$, $—CXH_2$, —CN, $—C(O)N(R)_2$, —N(R)C(O)R, $—N(R)S(O)_2R$, $—N(R)C(O)N(R)_2$, $—N(R)C(S)N(R)_2$, $—CRN(R)_2C(O)OR$, and a 5- to 14-membered heterocycloalkyl having one or more heteroatoms selected from N, O, and S which is substituted with one or more substituents selected from oxo (═O), OH, amino, and $C_{1-3}$ alkyl, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, $—(CH_2)_nQ$, $—(CH_2)_nCHQR$, —CHQR, $—CQ(R)_2$, and unsubstituted $C_{1-6}$ alkyl, where Q is selected from a $C_{3-6}$ carbocycle, a 5- to 14-membered heterocycle having one or more heteroatoms selected from N, O, and S, —OR, $—O(CH_2)_nN(R)_2$, —C(O)OR, —OC(O)R, $—CX_3$, $—CX_2H$, $—CXH_2$, —CN, $—C(O)N(R)_2$, —N(R)C(O)R, $—N(R)S(O)_2R$, $—N(R)C(O)N(R)_2$, $—N(R)C(S)N(R)_2$, $—CRN(R)_2C(O)OR$, and each n is independently selected from 1, 2, 3, 4, and 5; and when Q is a 5- to 14-membered heterocycle and (i) $R_4$ is $—(CH_2)_nQ$ in which n is 1 or 2, or (ii) $R_4$ is $—(CH_2)_nCHQR$ in which n is 1, or (iii) $R_4$ is —CHQR, and $—CQ(R)_2$, then Q is either a 5- to 14-membered heteroaryl or 8- to 14-membered heterocycloalkyl;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, $—S(O)_2—$, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —$(CH_2)_n$Q, —$(CH_2)_n$CHQR, —CHQR, —CQ$(R)_2$, and unsubstituted $C_{1-6}$ alkyl, where Q is selected from a $C_{3-6}$ carbocycle, a 5- to 14-membered heteroaryl having one or more heteroatoms selected from N, O, and S, —OR, —$O(CH_2)_n N(R)_2$, —C(O)OR, —OC(O)R, —$CX_3$, —$CX_2H$, —$CXH_2$, —CN, —C(O)$N(R)_2$, —N(R)C(O)R, —N(R)$S(O)_2$R, —N(R)C(O)$N(R)_2$, —N(R)C(S)$N(R)_2$, —CRN$(R)_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —$(CH_2)_n$Q or —$(CH_2)_n$CHQR, where Q is —$N(R)_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —$(CH_2)_n$Q, —$(CH_2)_n$CHQR, —CHQR, and —CQ$(R)_2$, where Q is —$N(R)_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In certain embodiments, a subset of compounds of Formula (I) includes those of Formula (IA):

(IA)

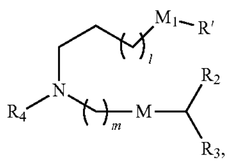

or a salt or stereoisomer thereof, wherein 1 is selected from 1, 2, 3, 4, and 5; m is selected from 5, 6, 7, 8, and 9; $M_1$ is a bond or M'; $R_4$ is unsubstituted $C_{1-3}$ alkyl, or —$(CH_2)_n$Q, in which Q is OH, —NHC(S)$N(R)_2$, or —NHC(O)$N(R)_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In certain embodiments, a subset of compounds of Formula (I) includes those of Formula (II):

(II)

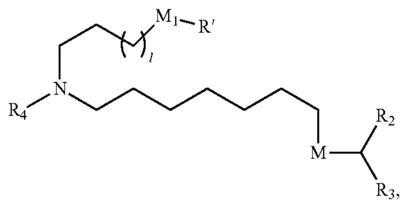

or a salt or stereoisomer thereof, wherein 1 is selected from 1, 2, 3, 4, and 5; $M_1$ is a bond or M'; $R_4$ is unsubstituted $C_{1-3}$ alkyl, or —$(CH_2)_nQ$, in which n is 2, 3, or 4, and Q is OH, —$NHC(S)N(R)_2$, or —$NHC(O)N(R)_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, the compound of formula (I) is of the formula (IIa), (IIa)

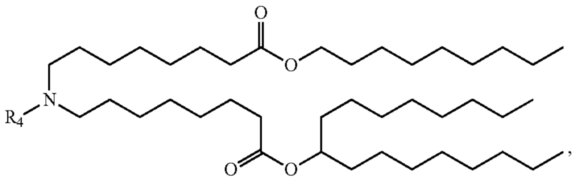

or a salt thereof, wherein $R_4$ is as described above.

In some embodiments, the compound of formula (I) is of the formula (IIb), (IIb)

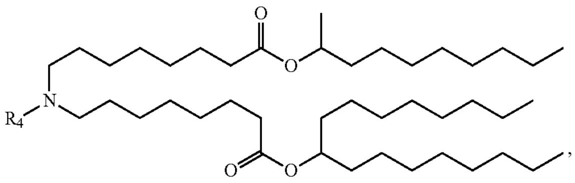

or a salt thereof, wherein $R_4$ is as described above.

In some embodiments, the compound of formula (I) is of the formula (IIc), (IIc)

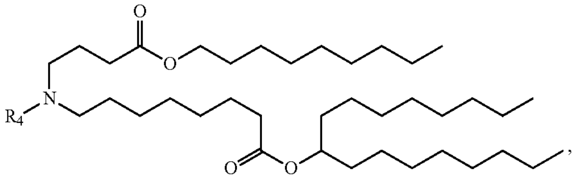

or a salt thereof, wherein $R_4$ is as described above.

In some embodiments, the compound of formula (I) is of the formula (lie):

or a salt thereof, wherein $R_4$ is as described above.

(IIe)

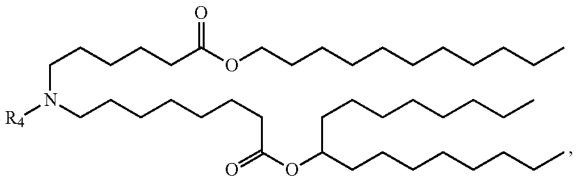

In some embodiments, the compound of formula (IIa), (IIb), (IIc), or (IIe) comprises an $R_4$ which is selected from —$(CH_2)_nQ$ and —$(CH_2)_nCHQR$, wherein Q, R and n are as defined above.

In some embodiments, Q is selected from the group consisting of —OR, —OH, —$O(CH_2)_nN(R)_2$, —OC(O)R, —$CX_3$, —CN, —N(R)C(O)R, —N(H)C(O)R, —$N(R)S(O)_2R$, —$N(H)S(O)_2R$, —$N(R)C(O)N(R)_2$, —$N(H)C(O)N(R)_2$, —N(H)C(O)N(H)(R), —$N(R)C(S)N(R)_2$, —$N(H)C(S)N(R)_2$, —N(H)C(S)N(H)(R), and a heterocycle, wherein R is as defined above. In some aspects, n is 1 or 2. In some embodiments, Q is OH, —$NHC(S)N(R)_2$, or —$NHC(O)N(R)_2$.

In some embodiments, the compound of formula (I) is of the formula (IId), (IId)

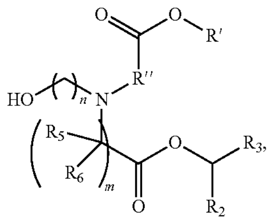

or a salt thereof, wherein $R_2$ and $R_3$ are independently selected from the group consisting of $C_{5-14}$ alkyl and $C_{5-14}$ alkenyl, n is selected from 2, 3, and 4, and R', R'', $R_5$, $R_6$ and m are as defined above.

In some aspects of the compound of formula (IId), $R_2$ is $C_8$ alkyl. In some aspects of the compound of formula (IId), $R_3$ is $C_5$-$C_9$ alkyl. In some aspects of the compound of formula (IId), m is 5, 7, or 9. In some aspects of the compound of formula (IId), each $R_5$ is H. In some aspects of the compound of formula (IId), each $R_6$ is H.

In another aspect, the present application provides a lipid composition (e.g., a lipid nanoparticle (LNP)) comprising: (1) a compound having the formula (I); (2) optionally a helper lipid (e.g. a phospholipid); (3) optionally a structural lipid (e.g. a sterol); (4) optionally a lipid conjugate (e.g. a PEG-lipid); and (5) optionally a quaternary amine compound. In exemplary embodiments, the lipid composition (e.g., LNP) further comprises at least two polynucleotides in combination (combination therapy), wherein the at least two polynucleotides are selected from the group consisting of (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof, e.g., a polynucleotide or polynucleotides encapsulated therein.

In particular embodiments, the lipid composition (e.g., LNP) further comprises at least two polynucleotides in combination (combination therapy), wherein the polynucleotides are (i) a polynucleotide encoding an immune response primer and a polynucleotide encoding an immune response co-stimulatory signal;

(ii) a polynucleotide encoding an immune response primer and a polynucleotide encoding a checkpoint inhibitor;

(iii) a polynucleotide encoding an immune response primer and a polypeptide checkpoint inhibitor;

(iv) a polynucleotide encoding an immune response co-stimulatory signal and a polynucleotide encoding a checkpoint inhibitor;

(v) a polynucleotide encoding an immune response co-stimulatory signal and a polypeptide checkpoint inhibitor;

(vi) a polynucleotide encoding an immune response primer and a second a polynucleotide encoding a second immune response primer;

(vii) polynucleotide encoding an immune response co-stimulatory signal and a second polynucleotide encoding an immune response co-stimulatory signal;

(viii) a polynucleotide encoding an immune response primer, a second a polynucleotide encoding a second immune response primer, and a polynucleotide encoding a checkpoint inhibitor;

(ix) a polynucleotide encoding an immune response co-stimulatory signal, a second polynucleotide encoding an immune response co-stimulatory signal, and a polynucleotide encoding a checkpoint inhibitor;

(x) a polynucleotide encoding an immune response primer, a second a polynucleotide encoding a second immune response primer, and a polypeptide checkpoint inhibitor;

(xi) a polynucleotide encoding an immune response co-stimulatory signal, a second polynucleotide encoding an immune response co-stimulatory signal, and a polypeptide checkpoint inhibitor;

(xii) a polynucleotide encoding an immune response primer, a polynucleotide encoding an immune response co-stimulatory signal, and a polynucleotide encoding a checkpoint inhibitor; or, (xiii) a polynucleotide encoding an immune response primer, a polynucleotide encoding an immune response co-stimulatory signal, and a polypeptide checkpoint inhibitor.

As used herein, the term "alkyl" or "alkyl group" means a linear or branched, saturated hydrocarbon including one or more carbon atoms (e.g., one, two, three, four, five, six, seven, eight, nine, ten, eleven, twelve, thirteen, fourteen, fifteen, sixteen, seventeen, eighteen, nineteen, twenty, or more carbon atoms).

The notation "$C_{1-14}$ alkyl" means a linear or branched, saturated hydrocarbon including 1-14 carbon atoms. An alkyl group may be optionally substituted.

As used herein, the term "alkenyl" or "alkenyl group" means a linear or branched hydrocarbon including two or more carbon atoms (e.g., two, three, four, five, six, seven, eight, nine, ten, eleven, twelve, thirteen, fourteen, fifteen, sixteen, seventeen, eighteen, nineteen, twenty, or more carbon atoms) and at least one double bond.

The notation "$C_{2-14}$ alkenyl" means a linear or branched hydrocarbon including 2-14 carbon atoms and at least one double bond. An alkenyl group may include one, two, three, four, or more double bonds. For example, $C_{18}$ alkenyl may include one or more double bonds. A $C_{18}$ alkenyl group including two double bonds may be a linoleyl group. An alkenyl group may be optionally substituted.

As used herein, the term "carbocycle" or "carbocyclic group" means a mono- or multi-cyclic system including one or more rings of carbon atoms. Rings may be three, four, five, six, seven, eight, nine, ten, eleven, twelve, thirteen, fourteen, or fifteen membered rings.

The notation "$C_{3-6}$ carbocycle" means a carbocycle including a single ring having 3-6 carbon atoms. Carbocycles may include one or more double bonds and may be aromatic (e.g., aryl groups). Examples of carbocycles include cyclopropyl, cyclopentyl, cyclohexyl, phenyl, naphthyl, and 1,2-dihydronaphthyl groups. Carbocycles may be optionally substituted.

As used herein, the term "heterocycle" or "heterocyclic group" means a mono- or multi-cyclic system including one or more rings, where at least one ring includes at least one heteroatom. Heteroatoms may be, for example, nitrogen, oxygen, or sulfur atoms. Rings may be three, four, five, six, seven, eight, nine, ten, eleven, or twelve membered rings. Heterocycles may include one or more double bonds and may be aromatic (e.g., heteroaryl groups). Examples of heterocycles include imidazolyl, imidazolidinyl, oxazolyl, oxazolidinyl, thiazolyl, thiazolidinyl, pyrazolidinyl, pyrazolyl, isoxazolidinyl, isoxazolyl, isothiazolidinyl, isothiazolyl, morpholinyl, pyrrolyl, pyrrolidinyl, furyl, tetrahydrofuryl, thiophenyl, pyridinyl, piperidinyl, quinolyl, and isoquinolyl groups. Heterocycles may be optionally substituted.

As used herein, a "biodegradable group" is a group that may facilitate faster metabolism of a lipid in a subject. A biodegradable group may be, but is not limited to, —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —$S(O)_2$—, an aryl group, and a heteroaryl group.

As used herein, an "aryl group" is a carbocyclic group including one or more aromatic rings. Examples of aryl groups include phenyl and naphthyl groups.

As used herein, a "heteroaryl group" is a heterocyclic group including one or more aromatic rings. Examples of heteroaryl groups include pyrrolyl, furyl, thiophenyl, imidazolyl, oxazolyl, and thiazolyl. Both aryl and heteroaryl groups may be optionally substituted. For example, M and M' can be selected from the non-limiting group consisting of optionally substituted phenyl, oxazole, and thiazole. In the formulas herein, M and M' can be independently selected from the list of biodegradable groups above.

Alkyl, alkenyl, and cyclyl (e.g., carbocyclyl and heterocyclyl) groups may be optionally substituted unless otherwise specified. Optional substituents may be selected from the group consisting of, but are not limited to, a halogen atom (e.g., a chloride, bromide, fluoride, or iodide group), a carboxylic acid (e.g., —C(O)OH), an alcohol (e.g., a hydroxyl, —OH), an ester (e.g., —C(O)OR or —OC(O)R), an aldehyde (e.g., —C(O)H), a carbonyl (e.g., —C(O)R, alternatively represented by C═O), an acyl halide (e.g., —C(O)X, in which X is a halide selected from bromide, fluoride, chloride, and iodide), a carbonate (e.g., —OC(O)OR), an alkoxy (e.g., —OR), an acetal (e.g., —$C(OR)_2R''$, in which each OR are alkoxy groups that can be the same or different and R" is an alkyl or alkenyl group), a phosphate (e.g., $P(O)_4^{3-}$), a thiol (e.g., —SH), a sulfoxide (e.g., —S(O)R), a sulfinic acid (e.g., —S(O)OH), a sulfonic acid (e.g., —$S(O)_2OH$), a thial (e.g., —C(S)H), a sulfate (e.g., $S(O)_4^{2-}$), a sulfonyl (e.g., —$S(O)_2$—), an amide (e.g., —$C(O)NR_2$, or —N(R)C(O)R), an azido (e.g., —$N_3$), a nitro (e.g., —$NO_2$), a cyano (e.g., —CN), an isocyano (e.g., —NC), an acyloxy (e.g., —OC(O)R), an amino (e.g., —$NR_2$, —NRH, or —$NH_2$), a carbamoyl (e.g., —OC(O)$NR_2$, —OC(O)NRH, or —OC(O)$NH_2$), a sulfonamide (e.g., —$S(O)_2NR_2$, —$S(O)_2NRH$, —$S(O)_2NH_2$, —N(R)$S(O)_2R$, —N(H)$S(O)_2R$, —N(R)$S(O)_2H$, or —N(H)$S(O)_2H$), an alkyl group, an alkenyl group, and a cyclyl (e.g., carbocyclyl or heterocyclyl) group.

In any of the preceding, R is an alkyl or alkenyl group, as defined herein. In some embodiments, the substituent groups themselves may be further substituted with, for example, one, two, three, four, five, or six substituents as defined herein. For example, a $C_{1-6}$ alkyl group may be further substituted with one, two, three, four, five, or six substituents as described herein.

The compounds of any one of formulae (I), (IA), (II), (IIa), (IIb), (IIc), (IId), and (IIe) include one or more of the following features when applicable.

In some embodiments, $R_4$ is selected from the group consisting of a $C_{3-6}$ carbocycle, —$(CH_2)_nQ$, —$CH_2)_n$CHQR, —CHQR, and —$CQ(R)_2$, where Q is selected from a $C_{3-6}$ carbocycle, 5- to 14-membered aromatic or non-aromatic heterocycle having one or more heteroatoms selected from N, O, S, and P, —OR, —$O(CH_2)_nN(R)_2$, —C(O)OR, —OC(O)R, —$CX_3$, —$CX_2H$, —$CXH_2$, —CN, —$N(R)_2$, —$C(O)N(R)_2$, —N(R)C(O)R, —N(R)$S(O)_2R$, —N(R)C(O)$N(R)_2$, —N(R)C(S)$N(R)_2$, and —C(R)$N(R)_2$C(O)OR, and each n is independently selected from 1, 2, 3, 4, and 5.

In another embodiment, $R_4$ is selected from the group consisting of a $C_{3-6}$ carbocycle, —$CH_2)_nQ$, —$CH_2)_n$CHQR, —CHQR, and —$CQ(R)_2$, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —N(R)$S(O)_2R$, —N(R)C(O)$N(R)_2$, —N(R)C(S)$N(R)_2$, —C(R)$N(R)_2$C(O)OR, and a 5- to 14-membered heterocycloalkyl having one or more heteroatoms selected from N, O, and S which is substituted with one or more substituents selected from oxo (═O), OH, amino, and $C_{1-3}$ alkyl, and each n is independently selected from 1, 2, 3, 4, and 5.

In another embodiment, $R_4$ is selected from the group consisting of a $C_{3-6}$ carbocycle, —$CH_2)_nQ$, —$CH_2)_n$CHQR, —CHQR, and —$CQ(R)_2$, where Q is selected from a $C_{3-6}$ carbocycle, a 5- to 14-membered heterocycle having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —N(R)$S(O)_2R$, —N(R)C(O)$N(R)_2$, —N(R)C(S)$N(R)_2$, —C(R)$N(R)_2$C(O)OR, and each n is independently selected from 1, 2, 3, 4, and 5; and when Q is a 5- to 14-membered heterocycle and (i) $R_4$ is —$(CH_2)_nQ$ in which n is 1 or 2, or (ii) $R_4$ is —$CH_2)_n$CHQR in which n is 1, or (iii) $R_4$ is —CHQR, and —$CQ(R)_2$, then Q is either a 5- to 14-membered heteroaryl or 8- to 14-membered heterocycloalkyl.

In another embodiment, $R_4$ is selected from the group consisting of a $C_{3-6}$ carbocycle, —$(CH_2)_nQ$, —$(CH_2)_n$CHQR, —CHQR, and —$CQ(R)_2$, where Q is selected from a $C_{3-6}$ carbocycle, a 5- to 14-membered heteroaryl having one or more heteroatoms selected from N, O, and S, —OR, —$O(CH_2)_nN(R)_2$, —C(O)OR, —OC(O)R, —$CX_3$, —$CX_2H$, —$CXH_2$, —CN, —$C(O)N(R)_2$, —N(R)C(O)R, —N(R)$S(O)_2R$, —N(R)C(O)$N(R)_2$, —N(R)C(S)$N(R)_2$, —C(R)$N(R)_2$C(O)OR, and each n is independently selected from 1, 2, 3, 4, and 5.

In another embodiment, $R_4$ is unsubstituted $C_{14}$ alkyl, e.g., unsubstituted methyl.

In certain embodiments, the disclosure provides a compound having the Formula (I), wherein $R_4$ is —$CH_2)_nQ$ or —$CH_2)_n$CHQR, where Q is —$N(R)_2$, and n is selected from 3, 4, and 5.

In certain embodiments, the disclosure provides a compound having the Formula (I), wherein $R_4$ is selected from the group consisting of —$CH_2)_nQ$, —$CH_2)_n$CHQR, —CHQR, and —$CQ(R)_2$, where Q is —$N(R)_2$, and n is selected from 1, 2, 3, 4, and 5.

In certain embodiments, the disclosure provides a compound having the Formula (I), wherein $R_2$ and $R_3$ are independently selected from the group consisting of $C_{2-14}$ alkyl, $C_{2-14}$ alkenyl, —R*YR", —YR", and —R*OR", or $R_2$ and $R_3$, together with the atom to which they are attached, form a heterocycle or carbocycle, and $R_4$ is —$CH_2)_nQ$ or —$CH_2)_n$CHQR, where Q is —$N(R)_2$, and n is selected from 3, 4, and 5.

In certain embodiments, $R_2$ and $R_3$ are independently selected from the group consisting of $C_{2-14}$ alkyl, $C_{2-14}$ alkenyl, —R*YR", —YR", and —R*OR", or $R_2$ and $R_3$, together with the atom to which they are attached, form a heterocycle or carbocycle.

In some embodiments, $R_1$ is selected from the group consisting of $C_{5-20}$ alkyl and $C_{5-20}$ alkenyl.

In other embodiments, $R_1$ is selected from the group consisting of —R*YR", —YR", and —R"M'R'.

In certain embodiments, $R_1$ is selected from —R*YR" and —YR". In some embodiments, Y is a cyclopropyl group. In some embodiments, R* is $C_8$ alkyl or $C_8$ alkenyl. In certain embodiments, R" is $C_{3-12}$ alkyl. For example, R" may be $C_3$ alkyl. For example, R" may be $C_{4-8}$ alkyl (e.g., $C_4$, $C_5$, $C_6$, $C_7$, or $C_8$ alkyl).

In some embodiments, $R_1$ is $C_{5-20}$ alkyl. In some embodiments, $R_1$ is $C_6$ alkyl. In some embodiments, $R_1$ is $C_8$ alkyl. In other embodiments, $R_1$ is $C_9$ alkyl. In certain embodiments, $R_1$ is $C_{14}$ alkyl. In other embodiments, $R_1$ is $C_{18}$ alkyl.

In some embodiments, $R_1$ is $C_{5-20}$ alkenyl. In certain embodiments, $R_1$ is $C_{18}$ alkenyl. In some embodiments, $R_1$ is linoleyl.

In certain embodiments, $R_1$ is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl, or heptadeca-9-yl). In certain embodiments, $R_1$ is

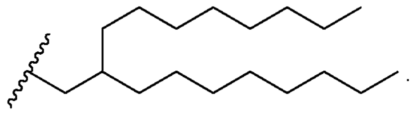 [SMILES: *CC(CCCCCCCC)CCCCCCCC]

In certain embodiments, $R_1$ is unsubstituted $C_{5-20}$ alkyl or $C_{5-20}$ alkenyl. In certain embodiments, R' is substituted $C_{5-20}$ alkyl or $C_{5-20}$ alkenyl (e.g., substituted with a $C_{3-6}$ carbocycle such as 1-cyclopropylnonyl).

In other embodiments, $R_1$ is —R"M'R'.

In some embodiments, R' is selected from —R*YR" and —YR". In some embodiments, Y is $C_{3-8}$ cycloalkyl. In some embodiments, Y is $C_{6-10}$ aryl. In some embodiments, Y is a cyclopropyl group. In some embodiments, Y is a cyclohexyl group. In certain embodiments, R* is $C_1$ alkyl.

In some embodiments, R" is selected from the group consisting of $C_{3-12}$ alkyl and $C_{3-12}$ alkenyl. In some embodiments, R" adjacent to Y is $C_1$ alkyl. In some embodiments, R" adjacent to Y is $C_{4-9}$ alkyl (e.g., $C_4$, $C_5$, $C_6$, $C_7$ or $C_8$ or $C_9$ alkyl).

In some embodiments, R' is selected from $C_4$ alkyl and $C_4$ alkenyl. In certain embodiments, R' is selected from $C_5$ alkyl and $C_5$ alkenyl. In some embodiments, R' is selected from $C_6$ alkyl and $C_6$ alkenyl. In some embodiments, R' is selected from $C_7$ alkyl and $C_7$ alkenyl. In some embodiments, R' is selected from $C_9$ alkyl and $C_9$ alkenyl.

In other embodiments, R' is selected from $C_{11}$ alkyl and $C_{11}$ alkenyl. In other embodiments, R' is selected from $C_{12}$ alkyl, $C_{12}$ alkenyl, $C_{13}$ alkyl, $C_{13}$ alkenyl, $C_{14}$ alkyl, $C_{14}$ alkenyl, $C_{15}$ alkyl, $C_{15}$ alkenyl, $C_{16}$ alkyl, $C_{16}$ alkenyl, $C_{17}$ alkyl, $C_{17}$ alkenyl, $C_{18}$ alkyl, and $C_{18}$ alkenyl. In certain embodiments, R' is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl or heptadeca-9-yl). In certain embodiments, R' is

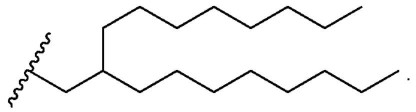

In certain embodiments, R' is unsubstituted $C_{1-18}$ alkyl. In certain embodiments, R' is substituted $C_{1-8}$ alkyl (e.g., $C_{1-15}$ alkyl substituted with a $C_{3-6}$ carbocycle such as 1-cyclopropylnonyl).

In some embodiments, R" is selected from the group consisting of $C_{3-14}$ alkyl and $C_{3-14}$ alkenyl. In some embodiments, R" is $C_3$ alkyl, $C_4$ alkyl, $C_5$ alkyl, $C_6$ alkyl, $C_7$ alkyl, or $C_8$ alkyl. In some embodiments, R" is $C_9$ alkyl, $C_{10}$ alkyl, $C_{11}$ alkyl, $C_{12}$ alkyl, $C_{13}$ alkyl, or $C_{14}$ alkyl.

In some embodiments, M' is —C(O)O—. In some embodiments, M' is —OC(O)—.

In other embodiments, M' is an aryl group or heteroaryl group. For example, M' may be selected from the group consisting of phenyl, oxazole, and thiazole.

In some embodiments, M is —C(O)O— In some embodiments, M is —OC(O)—. In some embodiments, M is —C(O)N(R')—. In some embodiments, M is —P(O)(OR')O—.

In other embodiments, M is an aryl group or heteroaryl group. For example, M may be selected from the group consisting of phenyl, oxazole, and thiazole.

In some embodiments, M is the same as M'. In other embodiments, M is different from M'.

In some embodiments, each $R_5$ is H. In certain such embodiments, each $R_6$ is also H.

In some embodiments, $R_7$ is H. In other embodiments, $R_7$ is $C_{1-3}$ alkyl (e.g., methyl, ethyl, propyl, or i-propyl).

In some embodiments, $R_2$ and $R_3$ are independently $C_{5-14}$ alkyl or $C_{5-14}$ alkenyl.

In some embodiments, $R_2$ and $R_3$ are the same. In some embodiments, $R_2$ and $R_3$ are $C_8$ alkyl. In certain embodiments, $R_2$ and $R_3$ are $C_2$ alkyl. In other embodiments, $R_2$ and $R_3$ are $C_3$ alkyl. In some embodiments, $R_2$ and $R_3$ are $C_4$ alkyl. In certain embodiments, $R_2$ and $R_3$ are $C_5$ alkyl. In other embodiments, $R_2$ and $R_3$ are $C_6$ alkyl. In some embodiments, $R_2$ and $R_3$ are $C_7$ alkyl.

In other embodiments, $R_2$ and $R_3$ are different. In certain embodiments, $R_2$ is $C_8$ alkyl. In some embodiments, $R_3$ is $C_{1-7}$ (e.g., Cl, $C_2$, $C_3$, $C_4$, $C_5$, $C_6$, or $C_7$ alkyl) or $C_9$ alkyl.

In some embodiments, $R_7$ and $R_3$ are H.

In certain embodiments, $R_2$ is H.

In some embodiments, m is 5, 7, or 9.

In some embodiments, $R_4$ is selected from $—(CH_2)_nQ$ and $—(CH_2)_nCHQR$.

In some embodiments, Q is selected from the group consisting of —OR, —OH, $—O(CH_2)_nN(R)_2$, —OC(O)R, $—CX_3$, —CN, —N(R)C(O)R, —N(H)C(O)R, $—N(R)S(O)_2R$, $—N(H)S(O)_2R$, $—N(R)C(O)N(R)_2$, $—N(H)C(O)N(R)_2$, —N(H)C(O)N(H)(R), $—N(R)C(S)N(R)_2$, $—N(H)C(S)N(R)_2$, —N(H)C(S)N(H)(R), $—C(R)N(R)_2C(O)OR$, a carbocycle, and a heterocycle.

In certain embodiments, Q is —OH.

In certain embodiments, Q is a substituted or unsubstituted 5- to 10-membered heteroaryl, e.g., Q is an imidazole, a pyrimidine, a purine, 2-amino-1,9-dihydro-6H-purin-6-one-9-yl (or guanin-9-yl), adenin-9-yl, cytosin-1-yl, or uracil-1-yl. In certain embodiments, Q is a substituted 5- to 14-membered heterocycloalkyl, e.g., substituted with one or more substituents selected from oxo (═O), OH, amino, and $C_{1-3}$ alkyl. For example, Q is 4-methylpiperazinyl, 4-(4-methoxybenzyl)piperazinyl, or isoindolin-2-yl-1,3-dione.

In certain embodiments, Q is an unsubstituted or substituted $C_{6-10}$ aryl (such as phenyl) or $C_{3-6}$ cycloalkyl.

In some embodiments, n is 1. In other embodiments, n is 2. In further embodiments, n is 3. In certain other embodiments, n is 4. For example, $R_4$ may be $—(CH_2)_2OH$. For example, $R_4$ may be $—(CH_2)_3OH$. For example, $R_4$ may be $—(CH_2)_4OH$. For example, $R_4$ may be benzyl. For example, $R_4$ may be 4-methoxybenzyl.

In some embodiments, $R_4$ is a $C_{3-6}$ carbocycle. In some embodiments, $R_4$ is a $C_{3-6}$ cycloalkyl. For example, $R_4$ may be cyclohexyl optionally substituted with e.g., OH, halo, $C_{1-6}$ alkyl, etc. For example, $R_4$ may be 2-hydroxycyclohexyl.

In some embodiments, R is H.

In some embodiments, R is unsubstituted $C_{1-3}$ alkyl or unsubstituted $C_{2-3}$ alkenyl. For example, $R_4$ may be $—CH_2CH(OH)CH_3$ or $—CH_2CH(OH)CH_2CH_3$.

In some embodiments, R is substituted $C_{1-3}$ alkyl, e.g., $CH_2OH$. For example, $R_4$ may be $—CH_2CH(OH)CH_2OH$.

In some embodiments, $R_2$ and $R_3$, together with the atom to which they are attached, form a heterocycle or carbocycle. In some embodiments, $R_2$ and $R_3$, together with the atom to which they are attached, form a 5- to 14-membered aromatic or non-aromatic heterocycle having one or more heteroatoms selected from N, O, S, and P. In some embodiments, $R_2$ and $R_3$, together with the atom to which they are attached, form an optionally substituted $C_{3-20}$ carbocycle (e.g., $C_{3-18}$ carbocycle, $C_{3-15}$ carbocycle, $C_{3-12}$ carbocycle, or $C_{3-10}$ carbocycle), either aromatic or non-aromatic. In some embodiments, $R_2$ and $R_3$, together with the atom to which they are attached, form a $C_{3-6}$ carbocycle. In other embodiments, $R_2$ and $R_3$, together with the atom to which they are attached, form a $C_6$ carbocycle, such as a cyclohexyl or phenyl group. In certain embodiments, the heterocycle or $C_{3-6}$ carbocycle is substituted with one or more alkyl groups (e.g., at the same ring atom or at adjacent or non-adjacent ring atoms). For example, $R_2$ and $R_3$, together with the atom to which they are attached, may form a cyclohexyl or phenyl group bearing one or more $C_5$ alkyl substitutions. In certain embodiments, the heterocycle or $C_{3-6}$ carbocycle formed by $R_2$ and $R_3$, is substituted with a carbocycle groups. For example, $R_2$ and $R_3$, together with the atom to which they are attached, may form a cyclohexyl or phenyl group that is substituted with cyclohexyl. In some embodiments, $R_2$ and $R_3$, together with the atom to which they are attached, form a $C_{7-15}$ carbocycle, such as a cycloheptyl, cyclopentadecanyl, or naphthyl group.

In some embodiments, $R_4$ is selected from —$(CH_2)_nQ$ and —$(CH_2)_nCHQR$. In some embodiments, Q is selected from the group consisting of —OR, —OH, —$O(CH_2)_nN(R)_2$, —OC(O)R, —$CX_3$, —CN, —N(R)C(O)R, —N(H)C(O)R, —$N(R)S(O)_2R$, —$N(H)S(O)_2R$, —$N(R)C(O)N(R)_2$, —$N(H)C(O)N(R)_2$, —N(H)C(O)N(H)(R), —$N(R)C(S)N(R)_2$, —$N(H)C(S)N(R)_2$, —N(H)C(S)N(H)(R), and a heterocycle. In other embodiments, Q is selected from the group consisting of an imidazole, a pyrimidine, and a purine.

In some embodiments, $R_2$ and $R_3$, together with the atom to which they are attached, form a heterocycle or carbocycle. In some embodiments, $R_2$ and $R_3$, together with the atom to which they are attached, form a $C_{3-6}$ carbocycle, such as a phenyl group. In certain embodiments, the heterocycle or $C_{3-6}$ carbocycle is substituted with one or more alkyl groups (e.g., at the same ring atom or at adjacent or non-adjacent ring atoms). For example, $R_2$ and $R_3$, together with the atom to which they are attached, may form a phenyl group bearing one or more $C_5$ alkyl substitutions.

In some embodiments, the pharmaceutical compositions of the present disclosure, the compound of formula (I) is selected from the group consisting of:

(Compound 1)

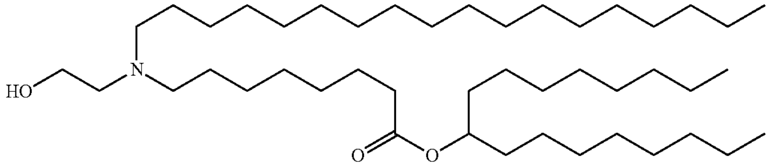
, (Compound 2)

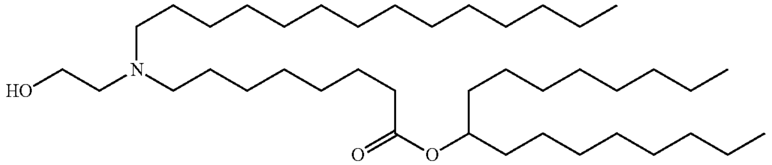
, (Compound 3)

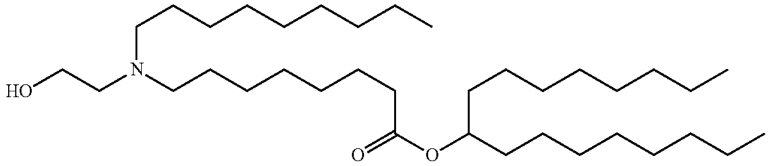
, (Compound 4)

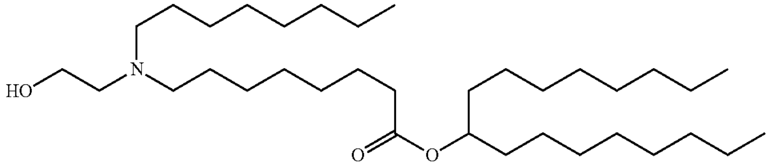
, (Compound 5)

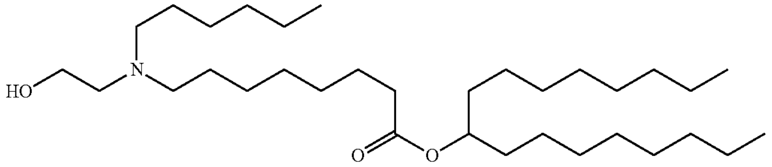
, (Compound 6)

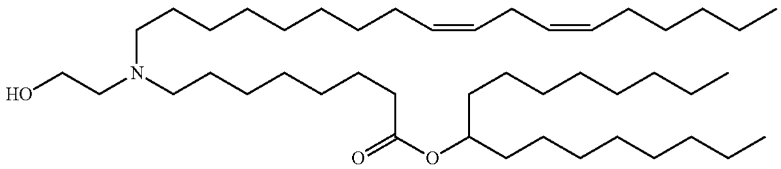
, (Compound 7)

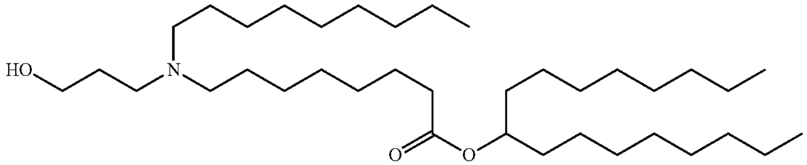
,

-continued
(Compound 8)
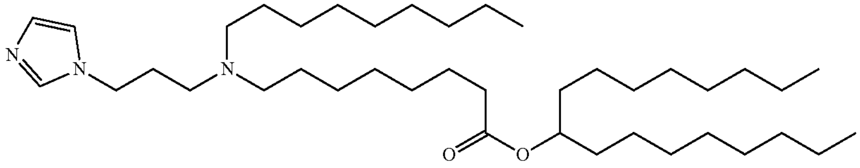
,
(Compound 9)
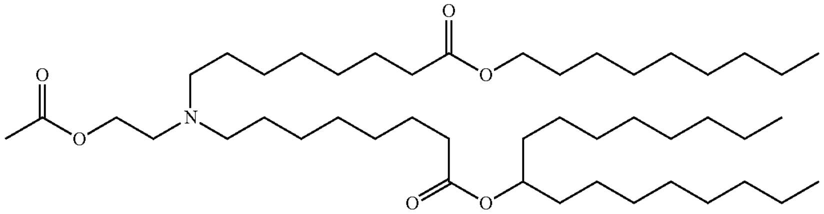
,
(Compound 10)
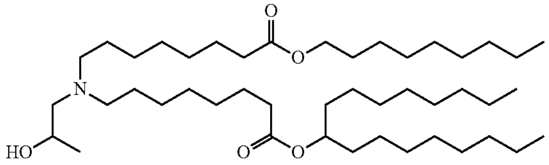
,
(Compound 11)
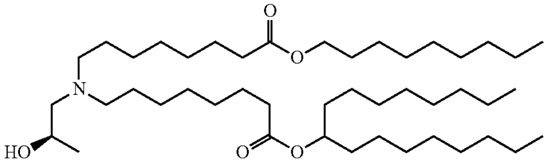
,
(Compound 12)
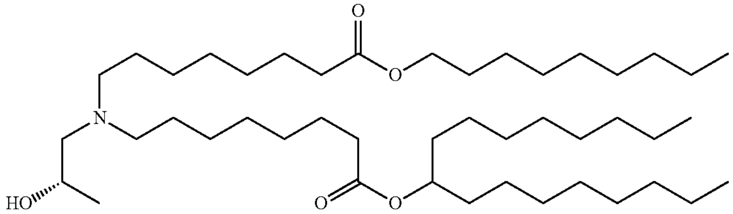
,
(Compound 13)
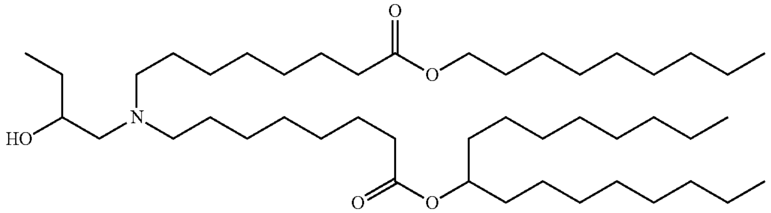
,
(Compound 14)
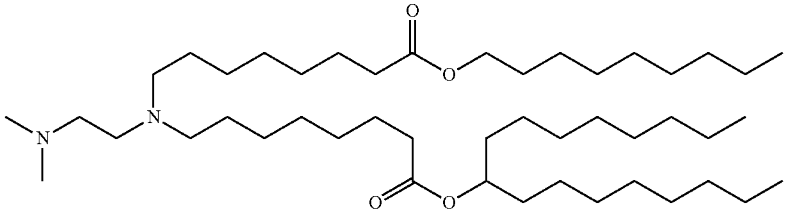
,
(Compound 15)
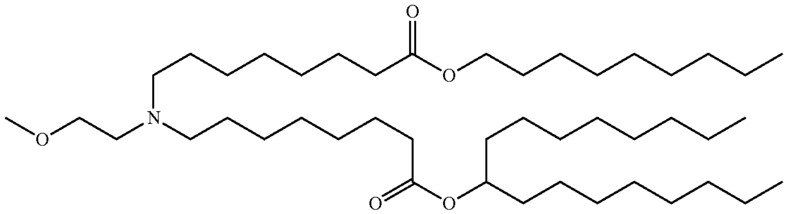
, -continued
(Compound 16)
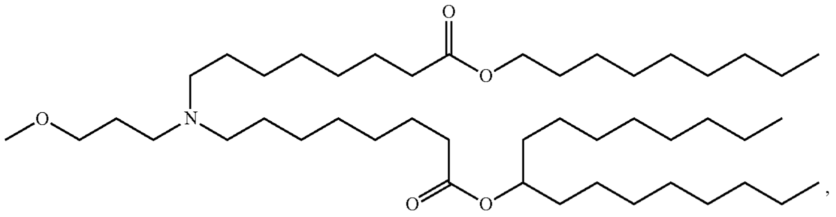
(Compound 17)
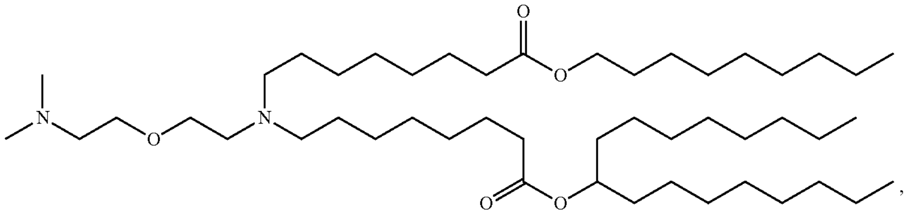
(Compound 18)
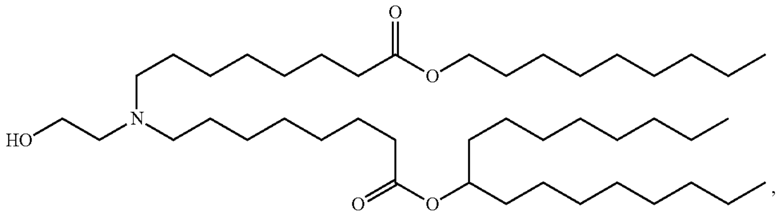
(Compound 19)
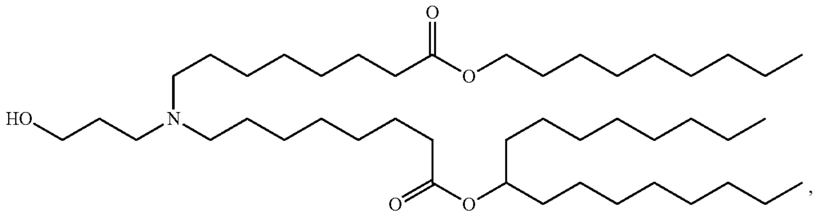
(Compound 20)
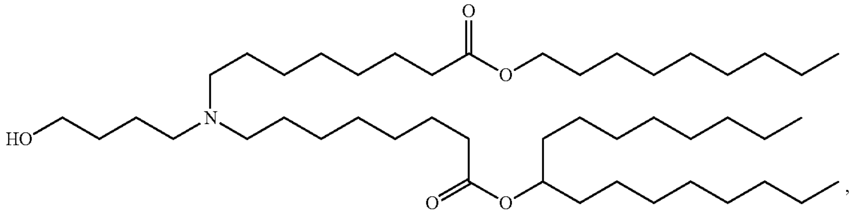
(Compound 21)
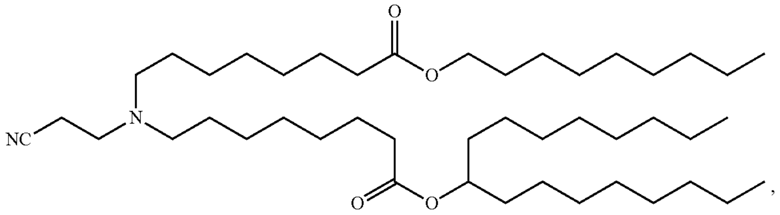
(Compound 22)
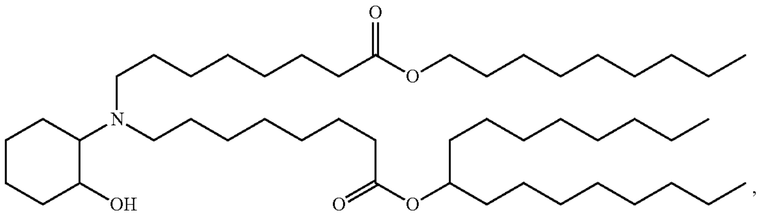

-continued
(Compound 23)
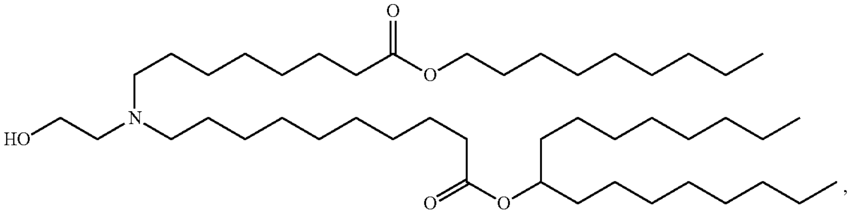
(Compound 24)
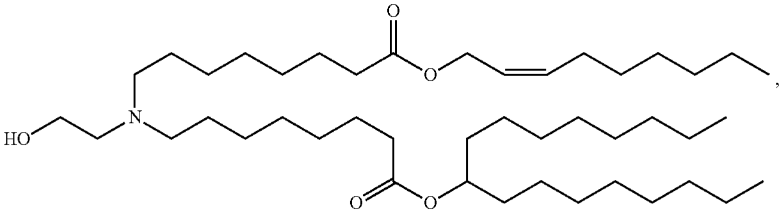
(Compound 25)
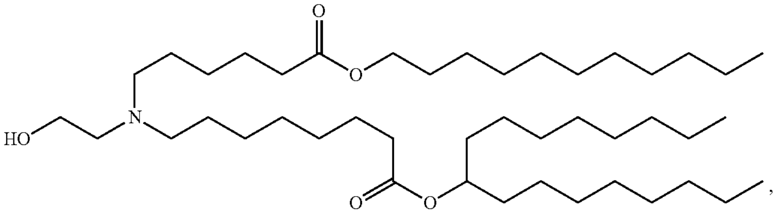
(Compound 26)
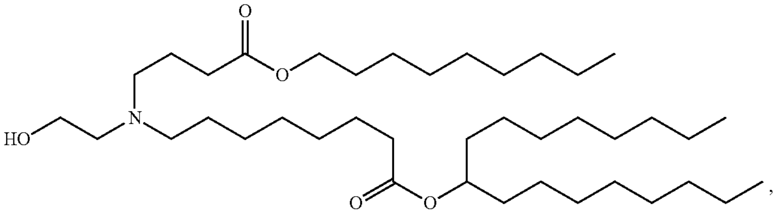
(Compound 27)
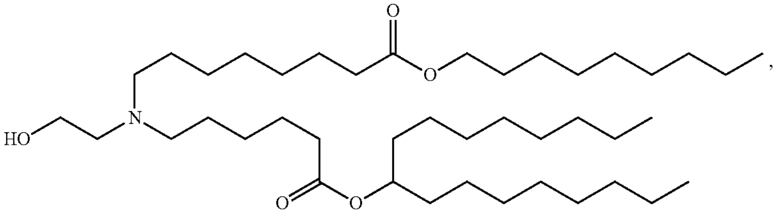
(Compound 28)
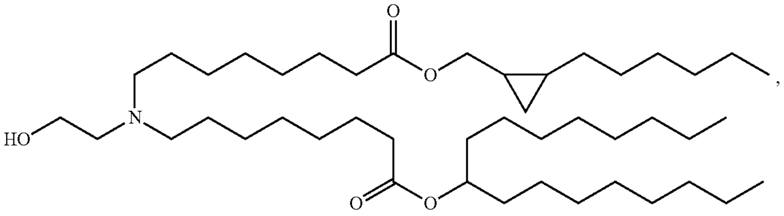
(Compound 29)
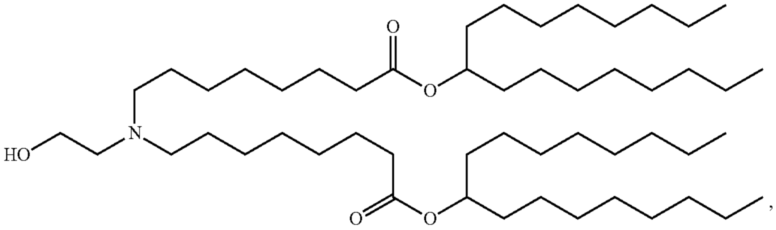

-continued
(Compound 30)
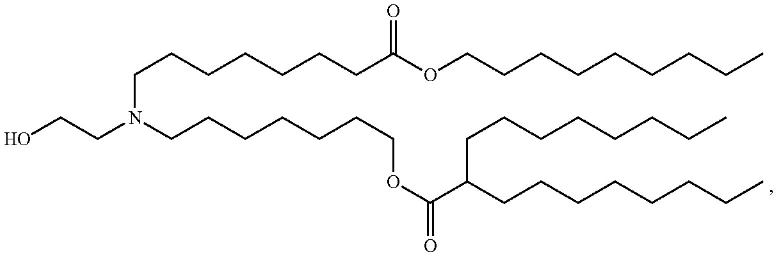
(Compound 31)
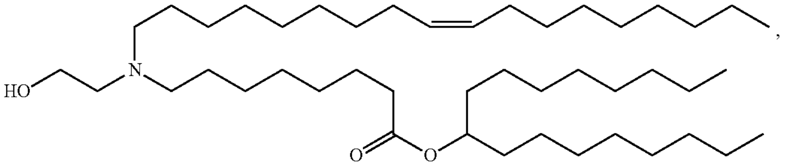
(Compound 32)
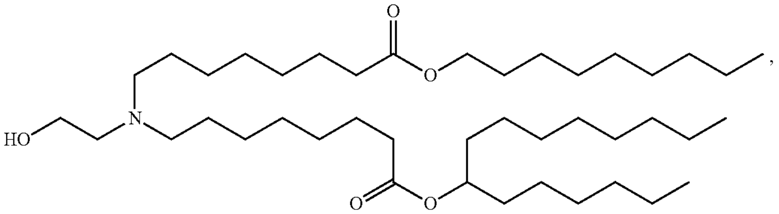
(Compound 33)
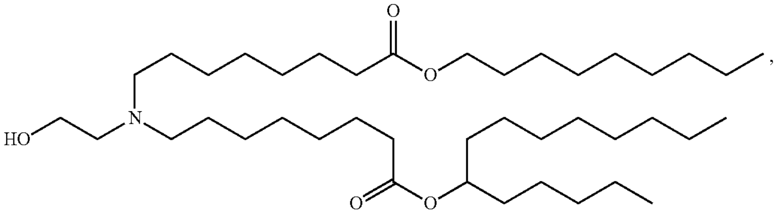
(Compound 34)
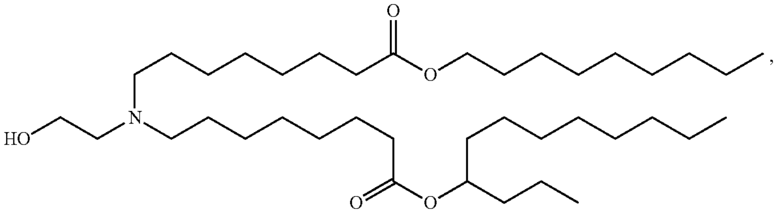
(Compound 35)
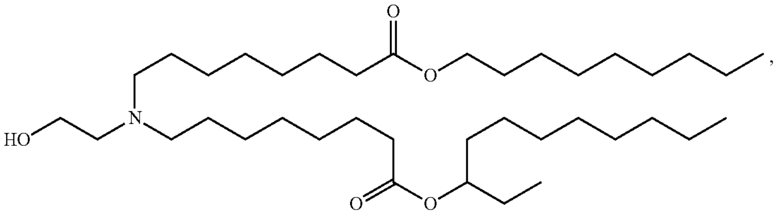
(Compound 36)
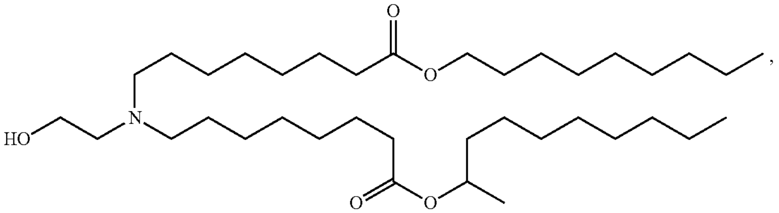

-continued
(Compound 37)
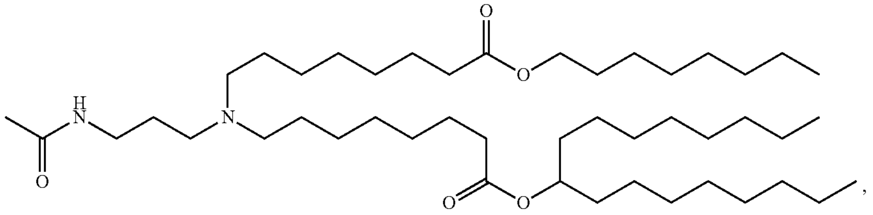
(Compound 38)
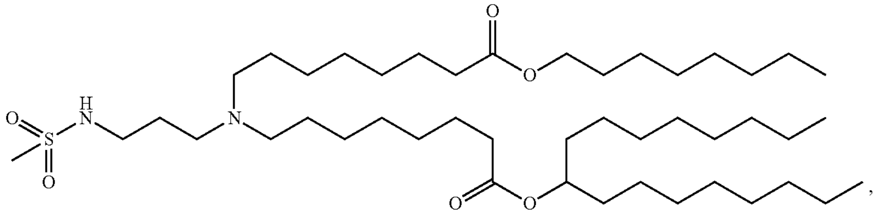
(Compound 39)
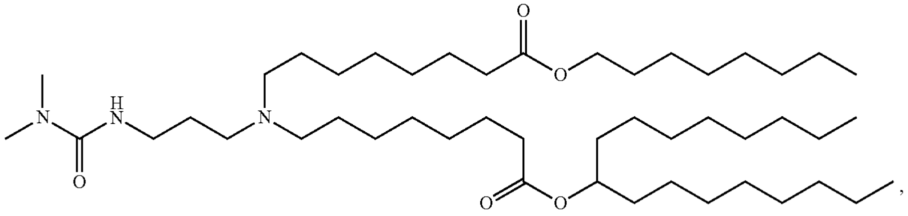
(Compound 40)
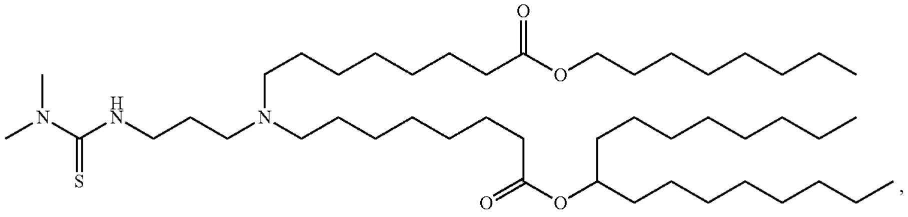
(Compound 41)
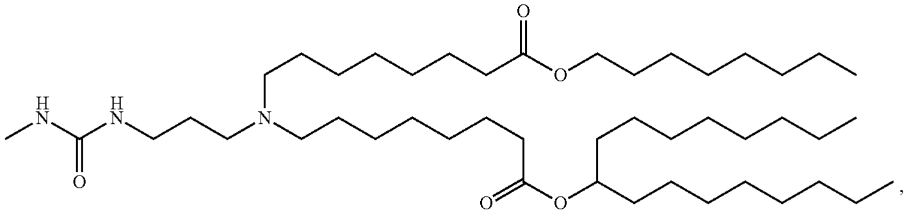
(Compound 42)
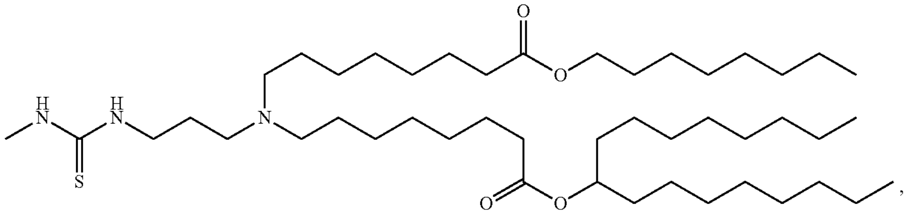
(Compound 43)
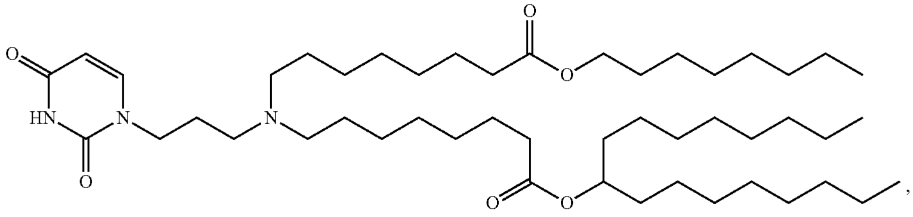

-continued
(Compound 44)
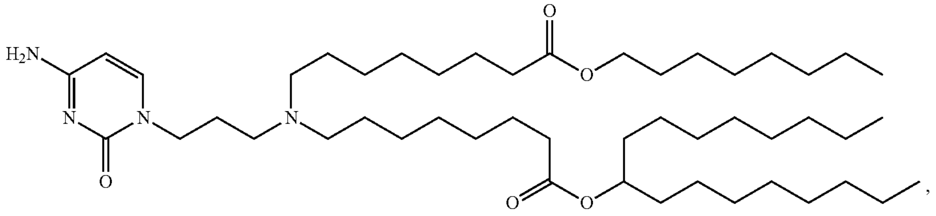
(Compound 45)
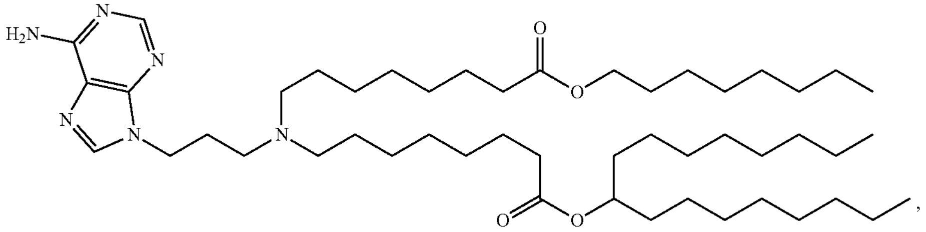
(Compound 46)
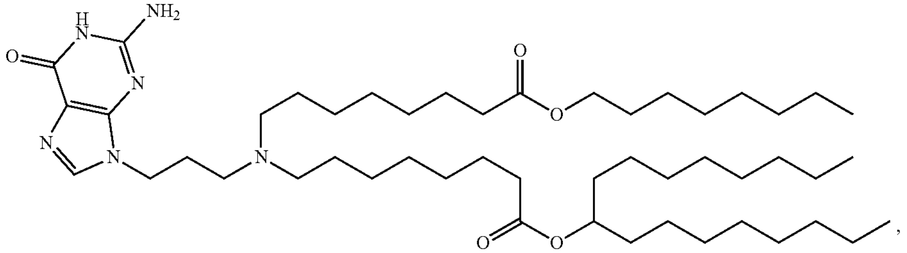
(Compound 47)
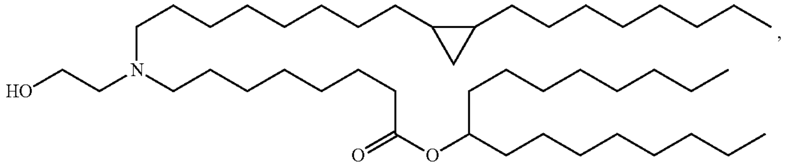
(Compound 48)
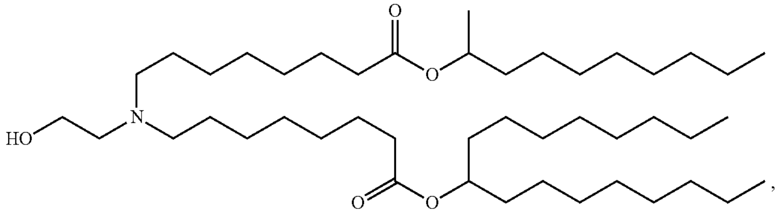
(Compound 49)
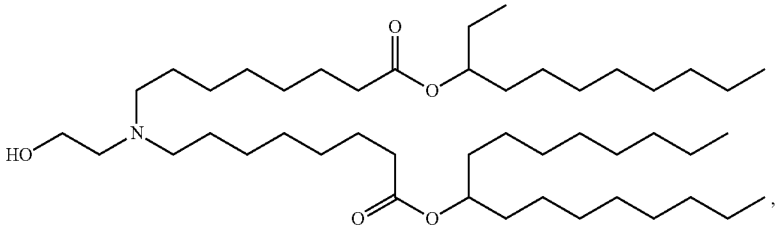
(Compound 50)
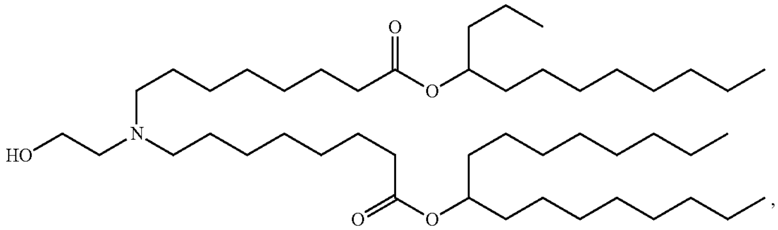

-continued
(Compound 51)
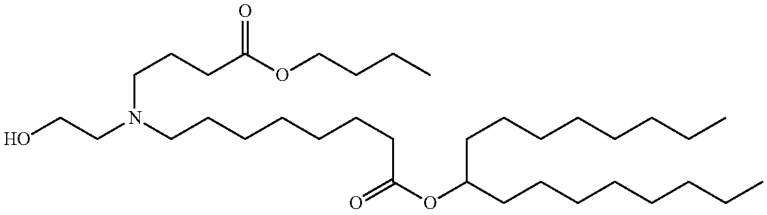
,
(Compound 52)
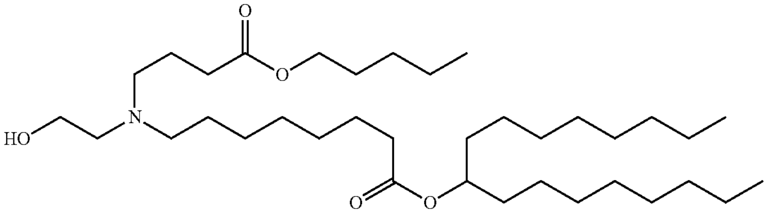
,
(Compound 53)
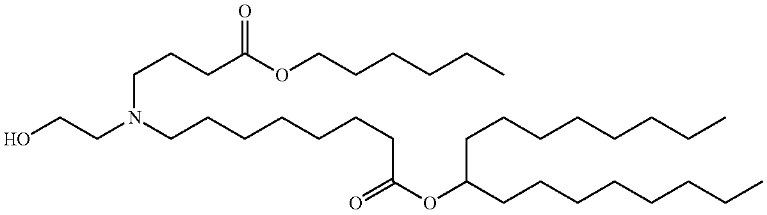
,
(Compound 54)
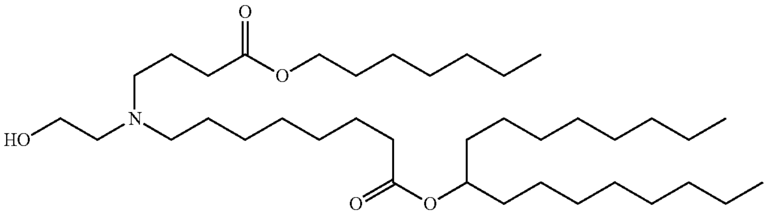
,
(Compound 55)
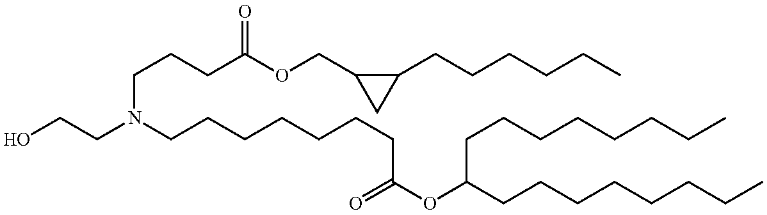
,
(Compound 56)
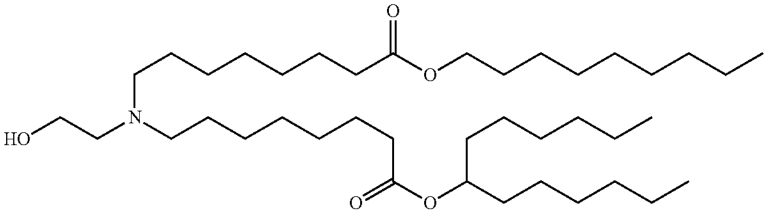
,
(Compound 57)
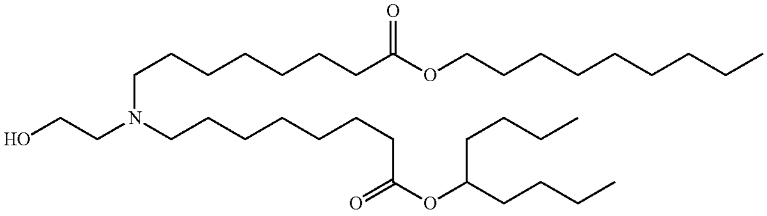
, -continued
(Compound 58)
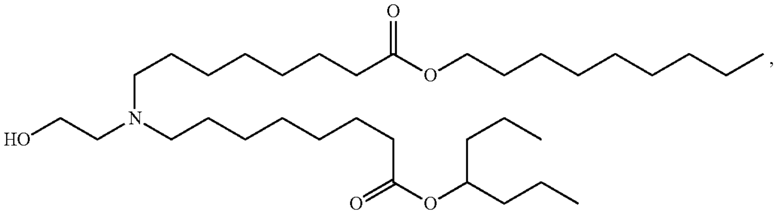
(Compound 59)
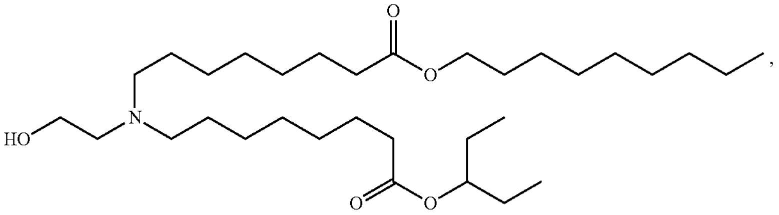
(Compound 60)
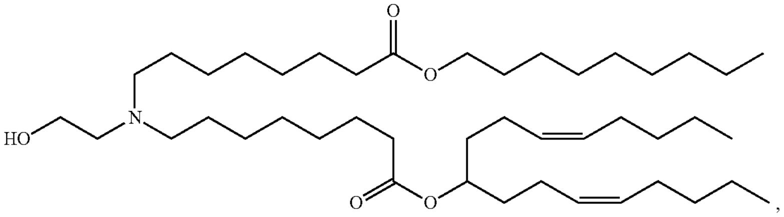
(Compound 61)
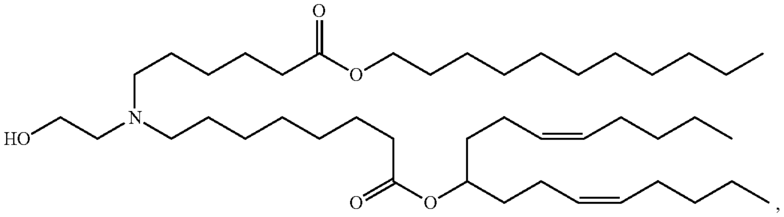
(Compound 62)
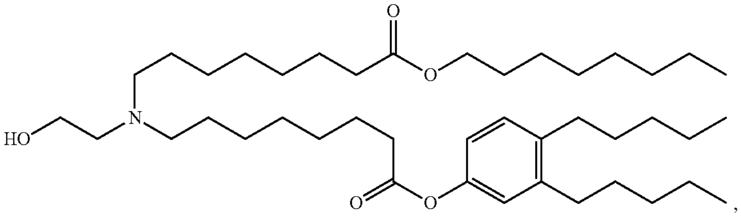
(Compound 63)
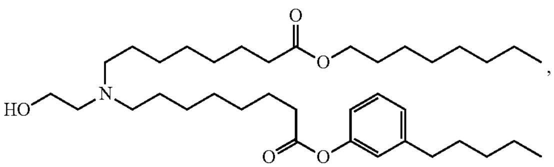
(Compound 64)
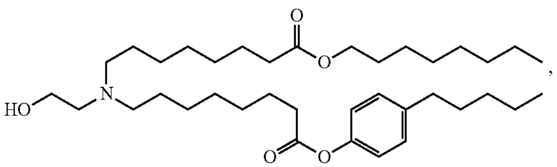
(Compound 65)
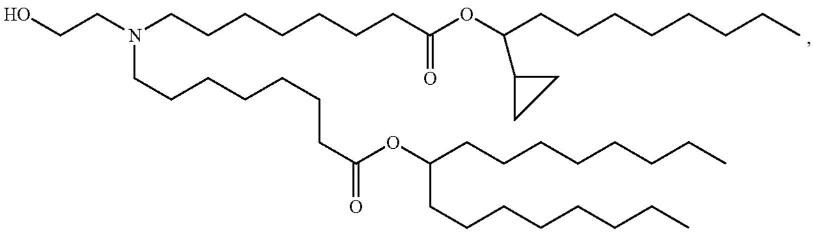

-continued
(Compound 66)
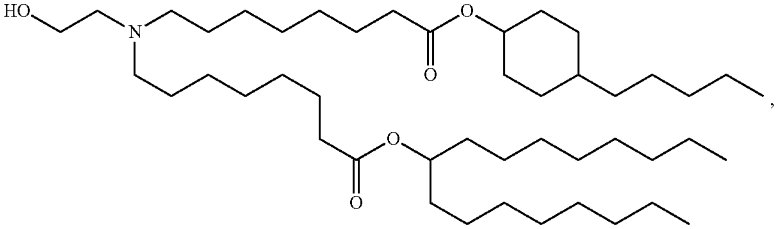
,
(Compound 67)
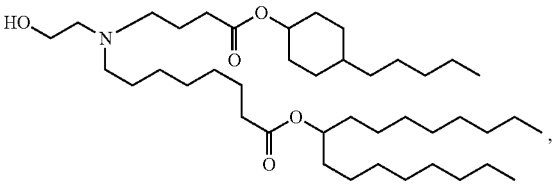
,
(Compound 68)
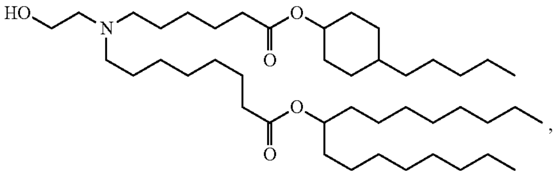
,
(Compound 69)
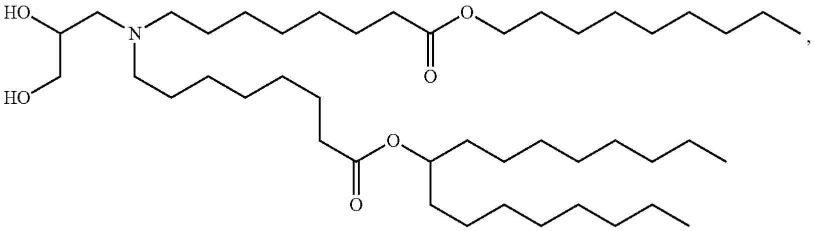
,
(Compound 70)
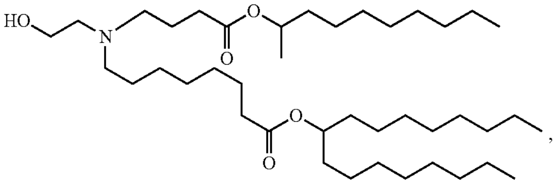
,
(Compound 71)
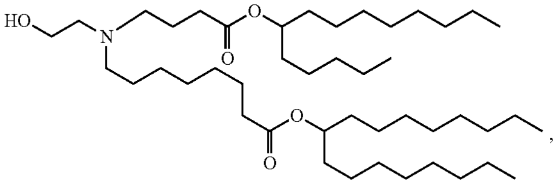
,
(Compound 72)
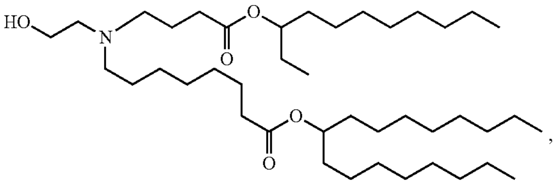
,
(Compound 73)
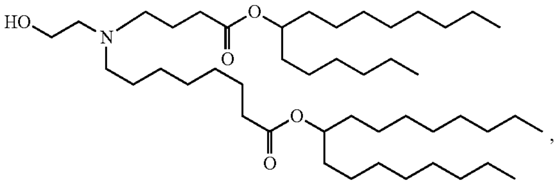
,
(Compound 74)
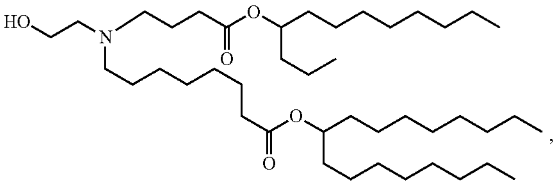
,
(Compound 75)
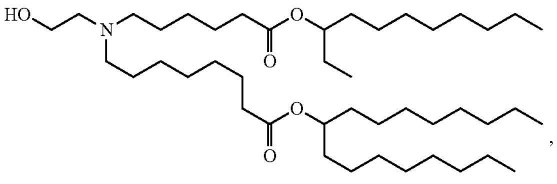
,
(Compound 76)
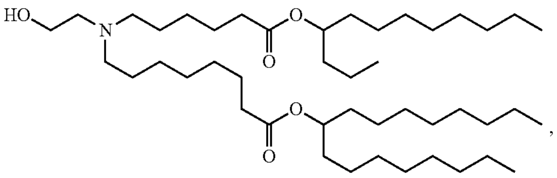
,
(Compound 77)
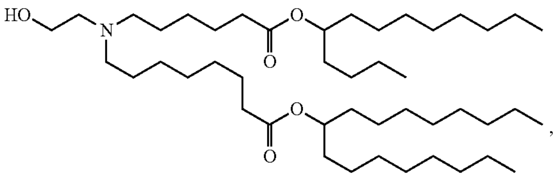
, -continued
(Compound 78)
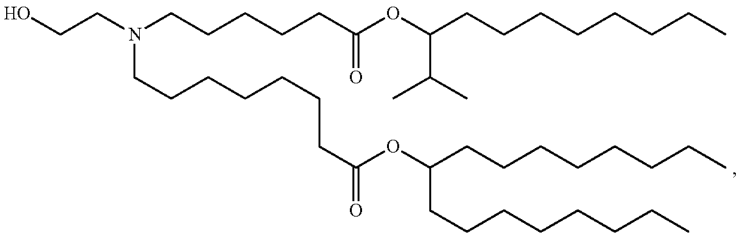
(Compound 79)
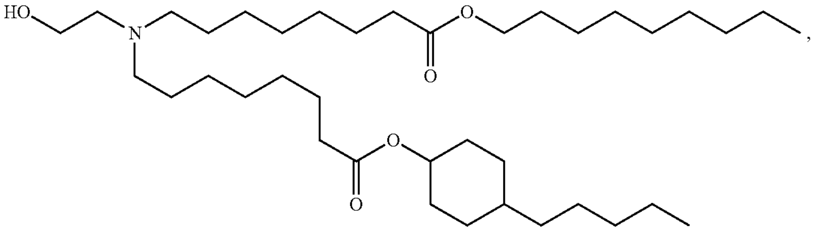
(Compound 80)
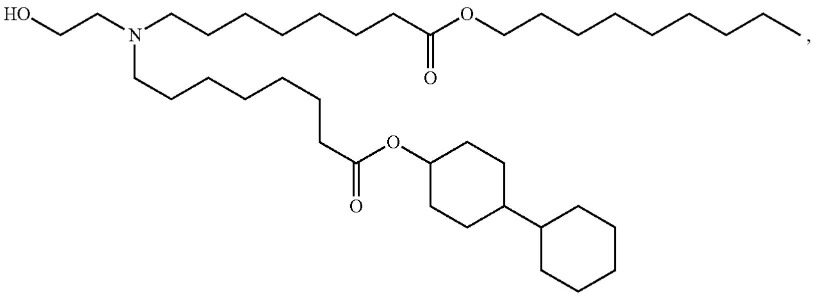
(Compound 81)
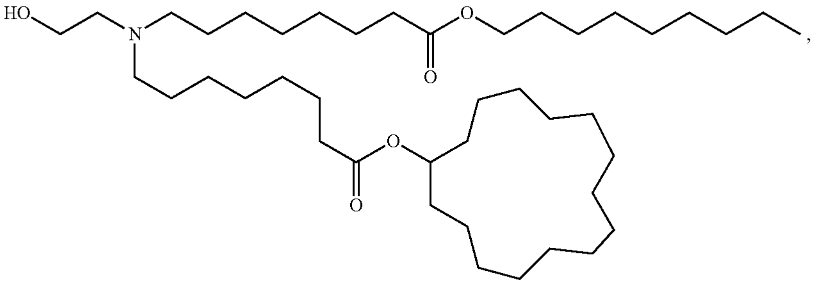
(Compound 82)
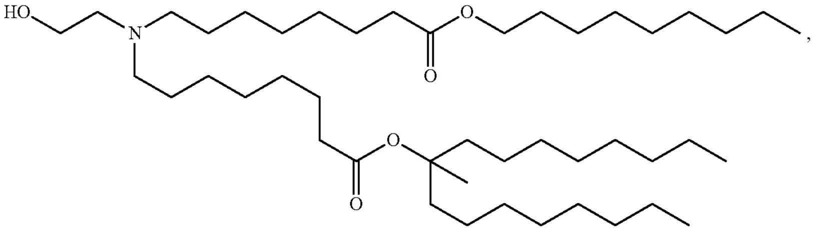
(Compound 83)
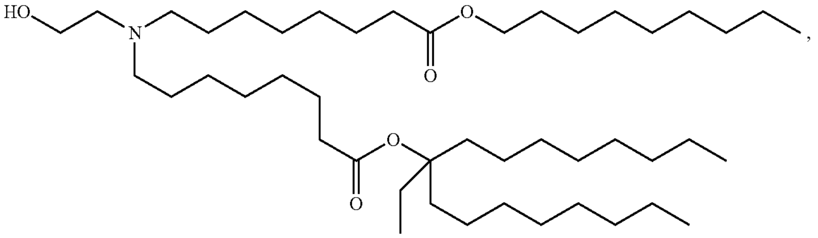

-continued
(Compound 84)
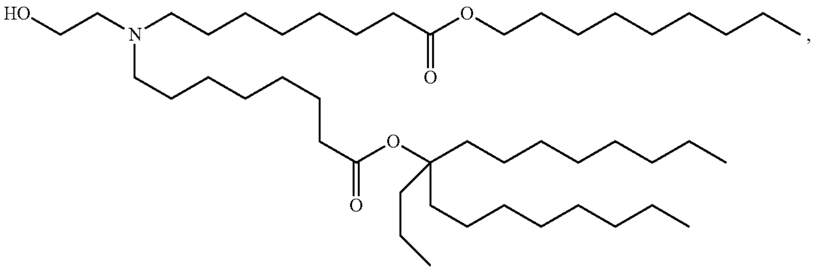
(Compound 85)
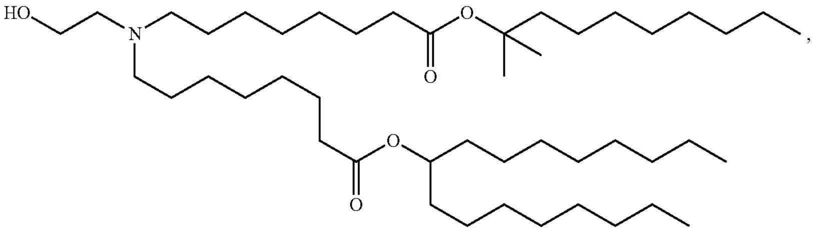
(Compound 86)
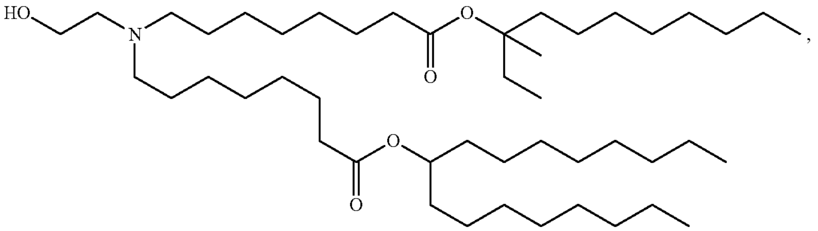
(Compound 87)
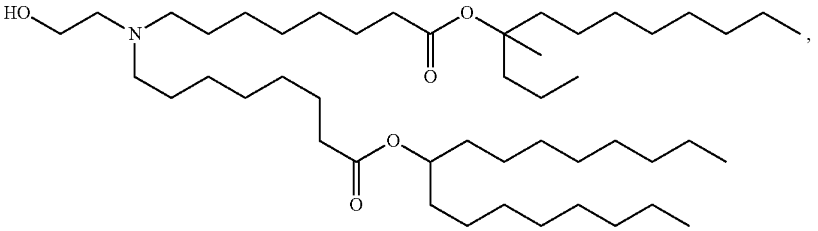
(Compound 88)
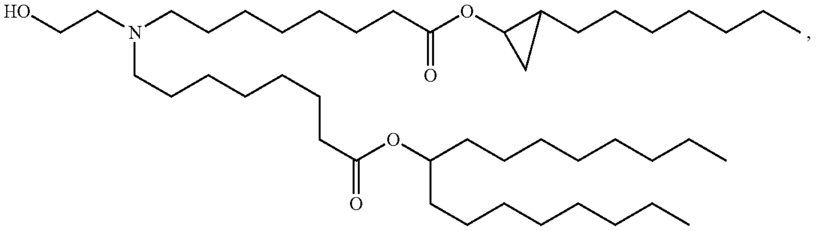
(Compound 89)
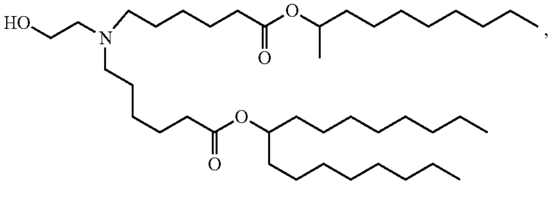
(Compound 90)
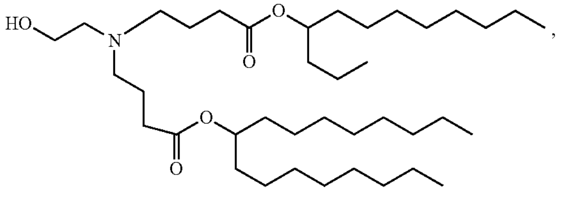

-continued
(Compound 91)
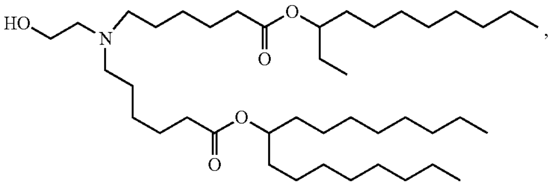
(Compound 92)
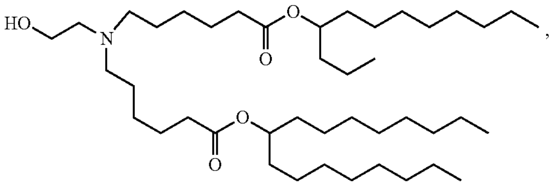
(Compound 93)
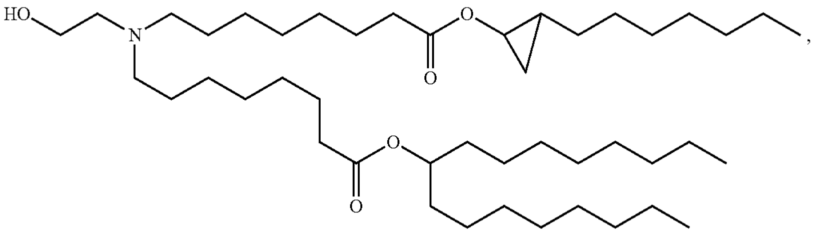
(Compound 94)
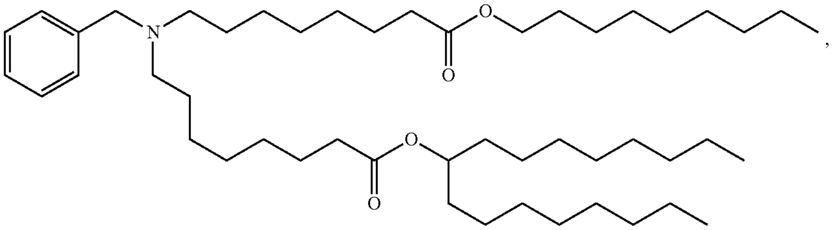
(Compound 95)
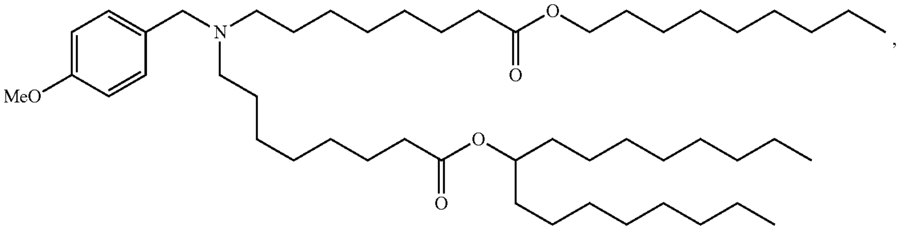
(Compound 96)
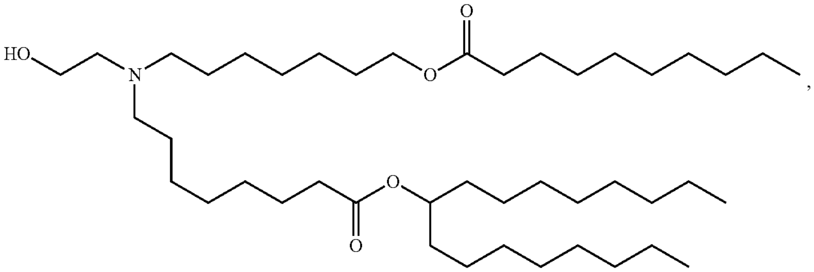
(Compound 97)
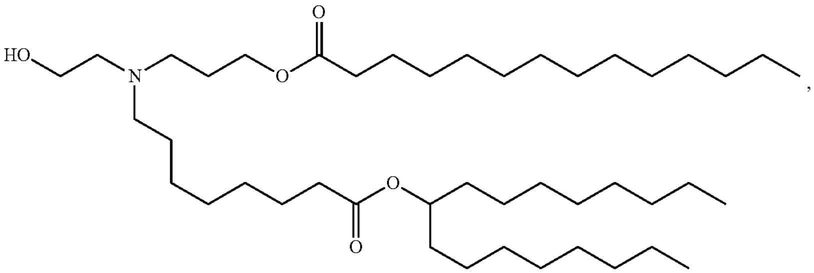

-continued
(Compound 98)
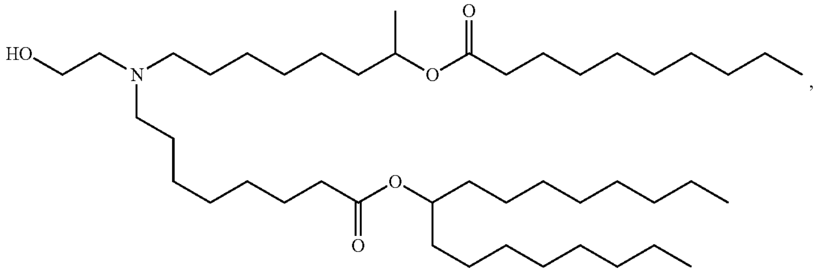
(Compound 99)
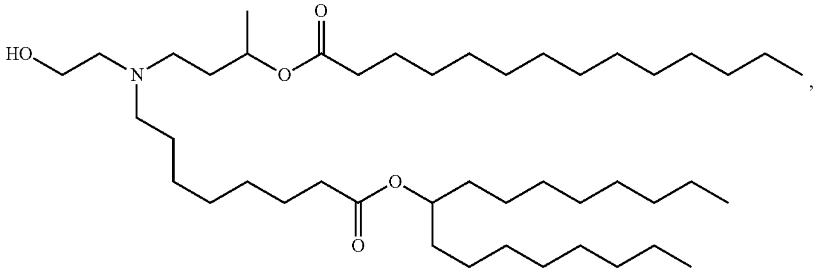
(Compound 100)
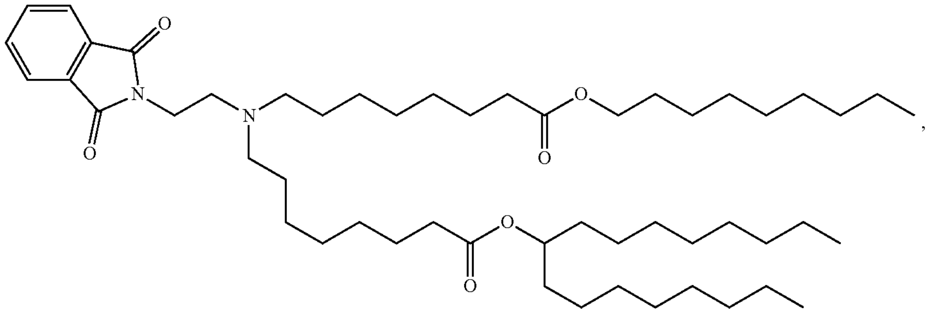
(Compound 101)
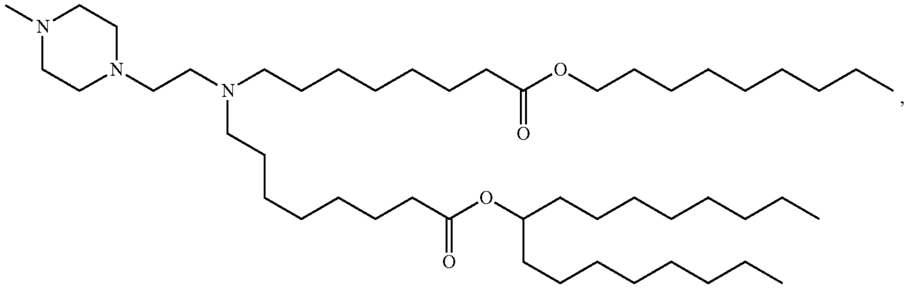
(Compound 102)
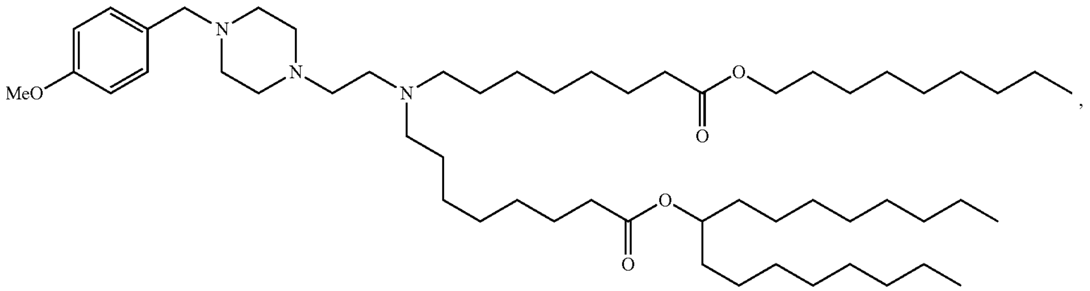

-continued
(Compound 103)
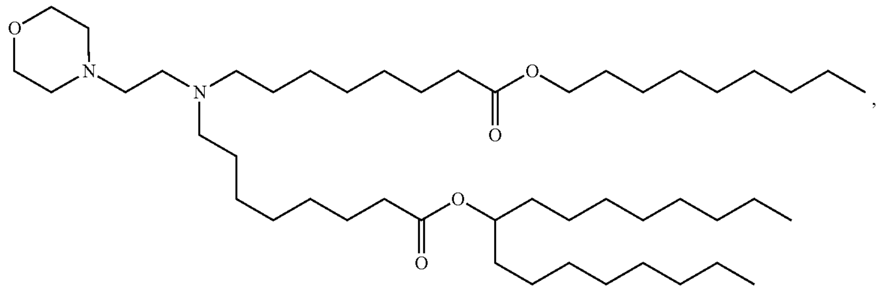
(Compound 104)
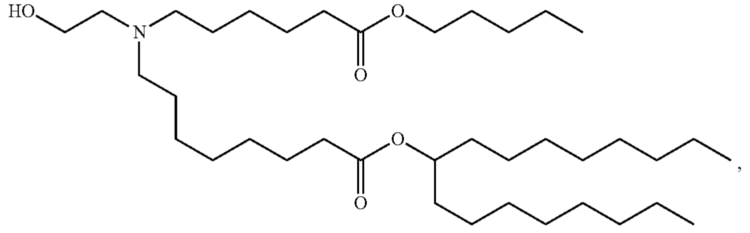
(Compound 105)
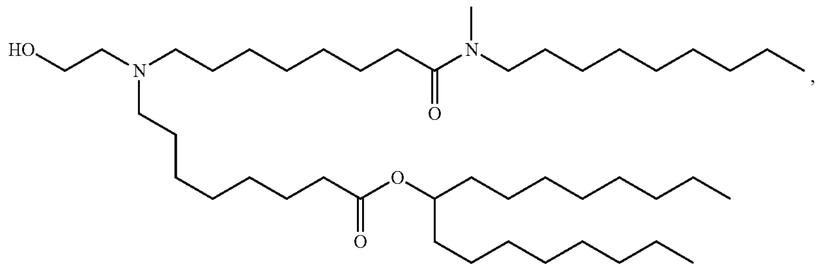
(Compound 106)
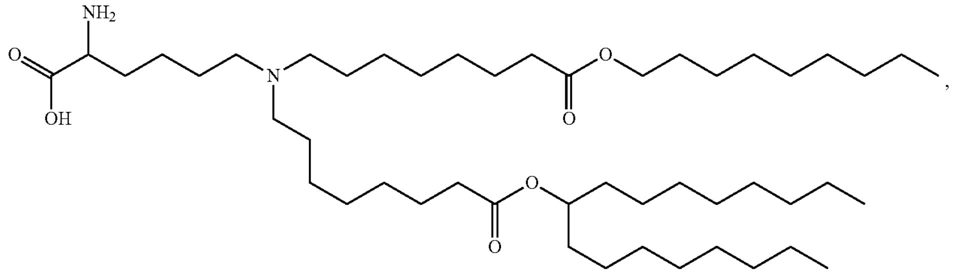
(Compound 107)
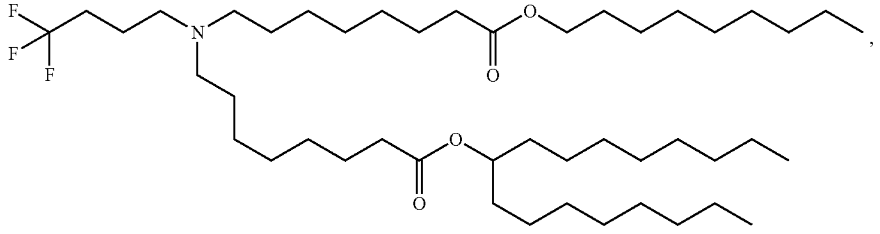
(Compound 108)
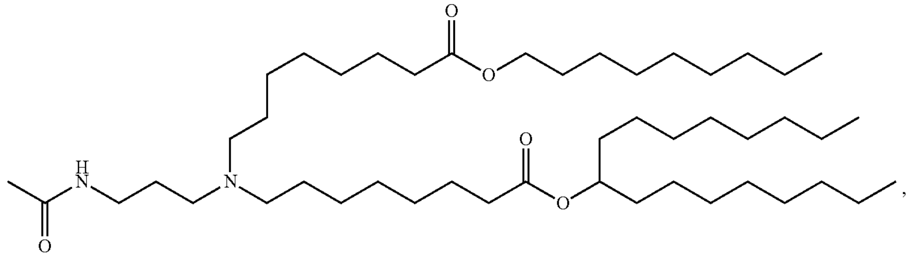

-continued
(Compound 109)
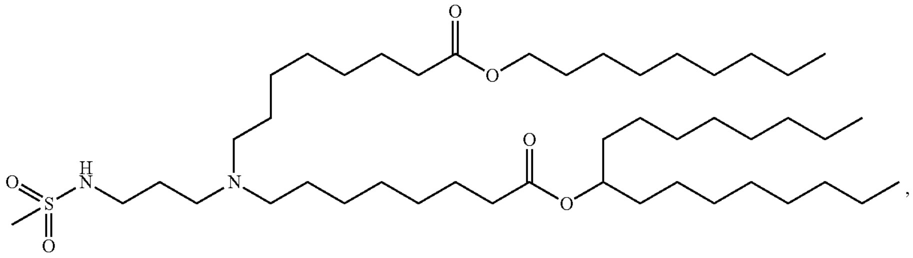
(Compound 110)
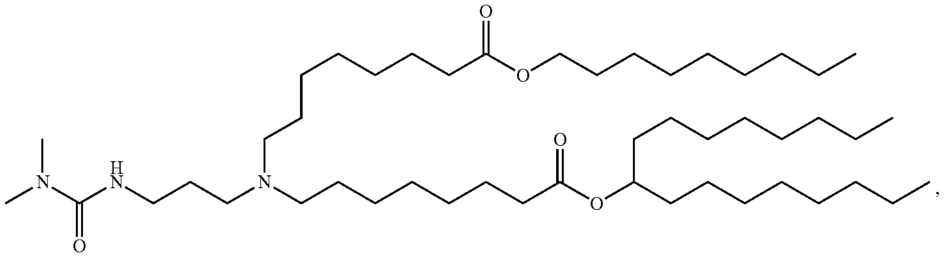
(Compound 111)
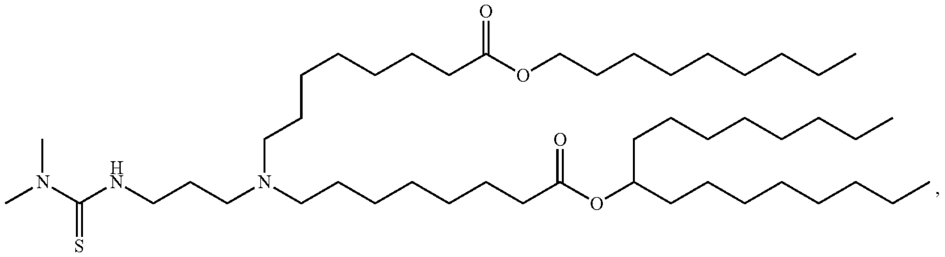
(Compound 112)
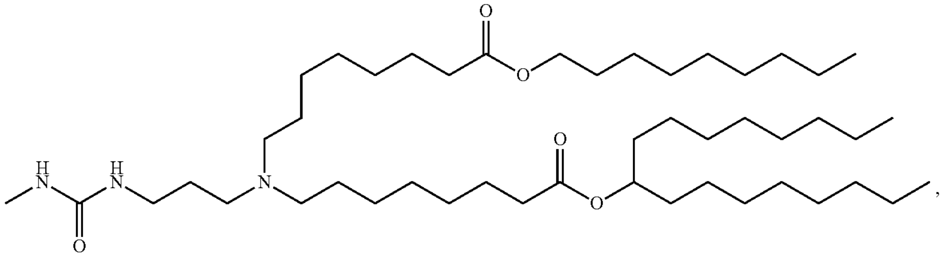
(Compound 113)
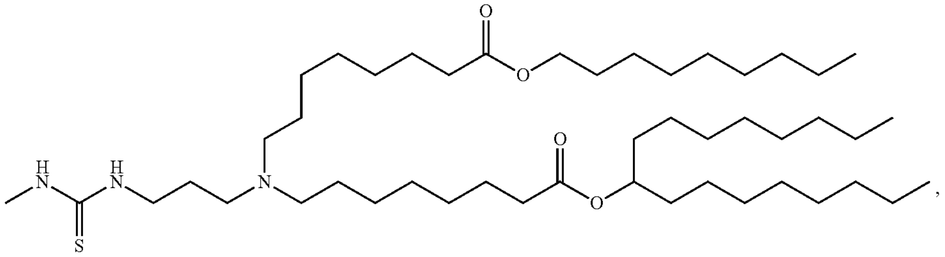
(Compound 114)
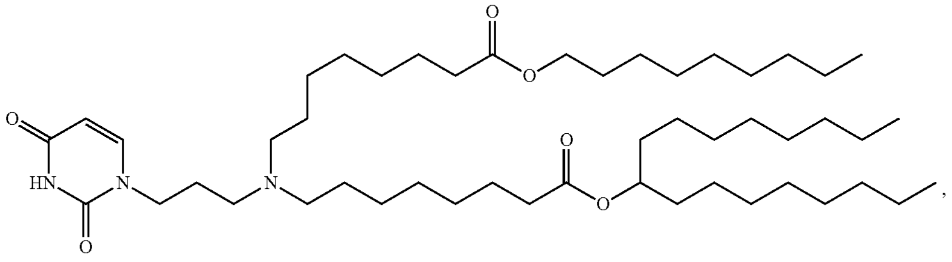

-continued
(Compound 115)
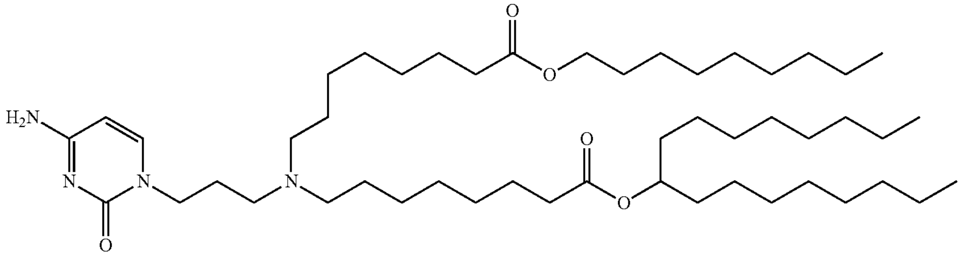
,
(Compound 116)
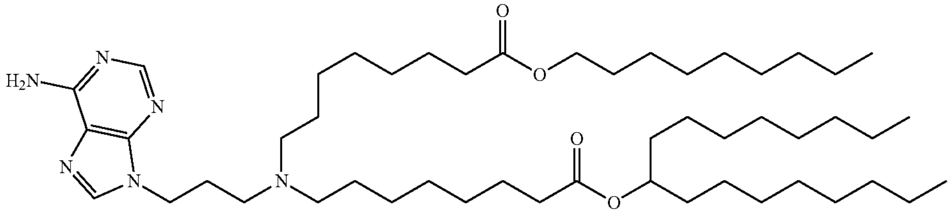
,
(Compound 117)
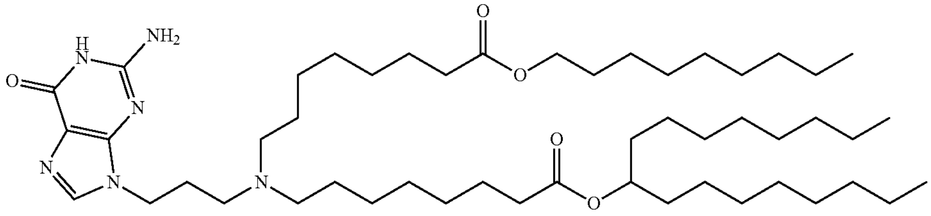
,
(Compound 118)
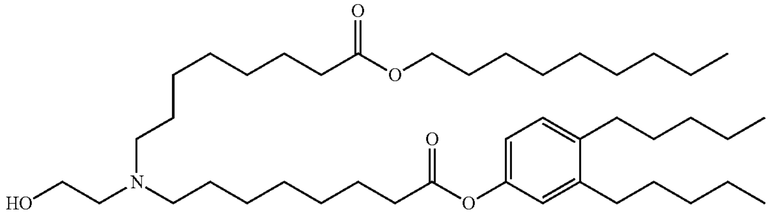
,
(Compound 119)
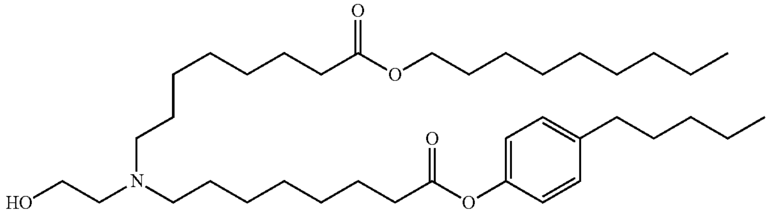
,
(Compound 120)
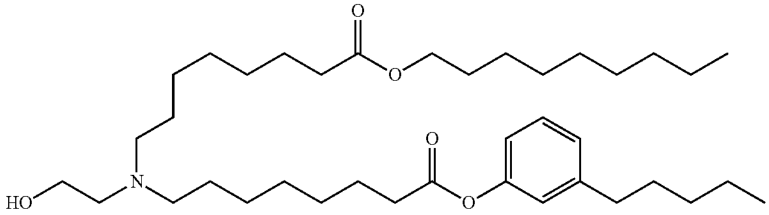
,
(Compound 121)
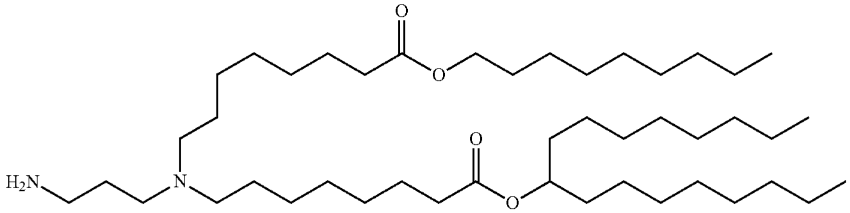
, -continued
(Compound 122)
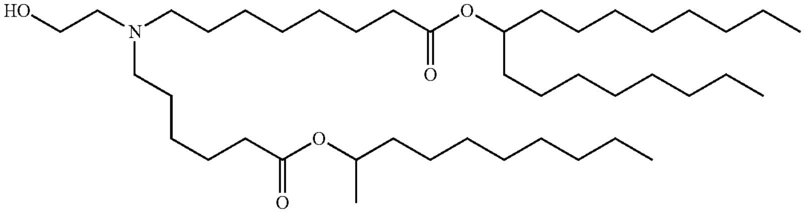
,
(Compound 123)
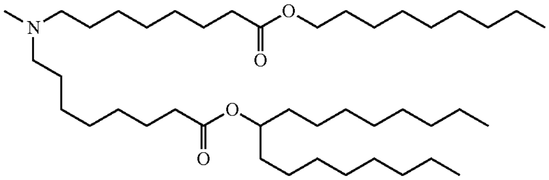
,
(Compound 124)
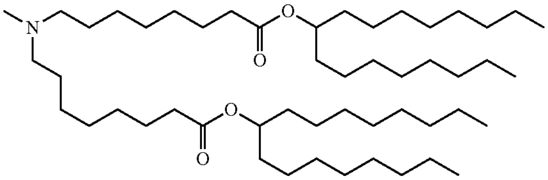
,
(Compound 125)
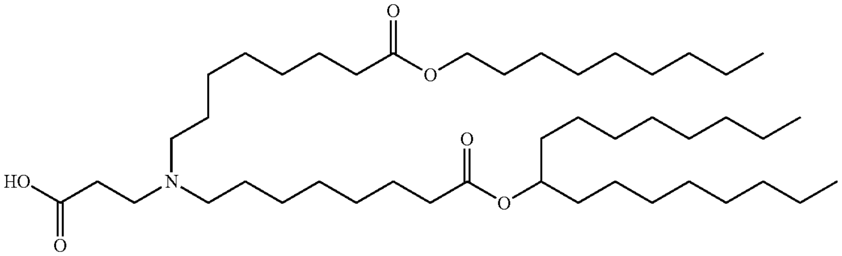
,
(Compound 126)
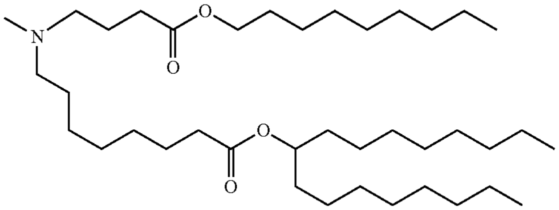
,
(Compound 127)
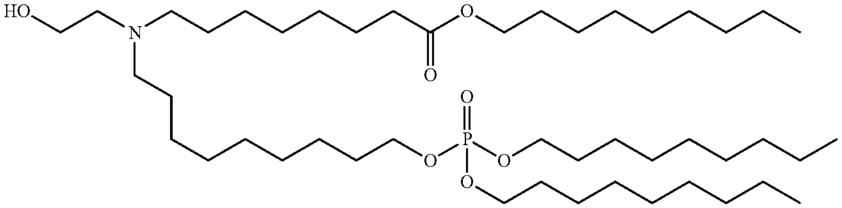
,
(Compound 128)
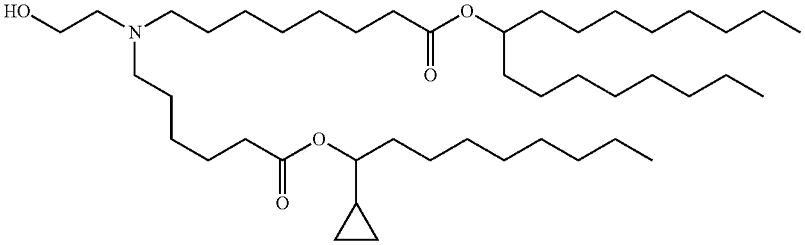
, -continued
(Compound 129)
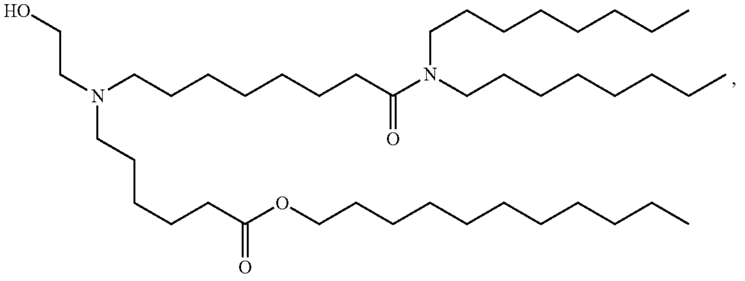
(Compound 130)
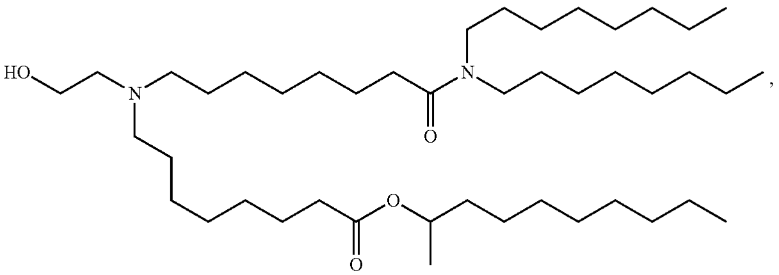
(Compound 131)
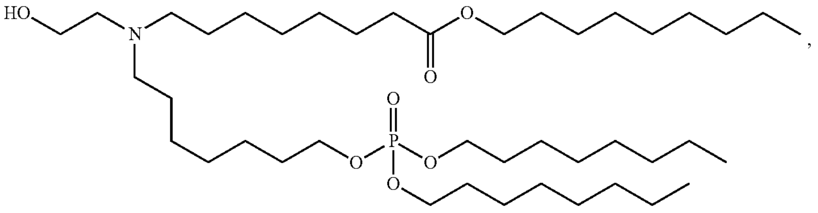
(Compound 132)
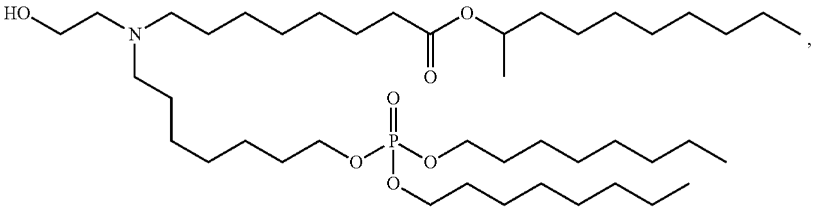
(Compound 133)
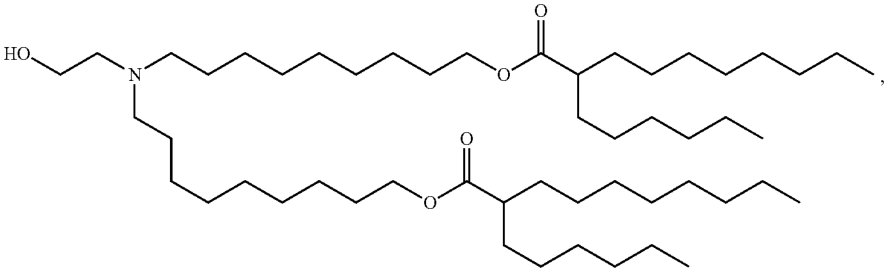
(Compound 134)
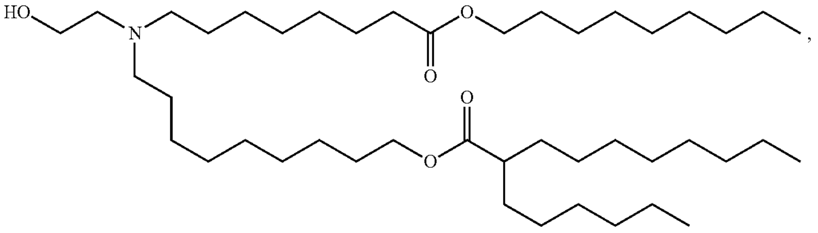

-continued
(Compound 135)
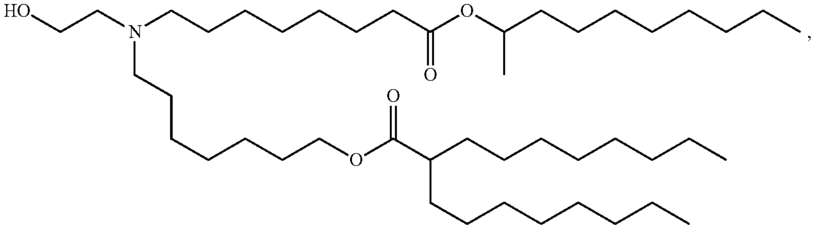
(Compound 136)
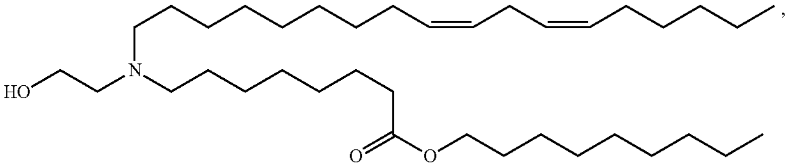
(Compound 137)
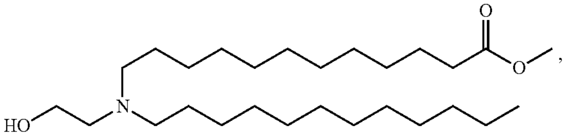
(Compound 138)
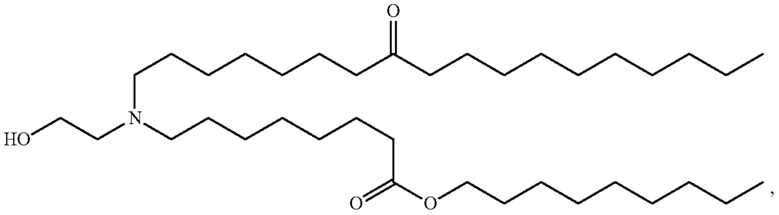
(Compound 139)
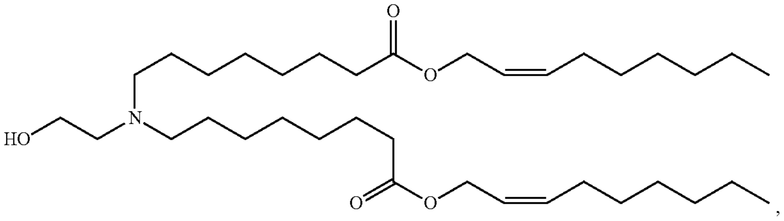
(Compound 140)
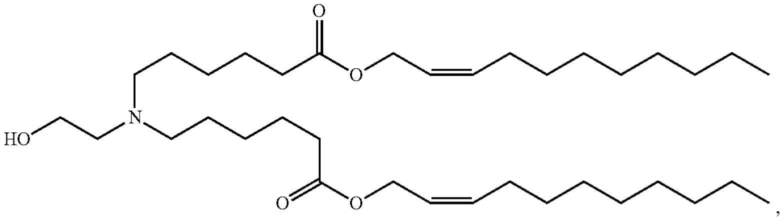
(Compound 141)
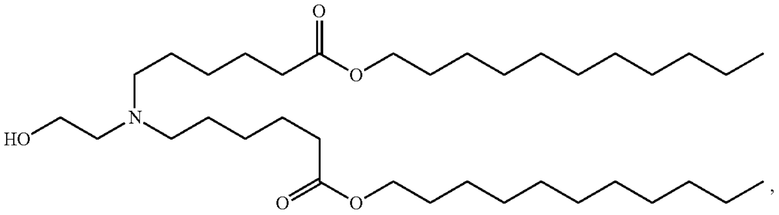

-continued (Compouind 142)

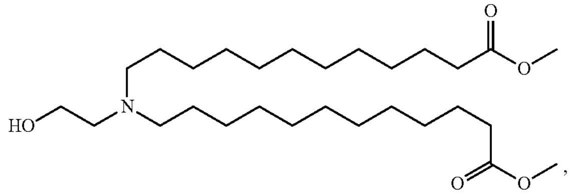

(Compound 143)

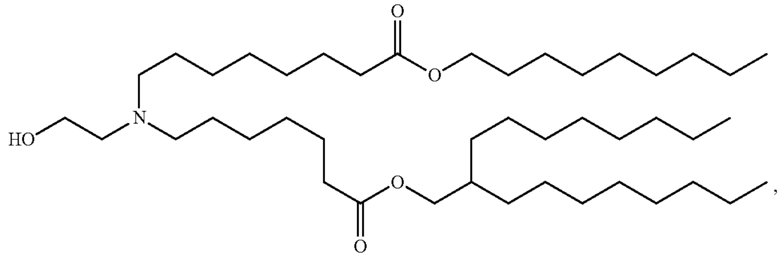

(Compound 144)

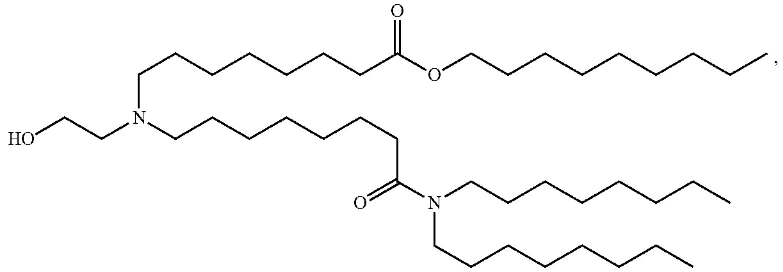

(Compound 145)

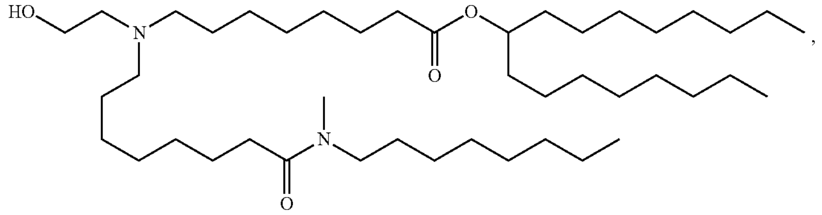

(Compound 146)

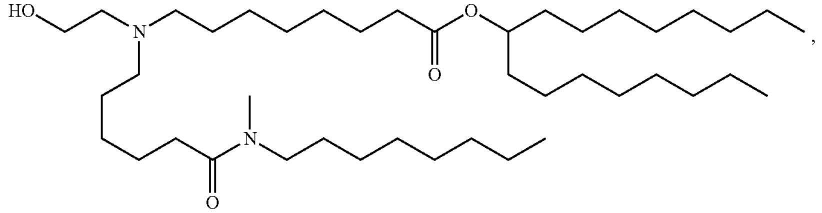

(Compound 147)

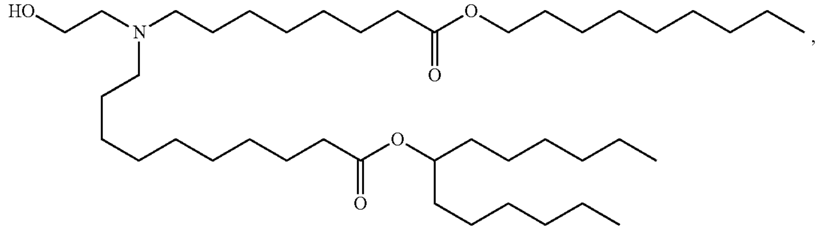

and salts or stereoisomers thereof.

The central amine moiety of a lipid according to formula (I) is typically protonated (i.e., positively charged) at a pH below the pKa of the amino moiety and is substantially not charged at a pH above the pKa. Such lipids may be referred to ionizable amino lipids.

In one specific embodiment, the compound of formula (I) is Compound 18.

In some embodiments, the amount the compound of formula (I) ranges from about 1 mol % to 99 mol % in the lipid composition.

In one embodiment, the amount of compound of formula (I) is at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 mol % in the lipid composition.

In one embodiment, the amount of the compound of formula (I) ranges from about 30 mol % to about 70 mol %, from about 35 mol % to about 65 mol %, from about 40 mol % to about 60 mol %, and from about 45 mol % to about 55 mol % in the lipid composition.

In one specific embodiment, the amount of the compound of formula (I) is about 50 mol % in the lipid composition.

In addition to the compound of formula I, the lipid composition of the pharmaceutical compositions disclosed herein can comprise additional components such as phospholipids, structural lipids, quaternary amine compounds, PEG-lipids, and any combination thereof.

Additional Components in the Lipid Composition

A. Phospholipids

The lipid composition of the pharmaceutical composition disclosed herein can comprise one or more phospholipids, for example, one or more saturated or (poly)unsaturated phospholipids or a combination thereof. In general, phospholipids comprise a phospholipid moiety and one or more fatty acid moieties. For example, a phospholipid can be a lipid according to formula (III):

(III)

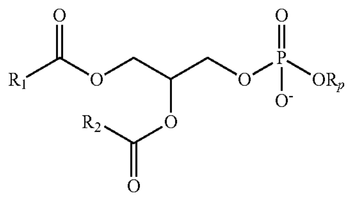

in which $R_p$ represents a phospholipid moiety and $R_1$ and $R_2$ represent fatty acid moieties with or without unsaturation that may be the same or different.

A phospholipid moiety may be selected, for example, from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin.

A fatty acid moiety may be selected, for example, from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid.

Particular phospholipids may facilitate fusion to a membrane. For example, a cationic phospholipid may interact with one or more negatively charged phospholipids of a membrane (e.g., a cellular or intracellular membrane). Fusion of a phospholipid to a membrane may allow one or more elements (e.g., a therapeutic agent) of a lipid-containing composition (e.g., LNPs) to pass through the membrane permitting, e.g., delivery of the one or more elements to a target tissue (e.g., tumoral tissue).

Non-natural phospholipid species including natural species with modifications and substitutions including branching, oxidation, cyclization, and alkynes are also contemplated. For example, a phospholipid may be functionalized with or cross-linked to one or more alkynes (e.g., an alkenyl group in which one or more double bonds is replaced with a triple bond). Under appropriate reaction conditions, an alkyne group may undergo a copper-catalyzed cycloaddition upon exposure to an azide. Such reactions may be useful in functionalizing a lipid bilayer of a nanoparticle composition to facilitate membrane permeation or cellular recognition or in conjugating a nanoparticle composition to a useful component such as a targeting or imaging moiety (e.g., a dye).

Phospholipids include, but are not limited to, glycerophospholipids such as phosphatidylcholines, phosphatidylethanolamines, phosphatidylserines, phosphatidylinositols, phosphatidyl glycerols, and phosphatidic acids. Phospholipids also include phosphosphingolipid, such as sphingomyelin. In some embodiments, a pharmaceutical composition for intratumoral delivery disclosed herein can comprise more than one phospholipid. When more than one phospholipid is used, such phospholipids can belong to the same phospholipid class (e.g., MSPC and DSPC) or different classes (e.g., MSPC and MSPE).

Phospholipids may be of a symmetric or an asymmetric type. As used herein, the term "symmetric phospholipid" includes glycerophospholipids having matching fatty acid moieties and sphingolipids in which the variable fatty acid moiety and the hydrocarbon chain of the sphingosine backbone include a comparable number of carbon atoms. As used herein, the term "asymmetric phospholipid" includes lysolipids, glycerophospholipids having different fatty acid moieties (e.g., fatty acid moieties with different numbers of carbon atoms and/or unsaturations (e.g., double bonds)), and sphingolipids in which the variable fatty acid moiety and the hydrocarbon chain of the sphingosine backbone include a dissimilar number of carbon atoms (e.g., the variable fatty acid moiety include at least two more carbon atoms than the hydrocarbon chain or at least two fewer carbon atoms than the hydrocarbon chain).

In some embodiments, the lipid composition of a pharmaceutical composition disclosed herein comprises at least one symmetric phospholipid. Symmetric phospholipids may be selected from the non-limiting group consisting of 1,2-dipropionyl-sn-glycero-3-phosphocholine (03:0 PC),
1,2-dibutyryl-sn-glycero-3-phosphocholine (04:0 PC),
1,2-dipentanoyl-sn-glycero-3-phosphocholine (05:0 PC),
1,2-dihexanoyl-sn-glycero-3-phosphocholine (06:0 PC),
1,2-diheptanoyl-sn-glycero-3-phosphocholine (07:0 PC),
1,2-dioctanoyl-sn-glycero-3-phosphocholine (08:0 PC),
1,2-dinonanoyl-sn-glycero-3-phosphocholine (09:0 PC),
1,2-didecanoyl-sn-glycero-3-phosphocholine (10:0 PC),
1,2-diundecanoyl-sn-glycero-3-phosphocholine (11:0 PC, DUPC),
1,2-dilauroyl-sn-glycero-3-phosphocholine (12:0 PC),
1,2-ditridecanoyl-sn-glycero-3-phosphocholine (13:0 PC),
1,2-dimyristoyl-sn-glycero-3-phosphocholine (14:0 PC, DMPC),
1,2-dipentadecanoyl-sn-glycero-3-phosphocholine (15:0 PC),
1,2-dipalmitoyl-sn-glycero-3-phosphocholine (16:0 PC, DPPC),
1,2-diphytanoyl-sn-glycero-3-phosphocholine (4ME 16:0 PC),
1,2-diheptadecanoyl-sn-glycero-3-phosphocholine (17:0 PC),
1,2-distearoyl-sn-glycero-3-phosphocholine (18:0 PC, DSPC), 1,2-dinonadecanoyl-sn-glycero-3-phosphocholine (19:0 PC),
1,2-diarachidoyl-sn-glycero-3-phosphocholine (20:0 PC),
1,2-dihenarachidoyl-sn-glycero-3-phosphocholine (21:0 PC),
1,2-dibehenoyl-sn-glycero-3-phosphocholine (22:0 PC),
1,2-ditricosanoyl-sn-glycero-3-phosphocholine (23:0 PC),
1,2-dilignoceroyl-sn-glycero-3-phosphocholine (24:0 PC),
1,2-dimyristoleoyl-sn-glycero-3-phosphocholine (14:1 (Δ9-Cis) PC),
1,2-dimyristelaidoyl-sn-glycero-3-phosphocholine (14:1 (Δ9-Trans) PC),
1,2-dipalmitoleoyl-sn-glycero-3-phosphocholine (16:1 (Δ9-Cis) PC),
1,2-dipalmitelaidoyl-sn-glycero-3-phosphocholine (16:1 (Δ9-Trans) PC),
1,2-dipetroselenoyl-sn-glycero-3-phosphocholine (18:1 (Δ6-Cis) PC),
1,2-dioleoyl-sn-glycero-3-phosphocholine (18:1 (Δ9-Cis) PC, DOPC),
1,2-dielaidoyl-sn-glycero-3-phosphocholine (18:1 (Δ9-Trans) PC),
1,2-dilinoleoyl-sn-glycero-3-phosphocholine (18:2 (Cis) PC, DLPC),
1,2-dilinolenoyl-sn-glycero-3-phosphocholine (18:3 (Cis) PC, DLnPC),
1,2-dieicosenoyl-sn-glycero-3-phosphocholine (20:1 (Cis) PC),
1,2-diarachidonoyl-sn-glycero-3-phosphocholine (20:4 (Cis) PC, DAPC),
1,2-dierucoyl-sn-glycero-3-phosphocholine (22:1 (Cis) PC),
1,2-didocosahexaenoyl-sn-glycero-3-phosphocholine (22:6 (Cis) PC, DHAPC),
1,2-dinervonoyl-sn-glycero-3-phosphocholine (24:1 (Cis) PC),
1,2-dihexanoyl-sn-glycero-3-phosphoethanolamine (06:0 PE),
1,2-dioctanoyl-sn-glycero-3-phosphoethanolamine (08:0 PE),
1,2-didecanoyl-sn-glycero-3-phosphoethanolamine (10:0 PE),
1,2-dilauroyl-sn-glycero-3-phosphoethanolamine (12:0 PE),
1,2-dimyristoyl-sn-glycero-3-phosphoethanolamine (14:0 PE),
1,2-dipentadecanoyl-sn-glycero-3-phosphoethanolamine (15:0 PE),
1,2-dipalmitoyl-sn-glycero-3-phosphoethanolamine (16:0 PE),
1,2-diphytanoyl-sn-glycero-3-phosphoethanol amine (4ME 16:0 PE),
1,2-diheptadecanoyl-sn-glycero-3-phosphoethanolamine (17:0 PE),
1,2-distearoyl-sn-glycero-3-phosphoethanolamine (18:0 PE, DSPE),
1,2-dipalmitoleoyl-sn-glycero-3-phosphoethanolamine (16:1 PE),
1,2-dioleoyl-sn-glycero-3-phosphoethanolamine (18:1 (Δ9-Cis) PE, DOPE),
1,2-dielaidoyl-sn-glycero-3-phosphoethanolamine (18:1 (Δ9-Trans) PE),
1,2-dilinoleoyl-sn-glycero-3-phosphoethanolamine (18:2 PE, DLPE),
1,2-dilinolenoyl-sn-glycero-3-phosphoethanolamine (18:3 PE, DLnPE),
1,2-diarachidonoyl-sn-glycero-3-phosphoethanolamine (20:4 PE, DAPE),
1,2-didocosahexaenoyl-sn-glycero-3-phosphoethanolamine (22:6 PE, DHAPE),
1,2-di-O-octadecenyl-sn-glycero-3-phosphocholine (18:0 Diether PC),
1,2-dioleoyl-sn-glycero-3-phospho-rac-(1-glycerol) sodium salt (DOPG), and
any combination thereof.

In some embodiments, the lipid composition of a pharmaceutical composition disclosed herein comprises at least one symmetric phospholipid selected from the non-limiting group consisting of DLPC, DMPC, DOPC, DPPC, DSPC, DUPC, 18:0 Diether PC, DLnPC, DAPC, DHAPC, DOPE, 4ME 16:0 PE, DSPE, DLPE, DLnPE, DAPE, DHAPE, DOPG, and any combination thereof.

In some embodiments, the lipid composition of a pharmaceutical composition disclosed herein comprises at least one asymmetric phospholipid. Asymmetric phospholipids may be selected from the non-limiting group consisting of
1-myristoyl-2-palmitoyl-sn-glycero-3-phosphocholine (14:0-16:0 PC, MPPC),
1-myristoyl-2-stearoyl-sn-glycero-3-phosphocholine (14:0-18:0 PC, MSPC),
1-palmitoyl-2-acetyl-sn-glycero-3-phosphocholine (16:0-02:0 PC),
1-palmitoyl-2-myristoyl-sn-glycero-3-phosphocholine (16:0-14:0 PC, PMPC),
1-palmitoyl-2-stearoyl-sn-glycero-3-phosphocholine (16:0-18:0 PC, PSPC),
1-palmitoyl-2-oleoyl-sn-glycero-3-phosphocholine (16:0-18:1 PC, POPC),
1-palmitoyl-2-linoleoyl-sn-glycero-3-phosphocholine (16:0-18:2 PC, PLPC),
1-palmitoyl-2-arachidonoyl-sn-glycero-3-phosphocholine (16:0-20:4 PC),
1-palmitoyl-2-docosahexaenoyl-sn-glycero-3-phosphocholine (14:0-22:6 PC),
1-stearoyl-2-myristoyl-sn-glycero-3-phosphocholine (18:0-14:0 PC, SMPC),
1-stearoyl-2-palmitoyl-sn-glycero-3-phosphocholine (18:0-16:0 PC, SPPC),
1-stearoyl-2-oleoyl-sn-glycero-3-phosphocholine (18:0-18:1 PC, SOPC),
1-stearoyl-2-linoleoyl-sn-glycero-3-phosphocholine (18:0-18:2 PC),
1-stearoyl-2-arachidonoyl-sn-glycero-3-phosphocholine (18:0-20:4 PC),
1-stearoyl-2-docosahexaenoyl-sn-glycero-3-phosphocholine (18:0-22:6 PC),
1-oleoyl-2-myristoyl-sn-glycero-3-phosphocholine (18:1-14:0 PC, OMPC),
1-oleoyl-2-palmitoyl-sn-glycero-3-phosphocholine (18:1-16:0 PC, OPPC),
1-oleoyl-2-stearoyl-sn-glycero-3-phosphocholine (18:1-18:0 PC, OSPC),
1-palmitoyl-2-oleoyl-sn-glycero-3-phosphoethanolamine (16:0-18:1 PE, POPE),
1-palmitoyl-2-linoleoyl-sn-glycero-3-phosphoethanolamine (16:0-18:2 PE),
1-palmitoyl-2-arachidonoyl-sn-glycero-3-phosphoethanolamine (16:0-20:4 PE),
1-palmitoyl-2-docosahexaenoyl-sn-glycero-3-phosphoethanolamine (16:0-22:6 PE),
1-stearoyl-2-oleoyl-sn-glycero-3-phosphoethanolamine (18:0-18:1 PE),
1-stearoyl-2-linoleoyl-sn-glycero-3-phosphoethanolamine (18:0-18:2 PE), 1-stearoyl-2-arachidonoyl-sn-glycero-3-phosphoethanolamine (18:0-20:4 PE), 1-stearoyl-2-docosahexaenoyl-sn-glycero-3-phosphoethanolamine (18:0-22:6 PE), 1-oleoyl-2-cholesterylhemisuccinoyl-sn-glycero-3-phosphocholine (OChemsPC), and any combination thereof.

Asymmetric lipids useful in the lipid composition may also be lysolipids. Lysolipids may be selected from the non-limiting group consisting of 1-hexanoyl-2-hydroxy-sn-glycero-3-phosphocholine (06:0 Lyso PC), 1-heptanoyl-2-hydroxy-sn-glycero-3-phosphocholine (07:0 Lyso PC), 1-octanoyl-2-hydroxy-sn-glycero-3-phosphocholine (08:0 Lyso PC), 1-nonanoyl-2-hydroxy-sn-glycero-3-phosphocholine (09:0 Lyso PC), 1-decanoyl-2-hydroxy-sn-glycero-3-phosphocholine (10:0 Lyso PC), 1-undecanoyl-2-hydroxy-sn-glycero-3-phosphocholine (11:0 Lyso PC), 1-lauroyl-2-hydroxy-sn-glycero-3-phosphocholine (12:0 Lyso PC), 1-tridecanoyl-2-hydroxy-sn-glycero-3-phosphocholine (13:0 Lyso PC), 1-myristoyl-2-hydroxy-sn-glycero-3-phosphocholine (14:0 Lyso PC), 1-pentadecanoyl-2-hydroxy-sn-glycero-3-phosphocholine (15:0 Lyso PC), 1-palmitoyl-2-hydroxy-sn-glycero-3-phosphocholine (16:0 Lyso PC), 1-heptadecanoyl-2-hydroxy-sn-glycero-3-phosphocholine (17:0 Lyso PC), 1-stearoyl-2-hydroxy-sn-glycero-3-phosphocholine (18:0 Lyso PC), 1-oleoyl-2-hydroxy-sn-glycero-3-phosphocholine (18:1 Lyso PC), 1-nonadecanoyl-2-hydroxy-sn-glycero-3-phosphocholine (19:0 Lyso PC), 1-arachidoyl-2-hydroxy-sn-glycero-3-phosphocholine (20:0 Lyso PC), 1-behenoyl-2-hydroxy-sn-glycero-3-phosphocholine (22:0 Lyso PC), 1-lignoceroyl-2-hydroxy-sn-glycero-3-phosphocholine (24:0 Lyso PC), 1-hexacosanoyl-2-hydroxy-sn-glycero-3-phosphocholine (26:0 Lyso PC), 1-myristoyl-2-hydroxy-sn-glycero-3-phosphoethanolamine (14:0 Lyso PE), 1-palmitoyl-2-hydroxy-sn-glycero-3-phosphoethanolamine (16:0 Lyso PE), 1-stearoyl-2-hydroxy-sn-glycero-3-phosphoethanolamine (18:0 Lyso PE), 1-oleoyl-2-hydroxy-sn-glycero-3-phosphoethanolamine (18:1 Lyso PE), 1-hexadecyl-sn-glycero-3-phosphocholine (C16 Lyso PC), and any combination thereof.

In some embodiment, the lipid composition of a pharmaceutical composition disclosed herein comprises at least one asymmetric phospholipid selected from the group consisting of MPPC, MSPC, PMPC, PSPC, SMPC, SPPC, and any combination thereof. In some embodiments, the asymmetric phospholipid is 1-myristoyl-2-stearoyl-sn-glycero-3-phosphocholine (MSPC).

In some embodiments, the lipid compositions disclosed herein may contain one or more symmetric phospholipids, one or more asymmetric phospholipids, or a combination thereof. When multiple phospholipids are present, they can be present in equimolar ratios, or non-equimolar ratios.

In one embodiment, the lipid composition of a pharmaceutical composition disclosed herein comprises a total amount of phospholipid (e.g., MSPC) which ranges from about 1 mol % to about 20 mol %, from about 5 mol % to about 20 mol %, from about 10 mol % to about 20 mol %, from about 15 mol % to about 20 mol %, from about 1 mol % to about 15 mol %, from about 5 mol % to about 15 mol %, from about 10 mol % to about 15 mol %, from about 5 mol % to about 10 mol % in the lipid composition. In one embodiment, the amount of the phospholipid is from about 8 mol % to about 15 mol % in the lipid composition. In one embodiment, the amount of the phospholipid (e.g., MSPC) is about 10 mol % in the lipid composition.

In some aspects, the amount of a specific phospholipid (e.g., MSPC) is at least about 1, 2, 3, 4, 5, 6, 7, 8, 9, 10, 11, 12, 13, 14, 15, 16, 17, 18, 19 or 20 mol % in the lipid composition.

B. Quaternary Amine Compounds

The lipid composition of a pharmaceutical composition disclosed herein can comprise one or more quaternary amine compounds (e.g., DOTAP). The term "quaternary amine compound" is used to include those compounds having one or more quaternary amine groups (e.g., trialkylamino groups) and permanently carrying a positive charge and existing in a form of a salt. For example, the one or more quaternary amine groups can be present in a lipid or a polymer (e.g., PEG). In some embodiments, the quaternary amine compound comprises (1) a quaternary amine group and (2) at least one hydrophobic tail group comprising (i) a hydrocarbon chain, linear or branched, and saturated or unsaturated, and (ii) optionally an ether, ester, carbonyl, or ketal linkage between the quaternary amine group and the hydrocarbon chain. In some embodiments, the quaternary amine group can be a trimethylammonium group. In some embodiments, the quaternary amine compound comprises two identical hydrocarbon chains. In some embodiments, the quaternary amine compound comprises two different hydrocarbon chains.

In some embodiments, the lipid composition of a pharmaceutical composition disclosed herein comprises at least one quaternary amine compound. Quaternary amine compound may be selected from the non-limiting group consisting of 1,2-dioleoyl-3-trimethylammonium-propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), N,N-distearyl-N,N-dimethylammonium bromide (DDAB), N-(1,2-dimyristyloxyprop-3-yl)-N,N-dimethyl-N-hydroxyethyl ammonium bromide (DMRIE), N-(1,2-dioleoyloxyprop-3-yl)-N,N-dimethyl-N-hydroxyethyl ammonium bromide (DORIE), N,N-dioleyl-N,N-dimethyl ammonium chloride (DODAC), 1,2-dilauroyl-sn-glycero-3-ethylphosphocholine (DLePC), 1,2-distearoyl-3-trimethylammonium-propane (DSTAP), 1,2-dipalmitoyl-3-trimethylammonium-propane (DPTAP), 1,2-dilinoleoyl-3-trimethylammonium-propane (DLTAP), 1,2-dimyristoyl-3-trimethylammonium-propane (DMTAP)
1,2-distearoyl-sn-glycero-3-ethylphosphocholine (DSePC)
1,2-dipalmitoyl-sn-glycero-3-ethylphosphocholine (DPePC),
1,2-dimyristoyl-sn-glycero-3-ethylphosphocholine (DMePC),
1,2-dioleoyl-sn-glycero-3-ethylphosphocholine (DOePC),
1,2-di-(9Z-tetradecenoyl)-sn-glycero-3-ethylphosphocholine (14:1 EPC),
1-palmitoyl-2-oleoyl-sn-glycero-3-ethylphosphocholine (16:0-18:1 EPC),
and any combination thereof.

In one embodiment, the quaternary amine compound is 1,2-dioleoyl-3-trimethylammonium-propane (DOTAP).

Quaternary amine compounds are known in the art, such as those described in U.S. Patent Appl. Publ. Nos. US2013/0245107 and US2014/0363493, U.S. Pat. No. 8,158,601, and Int'l. Publ. Nos. WO2015/123264 and WO2015/148247, which are incorporated herein by reference in their entireties.

In one embodiment, the amount of the quaternary amine compound (e.g., DOTAP) in the lipid composition disclosed herein ranges from about 0.01 mol % to about 20 mol %.

In one embodiment, the amount of the quaternary amine compound (e.g., DOTAP) in the lipid composition disclosed herein ranges from about 0.5 mol % to about 20 mol %, from about 0.5 mol % to about 15 mol %, from about 0.5 mol % to about 10 mol %, from about 1 mol % to about 20 mol %, from about 1 mol % to about 15 mol %, from about 1 mol % to about 10 mol %, from about 2 mol % to about 20 mol %, from about 2 mol % to about 15 mol %, from about 2 mol % to about 10 mol %, from about 3 mol % to about 20 mol %, from about 3 mol % to about 15 mol %, from about 3 mol % to about 10 mol %, from about 4 mol % to about 20 mol %, from about 4 mol % to about 15 mol %, from about 4 mol % to about 10 mol %, from about 5 mol % to about 20 mol %, from about 5 mol % to about 15 mol %, from about 5 mol % to about 10 mol %, from about 6 mol % to about 20 mol %, from about 6 mol % to about 15 mol %, from about 6 mol % to about 10 mol %, from about 7 mol % to about 20 mol %, from about 7 mol % to about 15 mol %, from about 7 mol % to about 10 mol %, from about 8 mol % to about 20 mol %, from about 8 mol % to about 15 mol %, from about 8 mol % to about 10 mol %, from about 9 mol % to about 20 mol %, from about 9 mol % to about 15 mol %, from about 9 mol % to about 10 mol %.

In one embodiment, the amount of the quaternary amine compound (e.g., DOTAP) in the lipid composition disclosed herein ranges from about 5 mol % to about 10 mol %.

In one embodiment, the amount of the quaternary amine compound (e.g., DOTAP) in the lipid composition disclosed herein is about 5 mol %. In one embodiment, the amount of the quaternary amine compound (e.g., DOTAP) in the lipid composition disclosed herein is about 10 mol %.

In some embodiments, the amount of the quaternary amine compound (e.g., DOTAP) is at least about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5 or 20 mol % in the lipid composition disclosed herein.

In one embodiment, the mole ratio of the compound of formula (I) (e.g., Compounds 18, 25, 26 or 48) to the quaternary amine compound (e.g., DOTA) is about 100:1 to about 2.5:1. In one embodiment, the mole ratio of the compound of formula (I) (e.g., Compounds 18, 25, 26 or 48) to the quaternary amine compound (e.g., DOTAP) is about 90:1, about 80:1, about 70:1, about 60:1, about 50:1, about 40:1, about 30:1, about 20:1, about 15:1, about 10:1, about 9:1, about 8:1, about 7:1, about 6:1, about 5:1, or about 2.5:1. In one embodiment, the mole ratio of the compound of formula (I) (e.g., Compounds 18, 25, 26 or 48) to the quaternary amine compound (e.g., DOTAP) in the lipid composition disclosed herein is about 10:1.

In some aspects, the lipid composition the pharmaceutical compositions disclosed herein does not comprise a quaternary amine compound. In some aspects, the lipid composition of the pharmaceutical compositions disclosed does not comprise DOTAP.

C. Structural Lipids

The lipid composition of a pharmaceutical composition disclosed herein can comprise one or more structural lipids. As used herein, the term "structural lipid" refers to sterols and also to lipids containing sterol moieties. In some embodiments, the structural lipid is selected from the group consisting of cholesterol, fecosterol, sitosterol, ergosterol, campesterol, stigmasterol, brassicasterol, tomatidine, tomatine, ursolic acid, alpha-tocopherol, and mixtures thereof. In some embodiments, the structural lipid is cholesterol.

In one embodiment, the amount of the structural lipid (e.g., an sterol such as cholesterol) in the lipid composition of a pharmaceutical composition disclosed herein ranges from about 20 mol % to about 60 mol %, from about 25 mol % to about 55 mol %, from about 30 mol % to about 50 mol %, or from about 35 mol % to about 45 mol %.

In one embodiment, the amount of the structural lipid (e.g., an sterol such as cholesterol) in the lipid composition disclosed herein ranges from about 25 mol % to about 30 mol %, from about 30 mol % to about 35 mol %, or from about 35 mol % to about 40 mol %.

In one embodiment, the amount of the structural lipid (e.g., a sterol such as cholesterol) in the lipid composition disclosed herein is about 23.5 mol %, about 28.5 mol %, about 33.5 mol %, or about 38.5 mol %.

In some embodiments, the amount of the structural lipid (e.g., an sterol such as cholesterol) in the lipid composition disclosed herein is at least about 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 mol %.

In some aspects, the lipid composition component of the pharmaceutical compositions for intratumoral delivery disclosed does not comprise cholesterol.

D. Polyethylene Glycol (PEG)-Lipids

The lipid composition of a pharmaceutical composition disclosed herein can comprise one or more a polyethylene glycol (PEG) lipid.

As used herein, the term "PEG-lipid" refers to polyethylene glycol (PEG)-modified lipids. Non-limiting examples of PEG-lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid may be PEG-c-DOMG, PEG-DMG, PEG-DLPE, PEG-DMPE, PEG-DPPC, or a PEG-DSPE lipid.

In some embodiments, the PEG-lipid includes, but not limited to 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA).

In one embodiment, the PEG-lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the lipid moiety of the PEG-lipids includes those having lengths of from about $C_{14}$ to about $C_{22}$, preferably from about $C_{14}$ to about $C_{16}$. In some embodiments, a PEG moiety, for example an mPEG-$NH_2$, has a size of about 1000, 2000, 5000, 10,000, 15,000 or 20,000 daltons. In one embodiment, the PEG-lipid is PEG2k-DMG.

In one embodiment, the lipid nanoparticles described herein may comprise a PEG lipid which is a non-diffusible PEG. Non-limiting examples of non-diffusible PEGs include PEG-DSG and PEG-DSPE.

PEG-lipids are known in the art, such as those described in U.S. Pat. No. 8,158,601 and International Publ. No. WO2015/130584, which are incorporated herein by reference in their entirety.

In one embodiment, the amount of PEG-lipid in the lipid composition of a pharmaceutical composition disclosed herein ranges from about 0.1 mol % to about 5 mol %, from about 0.5 mol % to about 5 mol %, from about 1 mol % to about 5 mol %, from about 1.5 mol % to about 5 mol %, from about 2 mol % to about 5 mol % mol %, from about 0.1 mol % to about 4 mol %, from about 0.5 mol % to about 4 mol %, from about 1 mol % to about 4 mol %, from about 1.5 mol % to about 4 mol %, from about 2 mol % to about 4 mol %, from about 0.1 mol % to about 3 mol %, from about 0.5 mol % to about 3 mol %, from about 1 mol % to about 3 mol %, from about 1.5 mol % to about 3 mol %, from about 2 mol % to about 3 mol %, from about 0.1 mol % to about 2 mol %, from about 0.5 mol % to about 2 mol %, from about 1 mol % to about 2 mol %, from about 1.5 mol % to about 2 mol %, from about 0.1 mol % to about 1.5 mol %, from about 0.5 mol % to about 1.5 mol %, or from about 1 mol % to about 1.5 mol %.

In one embodiment, the amount of PEG-lipid in the lipid composition disclosed herein is about 1.5 mol %.

In one embodiment, the amount of PEG-lipid in the lipid composition disclosed herein is at least about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, or 5 mol %.

In some aspects, the lipid composition of the pharmaceutical compositions disclosed herein does not comprise a PEG-lipid.

In some embodiments, the lipid composition disclosed herein comprises a compound of formula (I) and an asymmetric phospholipid. In some embodiments, the lipid composition comprises compound 18 and MSPC.

In some embodiments, the lipid composition disclosed herein comprises a compound of formula (I) and a quaternary amine compound. In some embodiments, the lipid composition comprises compound 18 and DOTAP.

In some embodiments, the lipid composition disclosed herein comprises a compound of formula (I), an asymmetric phospholipid, and a quaternary amine compound. In some embodiments, the lipid composition comprises compound 18, MSPC and DOTAP.

In one embodiment, the lipid composition comprises about 50 mol % of a compound of formula (I) (e.g. Compounds 18, 25, 26 or 48), about 10 mol % of DSPC or MSPC, about 33.5 mol % of cholesterol, about 1.5 mol % of PEG-DMG, and about 5 mol % of DOTAP. In one embodiment, the lipid composition comprises about 50 mol % of a compound of formula (I) (e.g. Compounds 18, 25, 26 or 48), about 10 mol % of DSPC or MSPC, about 28.5 mol % of cholesterol, about 1.5 mol % of PEG-DMG, and about 10 mol % of DOTAP.

The components of the lipid nanoparticle may be tailored for optimal delivery of the polynucleotides based on the desired outcome. As a non-limiting example, the lipid nanoparticle may comprise 40-60 mol % a compound of formula (I), 8-16 mol % phospholipid, 30-45 mol % cholesterol, 1-5 mol % PEG lipid, and optionally 1-15 mol % quaternary amine compound.

In some embodiments, the lipid nanoparticle may comprise 45-65 mol % of a compound of formula (I), 5-10 mol % phospholipid, 25-40 mol % cholesterol, 0.5-5 mol % PEG lipid, and optionally 1-15 mol % quaternary amine compound.

Non-limiting examples of nucleic acid lipid particles are disclosed in U.S. Patent Publication No. 20140121263, herein incorporated by reference in its entirety.

E. Other Ionizable Amino Lipids

The lipid composition of the pharmaceutical composition disclosed herein can comprise one or more ionizable amino lipids in addition to a lipid according to formula (I).

Ionizable lipids may be selected from the non-limiting group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethyl aminomethyl-[1,3]-dioxolane (DLin-K-DMA), heptatriaconta-6,9,28,31-tetraen-19-yl 4-(dimethylamino) butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), (13Z,165Z)—N,N-dimethyl-3-nonydocosa-13-16-dien-1-amine (L608), 2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA), (2R)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9, 12-dien-1-yloxy]propan-1-amine (Octyl-CLinDMA (2S)). In addition to these, an ionizable amino lipid may also be a lipid including a cyclic amine group.

Ionizable lipids can also be the compounds disclosed in International Publication No. WO2015/199952 (see also US20150376115), hereby incorporated by reference in their entirety. For example, the ionizable amino lipids include, but not limited to:

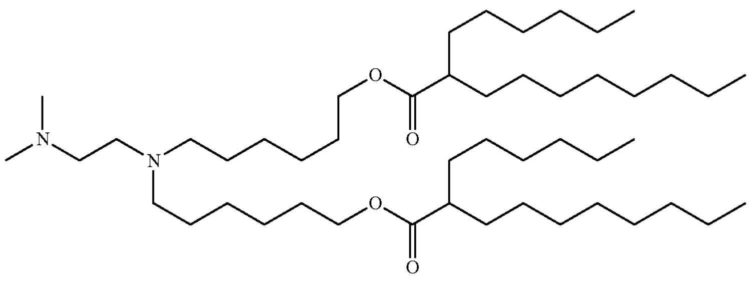
;
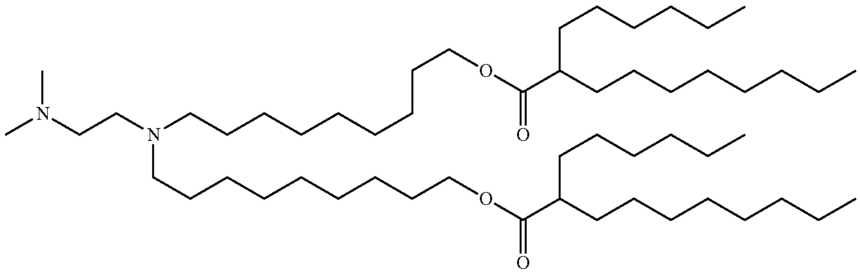
;
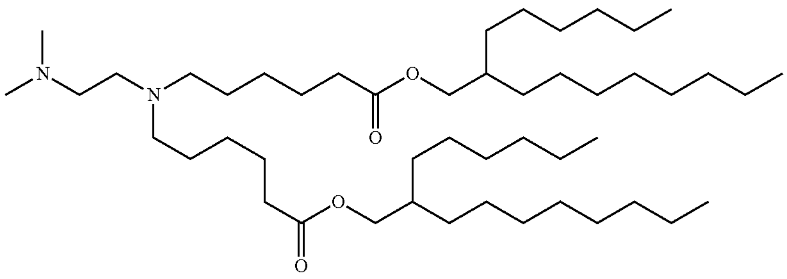
;
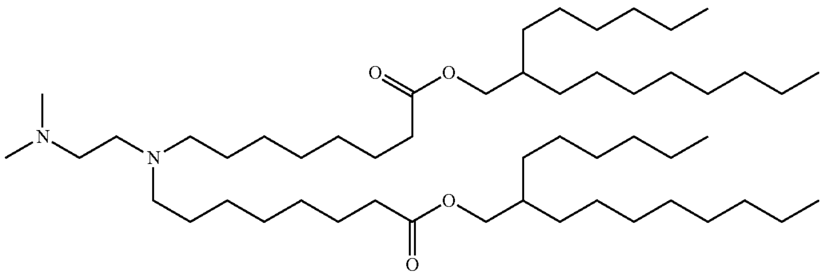
;
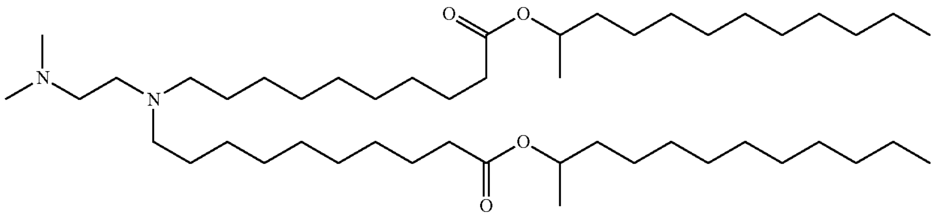
;
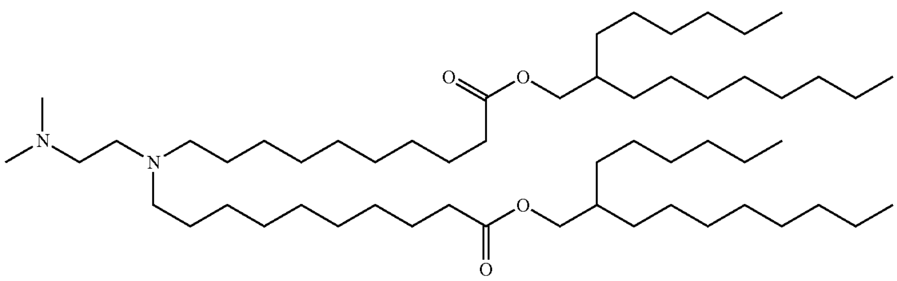
;

-continued

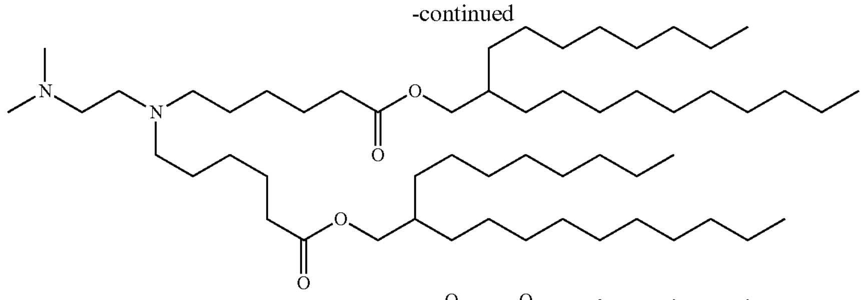

;

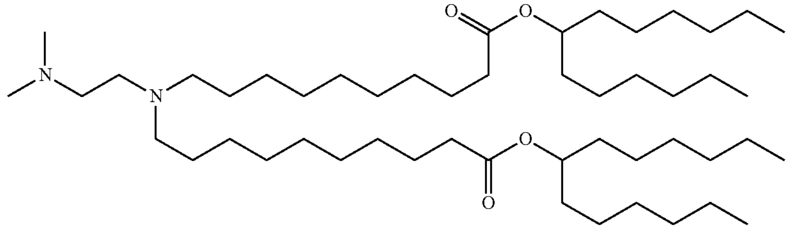

;

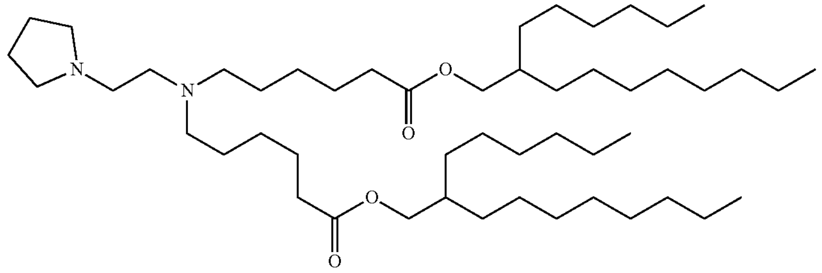

;

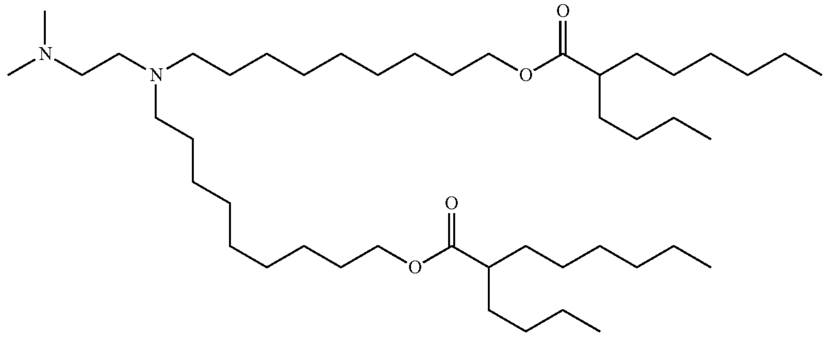

;

and any combination thereof.

F. Other Lipid Composition Components

The lipid composition of a pharmaceutical composition disclosed herein may include one or more components in addition to those described above. For example, the lipid composition may include one or more permeability enhancer molecules, carbohydrates, polymers, surface altering agents (e.g., surfactants), or other components. For example, a permeability enhancer molecule may be a molecule described by U.S. Patent Application Publication No. 2005/0222064. Carbohydrates may include simple sugars (e.g., glucose) and polysaccharides (e.g., glycogen and derivatives and analogs thereof). The lipid composition may include a buffer such as, but not limited to, citrate or phosphate at a pH of 7, salt and/or sugar. Salt and/or sugar may be included in the formulations described herein for isotonicity.

A polymer may be included in and/or used to encapsulate or partially encapsulate a pharmaceutical composition disclosed herein (e.g., a pharmaceutical composition in lipid nanoparticle form). A polymer may be biodegradable and/or biocompatible. A polymer may be selected from, but is not limited to, polyamines, polyethers, polyamides, polyesters, polycarbamates, polyureas, polycarbonates, polystyrenes, polyimides, polysulfones, polyurethanes, polyacetylenes, polyethylenes, polyethyleneimines, polyisocyanates, polyacrylates, polymethacrylates, polyacrylonitriles, and polyarylates.

The ratio between the lipid composition and the polynucleotide range from about 10:1 to about 60:1 (wt/wt).

In some embodiments, the ratio between the lipid composition and the polynucleotide can be about 10:1, 11:1, 12:1, 13:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, 50:1, 51:1, 52:1, 53:1, 54:1, 55:1, 56:1, 57:1, 58:1, 59:1 or 60:1 (wt/wt). In some embodiments, the wt/wt ratio of the lipid composition to the polynucleotide comprising an mRNA encoding an IL23 polypeptide, the polynucleotide comprising an mRNA encoding an IL36-gamma polypeptide, or the polynucleotide comprising an mRNA encoding an OX40L polypeptide, is about 20:1 or about 15:1.

In some embodiments, the pharmaceutical composition disclosed herein can contain more than one polypeptides, e.g., two, three or more polypeptides. For example, a pharmaceutical composition disclosed herein can contain two, three, or more polynucleotides (e.g., mRNA).

In one embodiment, the lipid nanoparticles described herein may comprise polynucleotides (e.g., mRNA) in a lipid:polynucleotide weight ratio of 5:1, 10:1, 15:1, 20:1, 25:1, 30:1, 35:1, 40:1, 45:1, 50:1, 55:1, 60:1 or 70:1, or a range or any of these ratios such as, but not limited to, 5:1 to about 10:1, from about 5:1 to about 15:1, from about 5:1 to about 20:1, from about 5:1 to about 25:1, from about 5:1 to about 30:1, from about 5:1 to about 35:1, from about 5:1 to about 40:1, from about 5:1 to about 45:1, from about 5:1 to about 50:1, from about 5:1 to about 55:1, from about 5:1 to about 60:1, from about 5:1 to about 70:1, from about 10:1 to about 15:1, from about 10:1 to about 20:1, from about 10:1 to about 25:1, from about 10:1 to about 30:1, from about 10:1 to about 35:1, from about 10:1 to about 40:1, from about 10:1 to about 45:1, from about 10:1 to about 50:1, from about 10:1 to about 55:1, from about 10:1 to about 60:1, from about 10:1 to about 70:1, from about 15:1 to about 20:1, from about 15:1 to about 25:1,from about 15:1 to about 30:1, from about 15:1 to about 35:1, from about 15:1 to about 40:1, from about 15:1 to about 45:1, from about 15:1 to about 50:1, from about 15:1 to about 55:1, from about 15:1 to about 60:1 or from about 15:1 to about 70:1.

In one embodiment, the lipid nanoparticles described herein may comprise the polynucleotide in a concentration from approximately 0.1 mg/ml to 2 mg/ml such as, but not limited to, 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.1 mg/ml, 1.2 mg/ml, 1.3 mg/ml, 1.4 mg/ml, 1.5 mg/ml, 1.6 mg/ml, 1.7 mg/ml, 1.8 mg/ml, 1.9 mg/ml, 2.0 mg/ml or greater than 2.0 mg/ml.

In one embodiment, formulations comprising the polynucleotides and lipid nanoparticles described herein may comprise 0.15 mg/ml to 2 mg/ml of the polynucleotide described herein (e.g., mRNA). In some embodiments, the formulation may further comprise 10 mM of citrate buffer and the formulation may additionally comprise up to 10% w/w of sucrose (e.g., at least 1% w/w, at least 2% w/w/, at least 3% w/w, at least 4% w/w, at least 5% w/w, at least 6% w/w, at least 7% w/w, at least 8% w/w, at least 9% w/w or 10% w/w).

Nanoparticle Compositions

In some embodiments, the pharmaceutical compositions disclosed herein are formulated as lipid nanoparticles (LNP). Accordingly, the present disclosure also provides nanoparticle compositions comprising (i) a lipid composition comprising a compound of formula (I) as described herein; and, (ii) at least two polynucleotides in combination (combination therapy), wherein the at least two polynucleotides are selected from the group consisting of (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof In the nanoparticle compositions disclosed herein, the lipid composition herein can encapsulate (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof.

In one particular embodiment, the different components of the combination therapy (i.e., at least two polynucleotides, wherein the at least two polynucleotides are selected from the group consisting of (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof) are encapsulated separately (i.e., each type of mRNA encapsulated in a population of nanoparticles). For example, in an embodiment, the polynucleotide comprising an mRNA encoding an immune response primer (e.g., an IL23 polypeptide), the polynucleotide comprising an mRNA encoding an immune response co-stimulatory signal (e.g., an OX40L polypeptide), and the polynucleotide comprising an mRNA encoding a checkpoint inhibitor (e.g., an anti-CTLA-4 antibody) are encapsulated separately (i.e., in three populations of nanoparticles).

In one particular embodiment, the different components of the combination therapy (i.e., at least two polynucleotides, wherein the at least two polynucleotides are selected from the group consisting of (i) a polynucleotide encoding an immune response primer; (ii) a polynucleotide encoding an immune response co-stimulatory signal; (iii) a polynucleotide encoding a checkpoint inhibitor or a polypeptide checkpoint inhibitor; and, (iv) a combination thereof) are encapsulated together (i.e., in a single population of nanoparticles). For example, in an embodiment, the polynucleotide comprising an mRNA encoding an immune response primer, the polynucleotide comprising an mRNA encoding an immune response co-stimulatory signal, and the polynucleotide comprising an mRNA encoding a checkpoint inhibitor are encapsulated together (i.e., in a single population of nanoparticles).

Nanoparticle compositions are typically sized on the order of micrometers or smaller and may include a lipid bilayer. Nanoparticle compositions encompass lipid nanoparticles (LNPs), liposomes (e.g., lipid vesicles), and lipoplexes. For example, a nanoparticle composition may be a liposome having a lipid bilayer with a diameter of 500 nm or less.

Nanoparticle compositions include, for example, lipid nanoparticles (LNPs), liposomes, and lipoplexes. In some embodiments, nanoparticle compositions are vesicles including one or more lipid bilayers. In certain embodiments, a nanoparticle composition includes two or more concentric bilayers separated by aqueous compartments. Lipid bilayers may be functionalized and/or crosslinked to one another. Lipid bilayers may include one or more ligands, proteins, or channels.

In some embodiments, a lipid nanoparticle (LNP) may comprise an ionizable lipid. As used herein, the term "ionizable lipid" has its ordinary meaning in the art and may refer to a lipid comprising one or more charged moieties. In some embodiments, an ionizable lipid may be positively charged or negatively charged. An ionizable lipid may be positively charged, in which case it can be referred to as "cationic lipid". For example, an ionizable molecule may comprise an amine group, referred to as ionizable amino lipids. As used herein, a "charged moiety" is a chemical moiety that carries a formal electronic charge, e.g., monovalent (+1, or −1), divalent (+2, or −2), trivalent (+3, or −3), etc. The charged moiety may be anionic (i.e., negatively charged) or cationic (i.e., positively charged). Examples of positively-charged moieties include amine groups (e.g., primary, secondary, and/or tertiary amines), ammonium groups, pyridinium group, guanidine groups, and imidizolium groups. In a particular embodiment, the charged moieties comprise amine groups. Examples of negatively-charged groups or precursors thereof, include carboxylate groups, sulfonate groups, sulfate groups, phosphonate groups, phosphate groups, hydroxyl groups, and the like. The charge of the charged moiety may vary, in some cases, with the environmental conditions, for example, changes in pH may alter the charge of the moiety, and/or cause the moiety to become charged or uncharged. In general, the charge density of the molecule may be selected as desired.

It should be understood that the terms "charged" or "charged moiety" does not refer to a "partial negative charge" or "partial positive charge" on a molecule. The terms "partial negative charge" and "partial positive charge" are given its ordinary meaning in the art. A "partial negative charge" may result when a functional group comprises a bond that becomes polarized such that electron density is pulled toward one atom of the bond, creating a partial negative charge on the atom. Those of ordinary skill in the art will, in general, recognize bonds that can become polarized in this way.

In some embodiments, the ionizable lipid is an ionizable amino lipid, sometimes referred to in the art as an "ionizable cationic lipid". In one embodiment, the ionizable amino lipid may have a positively charged hydrophilic head and a hydrophobic tail that are connected via a linker structure.

Nanoparticle compositions of the present disclosure comprise at least one compound according to formula (I). For example, the nanoparticle composition can include one or more of Compounds 1-147. Nanoparticle compositions can also include a variety of other components. For example, the nanoparticle composition may include one or more other lipids in addition to a lipid according to formula (I) or (II), for example (i) at least one phospholipid, (ii) at least one quaternary amine compound, (iii) at least one structural lipid, (iv) at least one PEG-lipid, or (v) any combination thereof.

In some embodiments, the nanoparticle composition comprises a compound of formula (I), (e.g., Compounds 18, 25, 26 or 48). In some embodiments, the nanoparticle composition comprises a compound of formula (I) (e.g., Compounds 18, 25, 26 or 48) and a phospholipid (e.g., DSPC or MSPC). In some embodiments, the nanoparticle composition comprises a compound of formula (I) (e.g., Compounds 18, 25, 26 or 48), a phospholipid (e.g., DSPC or MSPC), and a quaternary amine compound (e.g., DOTAP). In some embodiments, the nanoparticle composition comprises a compound of formula (I) (e.g., Compounds 18, 25, 26 or 48), and a quaternary amine compound (e.g., DOTAP).

In some embodiments, the nanoparticle composition comprises a lipid composition consisting or consisting essentially of compound of formula (I) (e.g., Compounds 18, 25, 26 or 48). In some embodiments, the nanoparticle composition comprises a lipid composition consisting or consisting essentially of a compound of formula (I) (e.g., Compounds 18, 25, 26 or 48) and a phospholipid (e.g., DSPC or MSPC). In some embodiments, the nanoparticle composition comprises a lipid composition consisting or consisting essentially of a compound of formula (I) (e.g., Compounds 18, 25, 26 or 48), a phospholipid (e.g., DSPC or MSPC), and a quaternary amine compound (e.g., DOTAP). In some embodiments, the nanoparticle composition comprises a lipid composition consisting or consisting essentially of a compound of formula (I) (e.g., Compounds 18, 25, 26 or 48), and a quaternary amine compound (e.g., DOTAP).

In one embodiment, the nanoparticle composition comprises (1) a lipid composition comprising about 50 mole % of a compound of formula (I) (e.g., Compounds 18, 25, 26 or 48); about 10 mole % of DSPC or MSPC; about 33.5 mole % of cholesterol; about 1.5 mole % of PEG-DMG (e.g., $PEG_{2k}$-DMG); about 5 mole % of DOTAP; and (2) at least one polynucleotide.

In one embodiment, the nanoparticle composition comprises (1) a lipid composition comprising about 50 mole % of a compound of formula (I) (e.g., Compounds 18, 25, 26 or 48); about 10 mole % of DSPC or MSPC; about 28.5 mole % of cholesterol; about 1.5 mole % of PEG-DMG (e.g., $PEG_{2k}$-DMG); about 10 mole % of DOTAP; and (2) at least one polynucleotide.

In one embodiment, the nanoparticle composition comprises (1) a lipid composition comprising about 50 mole % of a compound of formula (I) (e.g., Compounds 18, 25, 26 or 48); about 10 mole % of DSPC or MSPC; about 23.5 mole % of cholesterol; about 1.5 mole % of PEG-DMG (e.g., $PEG_{2k}$-DMG); about 15 mole % of DOTAP; and (2) at least one polynucleotide.

Nanoparticle compositions may be characterized by a variety of methods. For example, microscopy (e.g., transmission electron microscopy or scanning electron microscopy) may be used to examine the morphology and size distribution of a nanoparticle composition. Dynamic light scattering or potentiometry (e.g., potentiometric titrations) may be used to measure zeta potentials. Dynamic light scattering may also be utilized to determine particle sizes. Instruments such as the Zetasizer Nano ZS (Malvern Instruments Ltd, Malvern, Worcestershire, UK) may also be used to measure multiple characteristics of a nanoparticle composition, such as particle size, polydispersity index, and zeta potential.

The size of the nanoparticles can help counter biological reactions such as, but not limited to, inflammation, or can increase the biological effect of the polynucleotide or polynucleotides.

As used herein, "size" or "mean size" in the context of nanoparticle compositions refers to the mean diameter of a nanoparticle composition.

In one embodiment, the polynucleotides of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, are formulated in lipid nanoparticles. In some aspects, the lipid nanoparticles have a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm, about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the nanoparticles have a diameter from about 10 to 500 nm. In one embodiment, the nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the largest dimension of a nanoparticle composition is 1 m or shorter (e.g., 1 m, 900 nm, 800 nm, 700 nm, 600 nm, 500 nm, 400 nm, 300 nm, 200 nm, 175 nm, 150 nm, 125 nm, 100 nm, 75 nm, 50 nm, or shorter).

A nanoparticle composition may be relatively homogenous. A polydispersity index may be used to indicate the homogeneity of a nanoparticle composition, e.g., the particle size distribution of the nanoparticle composition. A small (e.g., less than 0.3) polydispersity index generally indicates a narrow particle size distribution. A nanoparticle composition may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a nanoparticle composition disclosed herein may be from about 0.10 to about 0.20.

The zeta potential of a nanoparticle composition may be used to indicate the electrokinetic potential of the composition. For example, the zeta potential may describe the surface charge of a nanoparticle composition. Nanoparticle compositions with relatively low charges, positive or negative, are generally desirable, as more highly charged species may interact undesirably with cells, tissues, and other elements in the body. In some embodiments, the zeta potential of a nanoparticle composition disclosed herein may be from about −10 mV to about +20 mV, from about −10 mV to about +15 mV, from about 10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

In some embodiments, the zeta potential of the lipid nanoparticles may be from about 0 mV to about 100 mV, from about 0 mV to about 90 mV, from about 0 mV to about 80 mV, from about 0 mV to about 70 mV, from about 0 mV to about 60 mV, from about 0 mV to about 50 mV, from about 0 mV to about 40 mV, from about 0 mV to about 30 mV, from about 0 mV to about 20 mV, from about 0 mV to about 10 mV, from about 10 mV to about 100 mV, from about 10 mV to about 90 mV, from about 10 mV to about 80 mV, from about 10 mV to about 70 mV, from about 10 mV to about 60 mV, from about 10 mV to about 50 mV, from about 10 mV to about 40 mV, from about 10 mV to about 30 mV, from about 10 mV to about 20 mV, from about 20 mV to about 100 mV, from about 20 mV to about 90 mV, from about 20 mV to about 80 mV, from about 20 mV to about 70 mV, from about 20 mV to about 60 mV, from about 20 mV to about 50 mV, from about 20 mV to about 40 mV, from about 20 mV to about 30 mV, from about 30 mV to about 100 mV, from about 30 mV to about 90 mV, from about 30 mV to about 80 mV, from about 30 mV to about 70 mV, from about 30 mV to about 60 mV, from about 30 mV to about 50 mV, from about 30 mV to about 40 mV, from about 40 mV to about 100 mV, from about 40 mV to about 90 mV, from about 40 mV to about 80 mV, from about 40 mV to about 70 mV, from about 40 mV to about 60 mV, and from about 40 mV to about 50 mV. In some embodiments, the zeta potential of the lipid nanoparticles may be from about 10 mV to about 50 mV, from about 15 mV to about 45 mV, from about 20 mV to about 40 mV, and from about 25 mV to about 35 mV. In some embodiments, the zeta potential of the lipid nanoparticles may be about 10 mV, about 20 mV, about 30 mV, about 40 mV, about 50 mV, about 60 mV, about 70 mV, about 80 mV, about 90 mV, and about 100 mV.

The term "encapsulation efficiency" of a polynucleotide describes the amount of the polynucleotide that is encapsulated by or otherwise associated with a nanoparticle composition after preparation, relative to the initial amount provided. As used herein, "encapsulation" may refer to complete, substantial, or partial enclosure, confinement, surrounding, or encasement.

Encapsulation efficiency is desirably high (e.g., close to 100%). The encapsulation efficiency may be measured, for example, by comparing the amount of the polynucleotide in a solution containing the nanoparticle composition before and after breaking up the nanoparticle composition with one or more organic solvents or detergents.

Fluorescence may be used to measure the amount of free polynucleotide in a solution. For the nanoparticle compositions described herein, the encapsulation efficiency of a polynucleotide may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In certain embodiments, the encapsulation efficiency may be at least 90%.

The amount of a polynucleotide present in a pharmaceutical composition disclosed herein can depend on multiple factors such as the size of the polynucleotide, desired target and/or application, or other properties of the nanoparticle composition as well as on the properties of the polynucleotide.

For example, the amount of an mRNA useful in a nanoparticle composition may depend on the size (expressed as length, or molecular mass), sequence, and other characteristics of the mRNA. The relative amounts of a polynucleotide in a nanoparticle composition may also vary.

The relative amounts of the lipid composition and the polynucleotide present in a lipid nanoparticle composition of the present disclosure can be optimized according to considerations of efficacy and tolerability. For compositions including an mRNA as a polynucleotide, the N:P ratio can serve as a useful metric.

As the N:P ratio of a nanoparticle composition controls both expression and tolerability, nanoparticle compositions with low N:P ratios and strong expression are desirable. N:P ratios vary according to the ratio of lipids to RNA in a nanoparticle composition.

In general, a lower N:P ratio is preferred. The one or more RNA, lipids, and amounts thereof may be selected to provide an N:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the N:P ratio may be from about 2:1 to about 8:1. In other embodiments, the N:P ratio is from about 5:1 to about 8:1. In certain embodiments, the N:P ratio is between 5:1 and 6:1. In one specific aspect, the N:P ratio is about is about 5.67:1.

In addition to providing nanoparticle compositions, the present disclosure also provides methods of producing lipid nanoparticles comprising encapsulating a polynucleotide. Such method comprises using any of the pharmaceutical compositions disclosed herein and producing lipid nanoparticles in accordance with methods of production of lipid nanoparticles known in the art. See, e.g., Wang (et al. 2015) Adv. Drug Deliv. Rev. 87:68-80; Silva et al. (2015) Curr. Pharm. Technol. 16: 940-954; Naseri et al. (2015) Adv. Pharm. Bull. 5:305-13; Silva et al. (2015) Curr. Pharm. Biotechnol. 16:291-302, and references cited therein.

In some embodiments, the polynucleotide of the disclosure is formulated in a lipid nanoparticle, wherein the polynucleotide comprises a polynucleotide sequence encoding an immune response primer, immune response co-stimulatory signal, or checkpoint inhibitor provided in the present disclosure. In some embodiments, the polynucleotide of the disclosure is formulated in a lipid nanoparticle, wherein the polynucleotide comprises a polynucleotide sequence encoding an immune response primer, immune response co-stimulatory signal, or checkpoint inhibitor provided in the present disclosure.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In one embodiment, the lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy) heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In one embodiment, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., from about 35 to about 65%, from about 45 to about 65%, about 60%, about 57.5%, about 50% or about 40% on a molar basis.

In one embodiment, the formulation includes from about 0.5% to about 15% on a molar basis of the neutral lipid, e.g., from about 3 to about 12%, from about 5 to about 10% or about 15%, about 10%, or about 7.5% on a molar basis. Exemplary neutral lipids include, but are not limited to, DSPC, POPC, DPPC, DOPE and SM. In one embodiment, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In one embodiment, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis. In one embodiment, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Exemplary PEG-modified lipids include, but are not limited to, PEG-distearoyl glycerol (PEG-DMG) (also referred herein as PEG-C14 or C14-PEG), PEG-cDMA (further discussed in Reyes et al. (2005) J. Controlled Release 107:276-287).

In one embodiment, the formulations of the disclosure include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In one embodiment, the formulations of the disclosure include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In one embodiment, the formulations of the disclosure include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In one embodiment, the formulations of the disclosure include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.5% of the neutral lipid, about 31% of the sterol, and about 1.5% of the PEG or PEG-modified lipid on a molar basis.

In one embodiment, the formulations of the disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 38.5% of the sterol, and about 1.5% of the PEG or PEG-modified lipid on a molar basis.

In one embodiment, the formulations of the disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 35% of the sterol, about 4.5% or about 5% of the PEG or PEG-modified lipid, and about 0.5% of the targeting lipid on a molar basis.

In one embodiment, the formulations of the disclosure include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 15% of the neutral lipid, about 40% of the sterol, and about 5% of the PEG or PEG-modified lipid on a molar basis.

In one embodiment, the formulations of the disclosure include about 57.2% of a cationic lipid selected from 2,2-dilinoleyl-4-dimethylaminoethyl-[1,3]-dioxolane (DLin- KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.1% of the neutral lipid, about 34.3% of the sterol, and about 1.4% of the PEG or PEG-modified lipid on a molar basis.

In one embodiment, the formulations of the disclosure include about 57.5% of a cationic lipid selected from the PEG lipid is PEG-cDMA (PEG-cDMA is further discussed in Reyes et al. (2005) J. Controlled Release 107:276-287, about 7.5% of the neutral lipid, about 31.5% of the sterol, and about 3.5% of the PEG or PEG-modified lipid on a molar basis.

In some embodiments, lipid nanoparticle formulation consists essentially of a lipid mixture in molar ratios of about 20-70% cationic lipid:5-45% neutral lipid:20-55% cholesterol:0.5-15% PEG-modified lipid; e.g., in a molar ratio of about 20-60% cationic lipid:5-25% neutral lipid:25-55% cholesterol:0.5-15% PEG-modified lipid.

In particular embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Exemplary lipid nanoparticle compositions and methods of making same are described, for example, in Semple et al. (2010) Nat. Biotechnol. 28:172-176; Jayarama et al. (2012) Angew. Chem. Int. Ed. 51:8529-8533; and Maier et al. (2013) Molecular Therapy 21:570-1578.

In one embodiment, the lipid nanoparticle formulations described herein comprise a cationic lipid, a PEG lipid and a structural lipid and optionally comprise a non-cationic lipid. As a non-limiting example, the lipid nanoparticle comprises about 40-60% of cationic lipid, about 5-15% of a non-cationic lipid, about 1-2% of a PEG lipid and about 30-50% of a structural lipid. As another non-limiting example, the lipid nanoparticle comprises about 50% cationic lipid, about 10% non-cationic lipid, about 1.5% PEG lipid and about 38.5% structural lipid. As yet another non-limiting example, the lipid nanoparticle comprises about 55% cationic lipid, about 10% non-cationic lipid, about 2.5% PEG lipid and about 32.5% structural lipid. In one embodiment, the cationic lipid is any cationic lipid described herein such as, but not limited to, DLin-KC2-DMA, DLin-MC3-DMA and L319.

In one embodiment, the lipid nanoparticle formulations described herein are 4 component lipid nanoparticles. The lipid nanoparticle can comprise a cationic lipid, a non-cationic lipid, a PEG lipid and a structural lipid. As a non-limiting example, the lipid nanoparticle can comprise about 40-60% of cationic lipid, about 5-15% of a non-cationic lipid, about 1-2% of a PEG lipid and about 30-50% of a structural lipid. As another non-limiting example, the lipid nanoparticle can comprise about 50% cationic lipid, about 10% non-cationic lipid, about 1.5% PEG lipid and about 38.5% structural lipid. As yet another non-limiting example, the lipid nanoparticle can comprise about 55% cationic lipid, about 10% non-cationic lipid, about 2.5% PEG lipid and about 32.5% structural lipid. In one embodiment, the cationic lipid can be any cationic lipid described herein such as, but not limited to, DLin-KC2-DMA, DLin-MC3-DMA and L319.

In one embodiment, the lipid nanoparticle formulations described herein comprise a cationic lipid, a non-cationic lipid, a PEG lipid and a structural lipid. As a non-limiting example, the lipid nanoparticle comprise about 50% of the cationic lipid DLin-KC2-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DMG and about 38.5% of the structural lipid cholesterol. As yet another non-limiting example, the lipid nanoparticle comprise about 55% of the cationic lipid L319, about 10% of the non-cationic lipid DSPC, about 2.5% of the PEG lipid PEG-DMG and about 32.5% of the structural lipid cholesterol.

In one embodiment, the cationic lipid is selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and US20130225836.

In another embodiment, the cationic lipid can be selected from, but not limited to, formula A described in International Publication Nos. WO2012040184, WO2011153120, WO2011149733, WO2011090965, WO2011043913, WO2011022460, WO2012061259, WO2012054365, WO2012044638 and WO2013116126 or US Patent Publication No. US20130178541 and US20130225836.

In yet another embodiment, the cationic lipid can be selected from, but not limited to, formula CLI-CLXXIX of International Publication No. WO2008103276, formula CLI-CLXXIX of U.S. Pat. No. 7,893,302, formula CLI-CLXXXXII of U.S. Pat. No. 7,404,969 and formula I-VI of US Patent Publication No. US20100036115, formula I of US Patent Publication No US20130123338. As a non-limiting example, the cationic lipid can be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-1 6, 19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21 Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethyl-heptacosan-10-amine, (20Z,23Z)—N-ethyl-N-methylnonacosa-20,23-dien-10-amine, 1-[(11Z,14Z)-1-nonylicosa-11,14-dien-1-yl] pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl] eptadecan-8-amine, 1-[(1S,2R)-2-hexylcyclopropyl]-N,N-dimethylnonadecan-10-amine, N,N-dimethyl-1-[(1S,2R)-2-octylcyclopropyl] nonadecan-10-amine, N,N-dimethyl-21-[(1S,2R)-2-octylcyclopropyl]henicosan-10-amine,N,N-dimethyl-1-[(1S,2S)-2-{[(1R,2R)-2-pentylcyclopropyl] methyl} cyclopropyl]nonadecan-10-amine,N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl] heptyl} dodecan-1-amine, 1-[(1R,2 S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy) methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoylo ctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy) propan-2-amine, N,N-dimethyl-1-{[8-(2-oclylcyclopropyl)octyl] oxy}-3-(octyloxy)propan-2-amine and (1lE,20Z,23Z)—N,N-dimethylnonacosa-11,20,2-trien-10-amine or a pharmaceutically acceptable salt or stereoisomer thereof.

In one embodiment, the lipid is a cleavable lipid such as those described in International Publication No. WO2012170889. In another embodiment, the lipid is a cationic lipid such as, but not limited to, Formula (I) of U.S. Patent Application No. US20130064894.

In one embodiment, the cationic lipid is synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724, WO201021865, WO2013086373 and WO2013086354.

In another embodiment, the cationic lipid is a trialkyl cationic lipid. Non-limiting examples of trialkyl cationic lipids and methods of making and using the trialkyl cationic lipids are described in International Patent Publication No. WO2013126803.

In one embodiment, the LNP formulations of the polynucleotides contain PEG-c-DOMG at 3% lipid molar ratio. In another embodiment, the LNP formulations of the polynucleotides contains PEG-c-DOMG at 1.5% lipid molar ratio.

In one embodiment, a pharmaceutical composition comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, and further comprises at least one of the PEGylated lipids described in International Publication No. WO2012099755.

In one embodiment, the LNP formulation contains PEG-DMG 2000 (1,2-dimyristoyl-sn-glycero-3-phophoethanolamine-N-[methoxy(polyethylene glycol)-2000). In one embodiment, the LNP formulation can contain PEG-DMG 2000, a cationic lipid known in the art and at least one other component. In another embodiment, the LNP formulation contains PEG-DMG 2000, a cationic lipid known in the art, DSPC and cholesterol. As a non-limiting example, the LNP formulation contains PEG-DMG 2000, DLin-DMA, DSPC and cholesterol. As another non-limiting example the LNP formulation contains PEG-DMG 2000, DLin-DMA, DSPC and cholesterol in a molar ratio of 2:40:10:48 (see, e.g., Geall et al. (2012) Proc. Nat'l. Acad. Sci. USA 109:14604-9).

In one embodiment, the LNP formulation is formulated by the methods described in International Publication Nos. WO2011127255 or WO2008103276. As a non-limiting example, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is encapsulated in LNP formulations as described in WO2011127255 and/or WO2008103276; see also, U.S. Pat. Appl. Publ. Nos. US20130037977 and US20100015218, which are herein incorporated by reference in their entireties.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is formulated in a nanoparticle to be delivered by a parenteral route as described in U.S. Patent Application Publication No. US20120207845.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is formulated in a lipid nanoparticle made by the methods described in U.S. Patent Application Publication No. US20130156845 or International Publication No. WO2013093648 or WO2012024526.

The lipid nanoparticles described herein can be made in a sterile environment by the system and/or methods described in U.S. Patent Application Publication No. US20130164400.

In one embodiment, the LNP formulation is formulated in a nanoparticle such as a nucleic acid-lipid particle described in U.S. Pat. No. 8,492,359. As a non-limiting example, the lipid particle comprises one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle. The nucleic acid in the nanoparticle can be the polynucleotides described herein and/or are known in the art.

In one embodiment, the LNP formulation is formulated by the methods described in International Publication Nos. WO2011127255 or WO2008103276. As a non-limiting example, modified RNA described herein is encapsulated in LNP formulations as described in WO2011127255 and/or WO2008103276.

In one embodiment, LNP formulations described herein comprise a polycationic composition. As a non-limiting example, the polycationic composition is selected from formula 1-60 of U.S. Patent Publication No. US20050222064. In another embodiment, the LNP formulations comprising a polycationic composition are used for the delivery of the modified RNA described herein in vivo and/or in vitro.

In one embodiment, the LNP formulations described herein additionally comprise a permeability enhancer molecule. Non-limiting permeability enhancer molecules are described in U.S. Patent Application Publication No. US20050222064.

In one embodiment, the polynucleotide pharmaceutical compositions are formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. (2006) Cancer Biology & Therapy 5:1708-1713) and hyaluronan-coated liposomes (Quiet Therapeutics, Israel).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is formulated in a lyophilized gel-phase liposomal composition as described in U.S. Patent Application Publication No. US2012060293.

The nanoparticle formulations can comprise a phosphate conjugate. The phosphate conjugate can increase in vivo circulation times and/or increase the targeted delivery of the nanoparticle. Phosphate conjugates for use with the present disclosure can be made by the methods described in International Application No. WO2013033438 or U.S. Patent Application Publication No. US20130196948. As a non-limiting example, the phosphate conjugates can include a compound of any one of the formulas described in International Application No. WO2013033438; see also, U.S. Pat. Appl. Publ. No. US20130066086.

The nanoparticle formulation can comprise a polymer conjugate. The polymer conjugate can be a water soluble conjugate. The polymer conjugate can have a structure as described in U.S. Patent Application Publication No. 20130059360. In one embodiment, polymer conjugates with a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure can be made using the methods and/or segmented polymeric reagents described in U.S. Patent Application Publication No. US20130072709. In another embodiment, the polymer conjugate can have pendant side groups comprising ring moieties such as, but not limited to, the polymer conjugates described in U.S. Patent Application Publication No. US20130196948.

The nanoparticle formulations can comprise a conjugate to enhance the delivery of nanoparticles of the present disclosure in a subject. Further, the conjugate can inhibit phagocytic clearance of the nanoparticles in a subject. In one embodiment, the conjugate is a "self" peptide designed from the human membrane protein CD47, e.g., the "self" particles described by Rodriguez et al. (2013) Science 339:971-975. As shown by Rodriguez et al. the self peptides delayed macrophage-mediated clearance of nanoparticles which enhanced delivery of the nanoparticles. In another embodiment, the conjugate is the membrane protein CD47. See, e.g., Rodriguez et al. (2013) Science 339:971-975. Rodriguez et al. showed that, similarly to "self" peptides, CD47 can increase the circulating particle ratio in a subject as compared to scrambled peptides and PEG coated nanoparticles.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure can be formulated in nanoparticles which comprise a conjugate to enhance the delivery of the nanoparticles of the present disclosure in a subject. The conjugate can be the CD47 membrane or the conjugate can be derived from the CD47 membrane protein, such as the "self" peptide described previously. In another aspect the nanoparticle can comprise PEG and a conjugate of CD47 or a derivative thereof. In yet another aspect, the nanoparticle comprises both the "self" peptide described above and the membrane protein CD47.

In another aspect, a "self" peptide and/or CD47 protein is conjugated to a virus-like particle or pseudovirion, as described herein for delivery of the polynucleotides of the present disclosure.

In another embodiment, pharmaceutical compositions comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure, can comprise a conjugate with a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in U.S. Patent Application Publication No. US20130184443.

The nanoparticle formulations can be a carbohydrate nanoparticle comprising a carbohydrate carrier and a polynucleotide. As a non-limiting example, the carbohydrate carrier includes, but is not limited to, an anhydride-modified phytoglycogen or glycogen-type material, phtoglycogen octenyl succinate, phytoglycogen beta-dextrin, anhydride-modified phytoglycogen beta-dextrin. See, e.g., International Publication No. WO2012109121; see also U.S. Pat. Appl. Publ. No. US20140066363.

Nanoparticle formulations of the present disclosure can be coated with a surfactant or polymer in order to improve the delivery of the particle. In one embodiment, the nanoparticle is coated with a hydrophilic coating such as, but not limited to, PEG coatings and/or coatings that have a neutral surface charge. The hydrophilic coatings can help to deliver nanoparticles with larger payloads such as, but not limited to, polynucleotides within the central nervous system. As a non-limiting example nanoparticles comprising a hydrophilic coating and methods of making such nanoparticles are described in U.S. Patent Application Publication No. US20130183244.

In one embodiment, the lipid nanoparticles of the present disclosure are hydrophilic polymer particles. Non-limiting examples of hydrophilic polymer particles and methods of making hydrophilic polymer particles are described in U.S. Patent Application Publication No. US20130210991.

In another embodiment, the lipid nanoparticles of the present disclosure are hydrophobic polymer particles. Lipid nanoparticle formulations can be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and can be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it can be terminally located at the terminal end of the lipid chain. The internal ester linkage can replace any carbon in the lipid chain.

In one embodiment, the internal ester linkage is located on either side of the saturated carbon.

In one embodiment, an immune response is elicited by delivering a lipid nanoparticle which can include a nanospecies, a polymer and an immunogen. See, e.g., U.S. Patent Application Publication No. US20120189700 and International Publication No. WO2012099805. The polymer can encapsulate the nanospecies or partially encapsulate the nanospecies. The immunogen can be a recombinant protein, a modified RNA and/or a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure.

Lipid nanoparticles can be engineered to alter the surface properties of particles so the lipid nanoparticles can penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles can be removed from the mucosal tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. (2007) Proc. Nat'l. Acad. Sci. USA 104:1482-487; Lai et al. (2009) Adv. Drug Deliv. Rev. 61:158-171). The transport of nanoparticles can be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier can be made as described in U.S. Pat. No. 8,241,670 or International Patent Publication No. WO2013110028 (see, also U.S. Pat. Appl. Publ. No. US20150297531).

The lipid nanoparticle engineered to penetrate mucus can comprise a polymeric material (i.e. a polymeric core) and/or a polymer-vitamin conjugate and/or a tri-block co-polymer. The polymeric material can include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material can be biodegradable and/or biocompatible. Non-limiting examples of biocompatible polymers are described in International Patent Publication No. WO2013116804; see also, U.S. Pat. Appl. Publ. No. US20130203713, which is herein incorporated by reference in its entirety. The polymeric material can additionally be irradiated. As a non-limiting example, the polymeric material can be gamma irradiated. See, e.g., International App. No. WO2012082165; see also, U.S. Pat. Appl. Publ. No. US20130101609, which is herein incorporated by reference in its entirety.

Non-limiting examples of specific polymers include poly (caprolactone) (PCL), ethylene vinyl acetate polymer (EVA), poly(lactic acid) (PLA), poly(L-lactic acid) (PLLA), poly(glycolic acid) (PGA), poly(lactic acid-co-glycolic acid) (PLGA), poly(L-lactic acid-co-glycolic acid) (PLLGA), poly(D,L-lactide) (PDLA), poly(L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L- lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly (ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropyl cellulose, carboxymethylcellulose, polymers of acrylic acids, such as poly(methyl (meth)acrylate) (PMMA), poly(ethyl(meth)acrylate), poly (butyl(meth)acrylate), poly(isobutyl(meth)acrylate), poly (hexyl(meth)acrylate), poly(isodecyl(meth)acrylate), poly (lauryl(meth)acrylate), poly(phenyl(meth)acrylate), poly (methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly (valeric acid), poly(lactide-co-caprolactone), PEG-PLGA-PEG and trimethylene carbonate, polyvinylpyrrolidone. The lipid nanoparticle can be coated or associated with a co-polymer such as, but not limited to, a block co-polymer (such as a branched polyether-polyamide block copolymer described in International Publication No. WO2013012476), and (poly(ethylene glycol))-(poly(propylene oxide))-(poly (ethylene glycol)) triblock copolymer. See, e.g., U.S. Patent Application Publication Nos. US20120121718 and US20100003337, and U.S. Pat. No. 8,263,665.

The co-polymer can be a polymer that is generally regarded as safe (GRAS) and the formation of the lipid nanoparticle can be in such a way that no new chemical entities are created. For example, the lipid nanoparticle can comprise poloxamers coating PLGA nanoparticles without forming new chemical entities which are still able to rapidly penetrate human mucus. Yang et al. (2011) Angew. Chem. Int. Ed. 50:2597-2600. A non-limiting scalable method to produce nanoparticles which can penetrate human mucus is described by Xu et al. (2013) J. Control Release 170:279-86.

The vitamin of the polymer-vitamin conjugate can be vitamin E. The vitamin portion of the conjugate can be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus can include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocysteine, eprazinone, mesna, ambroxol, sobrerol, domiodol, letosteine, stepronin, tiopronin, gelsolin, thymosin β4 dornase alfa, neltenexine, erdosteine) and various DNases including rhDNase. The surface altering agent can be embedded or enmeshed in the particle's surface or disposed (e.g., by coating, adsorption, covalent linkage, or other process) on the surface of the lipid nanoparticle. See, e.g., U.S. Patent Application Publication Nos. US20100215580, US20080166414, and US20130164343.

In one embodiment, the mucus penetrating lipid nanoparticles comprises at least one polynucleotide described herein. The polynucleotide can be encapsulated in the lipid nanoparticle and/or disposed on the surface of the particle. The polynucleotide can be covalently coupled to the lipid nanoparticle. Formulations of mucus penetrating lipid nanoparticles can comprise a plurality of nanoparticles. Further, the formulations can contain particles which can interact with the mucus and alter the structural and/or adhesive properties of the surrounding mucus to decrease mucoadhesion which can increase the delivery of the mucus penetrating lipid nanoparticles to the mucosal tissue.

In another embodiment, the mucus penetrating lipid nanoparticles are a hypotonic formulation comprising a mucosal penetration enhancing coating. The formulation can be hypotonic for the epithelium to which it is being delivered. Non-limiting examples of hypotonic formulations can be found in International Patent Publication No. WO2013110028; see also U.S. Pat. Appl. Publ. No. US20150297531, which is herein incorporated by reference in its entirety.

In one embodiment, in order to enhance the delivery through the mucosal barrier the polynucleotide formulation comprises or is a hypotonic solution. Hypotonic solutions were found to increase the rate at which mucoinert particles such as, but not limited to, mucus-penetrating particles, were able to reach the vaginal epithelial surface. See, e.g., Ensign et al. (2013) Biomaterials 34:6922-9.

In one embodiment, the polynucleotide is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids. See Aleku et al. (2008) Cancer Res. 68:9788-9798; Strumberg et al. (2012) Int. J. Clin. Pharmacol. Ther. 50:76-78; Santel et al. (2006) Gene Ther. 13:1222-1234; Santel et al. (2006) Gene Ther. 13:1360-1370; Gutbier et al. (2010) Pulm. Pharmacol. Ther. 23:334-344; Kaufmann et al. (2010) Microvasc. Res. 80:286-293; Weide et al. (2009) J. Immunother. 32:498-507; Weide et al. (2008) J. Immunother. 31:180-188; Pascolo (2004) Expert Opin. Biol. Ther. 4:1285-1294; Fotin-Mleczek et al. (2011) J. Immunother. 34:1-15; Song et al. (2005) Nature Biotechnol. 23:709-717; Peer et al. (2007) Proc. Natl. Acad. Sci. USA 6:104:4095-4100; deFougerolles (2008) Hum. Gene Ther. 19:125-132).

In one embodiment, such formulations are also constructed or compositions altered such that they passively or actively are directed to different cell types in vivo, including but not limited to hepatocytes, immune cells, tumor cells, endothelial cells, antigen presenting cells, and leukocytes (Akinc et al. (2010) Mol. Ther. 18:1357-1364; Song et al. (2005) Nat. Biotechnol. 23:709-717; Judge et al. (2009) J. Clin. Invest. 119:661-673; Kaufmann et al. (2010) Microvasc. Res. 80:286-293; Santel et al. (2006) Gene Ther. 13:1222-1234; Santel et al. (2006) Gene Ther. 13:1360-1370; Gutbier et al. (2010) Pulm. Pharmacol. Ther. 23:334-344; Basha et al. (2011) Mol. Ther. 19:2186-2200; Fenske and Cullis (2008) Expert Opin. Drug Deliv. 5:25-44; Peer et al. (2008) Science 319:627-630; Peer and Lieberman (2011) Gene Ther. 18:1127-1133). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. (2010) Mol. Ther. 18:1357-1364).

Formulations can also be selectively targeted through expression of different ligands on their surface as exemplified by, but not limited by, folate, transferrin, N-acetylgalactosamine (GalNAc), and antibody targeted approaches. See, e.g., Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721: 339-353; Subramanya et al., Mol Ther. 2010 18:2028-2037; Song et al., Nat Biotechnol. 2005 23:709-717; Peer et al., Science. 2008 319:627-630; and, Peer and Lieberman, Gene Ther. 2011 18:1127-1133; all of which are herein incorporated by reference in their entireties.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is formulated as a solid lipid nanoparticle.

A solid lipid nanoparticle (SLN) can be spherical with an average diameter between 10 to 1,000 nm. SLN possess a solid lipid core matrix that can solubilize lipophilic molecules and can be stabilized with surfactants and/or emulsifiers. In a further embodiment, the lipid nanoparticle can be a self-assembly lipid-polymer nanoparticle. See Zhang et al. (2008) ACS Nano 2:1696-1702. As a non-limiting example, the SLN can be the SLN described in International Patent Publication No. WO2013105101. As another non-limiting example, the SLN can be made by the methods or processes described in International Patent Publication No. WO2013105101.

Liposomes, lipoplexes, or lipid nanoparticles can be used to improve the efficacy of a polynucleotide (or the efficacy of a combination of polynucleotides) of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, as these formulations can be able to increase cell transfection by the polynucleotides; and/or increase the translation of the encoded polypeptides. One such example involves the use of lipid encapsulation to enable the effective systemic delivery of polyplex plasmid DNA. See Heyes et al. (2007) Mol. Ther. 15:713-720. The liposomes, lipoplexes, or lipid nanoparticles can also be used to increase the stability of the polynucleotide.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated for controlled release and/or targeted delivery.

As used herein, "controlled release" refers to a pharmaceutical composition or compound release profile that conforms to a particular pattern of release to effect a therapeutic outcome. In one embodiment, the polynucleotides are encapsulated into a delivery agent described herein and/or known in the art for controlled release and/or targeted delivery. As used herein, the term "encapsulate" means to enclose, surround or encase. As it relates to the formulation of the compounds of the disclosure, encapsulation can be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the disclosure can be enclosed, surrounded or encased within the delivery agent. "Partially encapsulation" means that less than 10, 10, 20, 30, 40 50 or less of the pharmaceutical composition or compound of the disclosure can be enclosed, surrounded or encased within the delivery agent. Advantageously, encapsulation can be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the disclosure are encapsulated in the delivery agent.

In one embodiment, the controlled release formulation includes, but is not limited to, tri-block co-polymers. As a non-limiting example, the formulation includes two different types of tri-block co-polymers. See International Publ. Nos. WO2012131104 and WO2012131106; see also U.S. Pat. Appl. Publ. Nos. US20140219923 and US20150165042, which are herein incorporated by reference in their entireties.

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be encapsulated into a lipid nanoparticle or a rapidly eliminated lipid nanoparticle and the lipid nanoparticles or a rapidly eliminated lipid nanoparticle can then be encapsulated into a polymer, hydrogel and/or surgical sealant described herein and/or known in the art. As a non-limiting example, the polymer, hydrogel or surgical sealant is PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, or COSEAL® (Baxter International, Inc Deerfield, Ill.).

In another embodiment, the lipid nanoparticle is encapsulated into any polymer known in the art which can form a gel when injected into a subject. As another non-limiting example, the lipid nanoparticle is encapsulated into a polymer matrix which can be biodegradable.

In one embodiment, the formulation for controlled release and/or targeted delivery comprises a polynucleotide comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, also includes at least one controlled release coating.

Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In one embodiment, the polynucleotide controlled release and/or targeted delivery formulation comprises at least one degradable polyester which can contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters can include a PEG conjugation to form a PEGylated polymer.

In one embodiment, the polynucleotide controlled release and/or targeted delivery formulation comprising at least one polynucleotide comprises at least one PEG and/or PEG related polymer derivatives as described in U.S. Pat. No. 8,404,222.

In another embodiment, the polynucleotide controlled release delivery formulation comprising at least one polynucleotide is the controlled release polymer system described in U.S. Pat. Appl. Publ. No. US20130130348.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is encapsulated in a therapeutic nanoparticle Therapeutic nanoparticles can be formulated by methods described herein and known in the art such as, but not limited to, International Publ. Nos. WO2010005740, WO2010030763, WO2010005721, WO2010005723, WO2012054923, U.S. Pat. Appl. Publ. Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211. In another embodiment, therapeutic polymer nanoparticles can be identified by the methods described in U.S. Pat. Appl. Publ. No. US20120140790.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated for sustained release.

As used herein, "sustained release" refers to a pharmaceutical composition or compound that conforms to a release rate over a specific period of time. The period of time can include, but is not limited to, hours, days, weeks, months and years. As a non-limiting example, the sustained release nanoparticle comprises a polymer and a therapeutic agent such as, but not limited to, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure. See International Publ. No. WO2010075072 and U.S. Pat. Appl. Publ. Nos. US20100216804, US20110217377 and US20120201859. In another non-limiting example, the sustained release formulation comprises agents which permit persistent bioavailability such as, but not limited to, crystals, macromolecular gels and/or particulate suspensions. See U.S. Pat. Appl. Publ. No. US20130150295.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated to be target specific.

As a non-limiting example, the therapeutic nanoparticles include a corticosteroid. See International Pub. No. WO2011084518. As a non-limiting example, the therapeutic nanoparticles are formulated in nanoparticles described in International Publ. Nos. WO2008121949, WO2010005726, WO2010005725, WO2011084521 and U.S. Pat. Appl. Publ. Nos. US20100069426, US20120004293 and US20100104655.

In one embodiment, the nanoparticles of the present disclosure comprise a polymeric matrix. As a non-limiting example, the nanoparticle comprises two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer includes PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof. In yet another embodiment, the diblock copolymer is a high-X diblock copolymer such as those described in International Patent Publication No. WO2013120052; see also U.S. Pat. Appl. Publ. No. US20150337068, which is herein incorporated by reference in its entirety.

As a non-limiting example the therapeutic nanoparticle comprises a PLGA-PEG block copolymer. See U.S. Pat. Appl. Publ. No. US20120004293 and U.S. Pat. No. 8,236,330. In another non-limiting example, the therapeutic nanoparticle is a stealth nanoparticle comprising a diblock copolymer of PEG and PLA or PEG and PLGA. See U.S. Pat. No. 8,246,968 and International Publication No. WO2012166923. In yet another non-limiting example, the therapeutic nanoparticle is a stealth nanoparticle or a target-specific stealth nanoparticle as described in U.S. Pat. Appl. Publ. No. US20130172406.

In one embodiment, the therapeutic nanoparticle comprises a multiblock copolymer. See, e.g., U.S. Pat. Nos. 8,263,665 and 8,287,910 and U.S. Pat. Appl. Publ. No. US20130195987. In yet another non-limiting example, the lipid nanoparticle comprises the block copolymer PEG-PLGA-PEG. See, e.g., Lee et al. (2003) Pharmaceutical Research 20:1995-2000; Li et al. (2003) Pharmaceutical Research 20:884-888; and Chang et al. (2007) J. Controlled Release. 118:245-253.

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in lipid nanoparticles comprising the PEG-PLGA-PEG block copolymer.

In one embodiment, the therapeutic nanoparticle comprises a multiblock copolymer. See, e.g., U.S. Pat. Nos. 8,263,665 and 8,287,910 and U.S. Patent Appl. Publ. No. US20130195987.

In one embodiment, the block copolymers described herein are included in a polyion complex comprising a non-polymeric micelle and the block copolymer. See, e.g., U.S. Pat. App. Publ. No. US20120076836.

In one embodiment, the therapeutic nanoparticle comprises at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the therapeutic nanoparticles comprises at least one poly(vinyl ester) polymer. The poly(vinyl ester) polymer can be a copolymer such as a random copolymer. As a non-limiting example, the random copolymer has a structure such as those described in International Application No. WO2013032829 or U.S. Pat. Appl. Publ. No. US20130121954. In one aspect, the poly(vinyl ester) polymers can be conjugated to the polynucleotides described herein.

In one embodiment, the therapeutic nanoparticle comprises at least one diblock copolymer. The diblock copolymer can be, but it not limited to, a poly(lactic) acid-poly (ethylene)glycol copolymer. See, e.g., International Patent Publication No. WO02013044219.

As a non-limiting example, the therapeutic nanoparticle are used to treat cancer. See International Publication No. WO2013044219; see also, U.S. Pat. Appl. Publ. No. US20150017245, which is herein incorporated by reference in its entirety.

In one embodiment, the therapeutic nanoparticles comprise at least one cationic polymer described herein and/or known in the art.

In one embodiment, the therapeutic nanoparticles comprise at least one amine-containing polymer such as, but not limited to polylysine, polyethylene imine, poly(amidoamine) dendrimers, poly(beta-amino esters) and combinations thereof. See, e.g., U.S. Pat. No. 8,287,849.

In another embodiment, the nanoparticles described herein comprise an amine cationic lipid such as those described in International Patent Application No. WO2013059496. In one aspect the cationic lipids have an amino-amine or an amino-amide moiety.

In one embodiment, the therapeutic nanoparticles comprise at least one degradable polyester which can contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters can include a PEG conjugation to form a PEGylated polymer.

In another embodiment, the therapeutic nanoparticle include a conjugation of at least one targeting ligand. The targeting ligand can be any ligand known in the art such as, but not limited to, a monoclonal antibody. See Kirpotin et al (2006) Cancer Res. 66:6732-6740.

In one embodiment, the therapeutic nanoparticle is formulated in an aqueous solution which can be used to target cancer (see International Pub No. WO2011084513 and U.S. Pat. Appl. Publ. No. US20110294717).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated using the methods described in U.S. Pat. No. 8,404,799.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be are encapsulated in, linked to and/or associated with synthetic nanocarriers.

Synthetic nanocarriers include, but are not limited to, those described in International Pub. Nos. WO2010005740, WO2010030763, WO201213501, WO2012149252, WO2012149255, WO2012149259, WO2012149265, WO2012149268, WO2012149282, WO2012149301, WO2012149393, WO2012149405, WO2012149411, WO2012149454 and WO2013019669, and U.S. Pat. Appl. Publ. Nos. US20110262491, US20100104645, US20100087337 and US20120244222. The synthetic nanocarriers can be formulated using methods known in the art and/or described herein. As a non-limiting example, the synthetic nanocarriers can be formulated by the methods described in International Pub Nos. WO2010005740, WO2010030763 and WO201213501and U.S. Pat. Appl. Publ. Nos. US20110262491, US20100104645, US20100087337 and US2012024422. In another embodiment, the synthetic nanocarrier formulations can be lyophilized by methods described in International Pub. No. WO2011072218 and U.S. Pat. No. 8,211,473. In yet another embodiment, formulations of the present disclosure, including, but not limited to, synthetic nanocarriers, can be lyophilized or reconstituted by the methods described in US Pat. Appl. Publ. No. US20130230568.

In one embodiment, the synthetic nanocarriers contain reactive groups to release the polynucleotides described herein (see International Publ. No. WO20120952552 and U.S. Pat. Appl. Publ. No. US20120171229).

In one embodiment, the synthetic nanocarriers contain an immunostimulatory agent to enhance the immune response from delivery of the synthetic nanocarrier. As a non-limiting example, the synthetic nanocarrier can comprise a Th1 immunostimulatory agent which can enhance a Th1-based response of the immune system (see International Publ. No. WO2010123569 and U.S. Pat. Appl. Publ. No. US20110223201).

In one embodiment, the synthetic nanocarriers are formulated for targeted release. In one embodiment, the synthetic nanocarrier is formulated to release the polynucleotides at a specified pH and/or after a desired time interval. As a non-limiting example, the synthetic nanoparticle are formulated to release the polynucleotides after 24 hours and/or at a pH of 4.5 (see International Publ. Nos. WO2010138193 and WO2010138194 and U.S. Pat. Appl. Publ. Nos. US20110020388 and US20110027217).

In one embodiment, the synthetic nanocarriers are formulated for controlled and/or sustained release of the polynucleotides described herein. As a non-limiting example, the synthetic nanocarriers for sustained release are formulated by methods known in the art, described herein and/or as described in International Pub No. WO2010138192 and U.S. Pat. Appl. Publ. No. 20100303850, both of which are herein incorporated by reference in their entireties.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated for controlled and/or sustained release wherein the formulation comprises at least one polymer that is a crystalline side chain (CYSC) polymer. CYSC polymers are described in U.S. Pat. No. 8,399,007.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be encapsulated in, linked to, and/or associated with zwitterionic lipids. Non-limiting examples of zwitterionic lipids and methods of using zwitterionic lipids are described in U.S. Pat. Appl. Publ. No. US20130216607. In one aspect, the zwitterionic lipids can be used in the liposomes and lipid nanoparticles described herein.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in colloid nanocarriers as described in U.S. Pat. Appl. Publ. No. US20130197100.

In one embodiment, the nanoparticle is optimized for oral administration. The nanoparticle can comprise at least one cationic biopolymer such as, but not limited to, chitosan or a derivative thereof. As a non-limiting example, the nanoparticle can be formulated by the methods described in U.S. Pat. Appl. Publ. No. US20120282343.

In some embodiments, LNPs comprise the lipid KL52 (an amino-lipid disclosed in U.S. Pat. Appl. Publ. No. US2012/0295832). Activity and/or safety (as measured by examining one or more of ALT/AST, white blood cell count and cytokine induction) of LNP administration can be improved by incorporation of such lipids. LNPs comprising KL52 can be administered intravenously and/or in one or more doses. In some embodiments, administration of LNPs comprising KL52 results in equal or improved mRNA and/or protein expression as compared to LNPs comprising MC3.

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be delivered using smaller LNPs. Such particles can comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, or less than 975 um.

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be delivered using smaller LNPs which can comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Exemplary microfluidic mixers can include, but are not limited to a slit Interdigital micromixer including, but not limited to those manufactured by Microinnova (Allerheiligen bei Wildon, Austria) and/or a staggered herringbone micromixer (SHM). See Zhigaltsev et al. (2012) Langmuir 28:3633-40; Belliveau et al. (2012) Molecular Therapy-Nucleic Acids 1:e37; Chen et al. (2012) J. Am. Chem. Soc. 134:6948-51.

In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method can also comprise a surface for fluid mixing wherein the surface changes orientations during fluid cycling. Methods of generating LNPs using SHM include those disclosed in U.S. Pat. Appl. Publ. Nos. US2004/0262223 and US2012/0276209.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure can be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, of the present disclosure can be formulated in lipid nanoparticles created using microfluidic technology. See Whitesides (2006) Nature 442: 368-373; and Abraham et al. (2002) Science 295:647-651. As a non-limiting example, controlled microfluidic formulation includes a passive method for mixing streams of steady pressure-driven flows in micro channels at a low Reynolds number. See, e.g., Abraham et al. (2002) Science 295: 647-651.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated for delivery using the drug encapsulating microspheres described in International Patent Publication No. WO2013063468 or U.S. Pat. No. 8,440,614. The microspheres can comprise a compound of the formula (I), (II), (III), (IV), (V) or (VI) as described in International Patent Publication No. WO2013063468. In another aspect, the amino acid, peptide, polypeptide, lipids (APPL) are useful in delivering the polynucleotides of the disclosure to cells. See International Patent Publication No. WO2013063468; see also, U.S. Pat. Appl. Publ. No. US20130158021, which is herein incorporated by reference in its entirety.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles have a diameter from about 10 to 500 nm. In one embodiment, the lipid nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In one aspect, the lipid nanoparticle is a limit size lipid nanoparticle described in International Patent Publication No. WO2013059922 (see also U.S. Pat. Appl. Publ. No. US20140328759, which is herein incorporated by reference in its entirety). The limit size lipid nanoparticle can comprise a lipid bilayer surrounding an aqueous core or a hydrophobic core; where the lipid bilayer can comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In another aspect the limit size lipid nanoparticle can comprise a polyethylene glycol-lipid such as, but not limited to, DLPE-PEG, DMPE-PEG, DPPC-PEG and DSPE-PEG.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be delivered, localized, and/or concentrated in a specific location (e.g., a specific organ, tissue, physiological compartment, cell type, etc.) using the delivery methods described in International Patent Publication No. WO2013063530. See also, U.S. Pat. Appl. Publ. No. US20140323907, which is herein incorporated by reference in its entirety. As a non-limiting example, a subject can be administered an empty polymeric particle prior to, simultaneously with or after delivering the polynucleotides to the subject. The empty polymeric particle undergoes a change in volume once in contact with the subject and becomes lodged, embedded, immobilized or entrapped at a specific location in the subject.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in an active substance release system (see, e.g., U.S. Patent Appl. Publ. No. US20130102545). The active substance release system can comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a nanoparticle comprising an inner core comprising a non-cellular material and an outer surface comprising a cellular membrane. The cellular membrane can be derived from a cell or a membrane derived from a virus. As a non-limiting example, the nanoparticle is made by the methods described in International Patent Publication No. WO2013052167. As another non-limiting example, the nanoparticle described in International Patent Publication No. WO2013052167, is used to deliver the polynucleotides described herein. See also, U.S. Pat. Appl. Publ. No. US20130337066, which is herein incorporated by reference in its entirety.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in porous nanoparticle-supported lipid bilayers (protocells). Protocells are described in International Patent Publication No. WO2013056132 (see also U.S. Pat. Appl. Publ. No. US20150272885, which is herein incorporated by reference in its entirety).

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in polymeric nanoparticles as described in or made by the methods described in U.S. Pat. Nos. 8,420,123 and 8,518,963 and European Patent No. EP2073848B 1 As a non-limiting example, the polymeric nanoparticle has a high glass transition temperature such as the nanoparticles described in or nanoparticles made by the methods described in U.S. Pat. No. 8,518,963. As another non-limiting example, the polymer nanoparticle for oral and parenteral formulations is made by the methods described in European Patent No. EP2073848B 1.

In another embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in nanoparticles used in imaging (e.g., as a contrast medium in magnetic resonance imaging). The nanoparticles can be liposome nanoparticles such as those described in U.S. Pat. Appl. Publ. No. US20130129636. As a non-limiting example, the liposome can comprise gadolinium(III)2-{4,7-bis-carboxymethyl-10-[(N,N-distearylamidomethyl-N'-amido-methyl]-1,4,7,10-tetra-azacyclododec-1-yl}-acetic acid and a neutral, fully saturated phospholipid component (see, e.g., U.S. Pat. Appl. Publ. No. US20130129636).

In one embodiment, the nanoparticles which can be used in the present disclosure are formed by the methods described in U.S. Pat. Appl. Publ. No. US20130130348.

The nanoparticles of the present disclosure can further include nutrients such as, but not limited to, those which deficiencies can lead to health hazards from anemia to neural tube defects. See, e.g, the nanoparticles described in International Patent Publication No WO2013072929; see also, U.S. Pat. Appl. Publ. No. US20150224035, which is herein incorporated by reference in its entirety. As a non-limiting example, the nutrient is iron in the form of ferrous, ferric salts or elemental iron, iodine, folic acid, vitamins or micronutrients.

In one embodiment, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a swellable nanoparticle. The swellable nanoparticle can be, but is not limited to, those described in U.S. Pat. No. 8,440,231. As a non-limiting embodiment, the swellable nanoparticle is used for delivery of the polynucleotides of the present disclosure to the pulmonary system (see, e.g., U.S. Pat. No. 8,440,231).

In one embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in polyanhydride nanoparticles such as, but not limited to, those described in U.S. Pat. No. 8,449,916.

The nanoparticles and microparticles of the present disclosure can be geometrically engineered to modulate macrophage and/or the immune response. In one aspect, the geometrically engineered particles can have varied shapes, sizes and/or surface charges in order to incorporated the polynucleotides of the present disclosure for targeted delivery such as, but not limited to, pulmonary delivery (see, e.g., International Publication No WO2013082111). Other physical features the geometrically engineering particles can have include, but are not limited to, fenestrations, angled arms, asymmetry and surface roughness, charge which can alter the interactions with cells and tissues. As a non-limiting example, nanoparticles of the present disclosure are made by the methods described in International Publication No WO2013082111 (see also U.S. Pat. Appl. Publ. No. US20150037428).

In one embodiment, the nanoparticles of the present disclosure are water soluble nanoparticles such as, but not limited to, those described in International Publication No. WO2013090601 (see also, U.S. Pat. Appl. Publ. No. US20130184444). The nanoparticles can be inorganic nanoparticles which have a compact and zwitterionic ligand in order to exhibit good water solubility. The nanoparticles can also have small hydrodynamic diameters (HD), stability with respect to time, pH, and salinity and a low level of non-specific protein binding.

In one embodiment, the nanoparticles of the present disclosure are developed by the methods described in U.S. Patent Appl. Publ. No. US20130172406.

In one embodiment, the nanoparticles of the present disclosure are stealth nanoparticles or target-specific stealth nanoparticles such as, but not limited to, those described in U.S. Patent Appl. Publ. No. US20130172406. The nanoparticles of the present disclosure can be made by the methods described in U.S. Patent Appl. Publ. No. US20130172406.

In another embodiment, the stealth or target-specific stealth nanoparticles comprise a polymeric matrix. The polymeric matrix can comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In one embodiment, the nanoparticle is a nanoparticle-nucleic acid hybrid structure having a high density nucleic acid layer. As a non-limiting example, the nanoparticle-nucleic acid hybrid structure is made by the methods described in US Patent Appl. Publ. No. US20130171646. The nanoparticle can comprise a nucleic acid such as, but not limited to, polynucleotides described herein and/or known in the art.

At least one of the nanoparticles of the present disclosure can be embedded in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013123523. See also U.S. Patent Appl. Publ. No. US20150037249, which is herein incorporated by reference in its entirety.

Hyaluronidase

The intramuscular, intratumoral, or subcutaneous localized injection of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can include hyaluronidase, which catalyzes the hydrolysis of hyaluronan.

By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440). It is useful to speed their dispersion and systemic distribution of encoded proteins produced by transfected cells. Alternatively, the hyaluronidase can be used to increase the number of cells exposed to a polynucleotide of the disclosure administered intramuscularly, intratumorally, or subcutaneously.

Nanoparticle Mimics

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the polynucleotides of the disclosure can be encapsulated in a non-virion particle which can mimic the delivery function of a virus (see International Pub. No. WO2012006376 and U.S. Patent Appl. Publ. Nos. US20130171241 and US20130195968).

Nanotubes

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be attached or otherwise bound to at least one nanotube such as, but not limited to, rosette nanotubes, rosette nanotubes having twin bases with a linker, carbon nanotubes and/or single-walled carbon nanotubes. The polynucleotides can be bound to the nanotubes through forces such as, but not limited to, steric, ionic, covalent and/or other forces. Nanotubes and nanotube formulations comprising polynucleotides are described in International Patent Application No. PCT/US2014/027077 (published as WO2014152211).

Self-Assembled Nanoparticles

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in self-assembled nanoparticles. Nucleic acid self-assembled nanoparticles are described in International Patent Application No. PCT/US2014/027077 (published as WO2014152211), such as in paragraphs [000740]-[000743]. Polymer-based self-assembled nanoparticles are described in International Patent Application No. PCT/US2014/027077. See also U.S. Patent Appl. Publ. No. US20160038612, which is herein incorporated by reference in its entirety.

Self-Assembled Macromolecules

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in amphiphilic macromolecules (AMs) for delivery. AMs comprise biocompatible amphiphilic polymers which have an alkylated sugar backbone covalently linked to poly(ethylene glycol). In aqueous solution, the AMs self-assemble to form micelles. Non-limiting examples of methods of forming AMs and AMs are described in U.S. Patent Appl. Publ. No. US20130217753.

Inorganic Nanoparticles

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in inorganic nanoparticles (U.S. Pat. No. 8,257,745). The inorganic nanoparticles can include, but are not limited to, clay substances that are water swellable. As a non-limiting example, the inorganic nanoparticle include synthetic smectite clays which are made from simple silicates (See e.g., U.S. Pat. Nos. 5,585,108 and 8,257,745).

In some embodiments, the inorganic nanoparticles comprises a core of the polynucleotides disclosed herein and a polymer shell. The polymer shell can be any of the polymers described herein and are known in the art. In an additional embodiment, the polymer shell can be used to protect the polynucleotides in the core.

Semi-Conductive and Metallic Nanoparticles

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in water-dispersible nanoparticle comprising a semiconductive or metallic material (U.S. Patent Appl. Publ. No. US20120228565) or formed in a magnetic nanoparticle (U.S. Patent Appl. Publ. No. US20120265001 and US20120283503). The water-dispersible nanoparticles can be hydrophobic nanoparticles or hydrophilic nanoparticles.

In some embodiments, the semi-conductive and/or metallic nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

Surgical Sealants: Gels and Hydrogels

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, are encapsulated into any hydrogel known in the art which forms a gel when injected into a subject. Surgical sealants such as gels and hydrogels are described in International Patent Application No. PCT/US2014/027077.

Suspension Formulations

In some embodiments, suspension formulations are provided comprising polynucleotides, water immiscible oil depots, surfactants and/or co-surfactants and/or co-solvents. Combinations of oils and surfactants can enable suspension formulation with polynucleotides. Delivery of polynucleotides in a water immiscible depot can be used to improve bioavailability through sustained release of mRNA from the depot to the surrounding physiologic environment and prevent polynucleotides degradation by nucleases.

In some embodiments, suspension formulations of mRNA are prepared using combinations of polynucleotides, oil-based solutions and surfactants. Such formulations can be prepared as a two-part system comprising an aqueous phase comprising polynucleotides and an oil-based phase comprising oil and surfactants. Exemplary oils for suspension formulations can include, but are not limited to sesame oil and Miglyol (comprising esters of saturated coconut and palm kernel oil-derived caprylic and capric fatty acids and glycerin or propylene glycol), corn oil, soybean oil, peanut oil, beeswax and/or palm seed oil. Exemplary surfactants can include, but are not limited to Cremophor, polysorbate 20, polysorbate 80, polyethylene glycol, transcutol, CAPMUL®, labrasol, isopropyl myristate, and/or Span 80. In some embodiments, suspensions can comprise co-solvents including, but not limited to ethanol, glycerol and/or propylene glycol.

Suspensions can be formed by first preparing polynucleotides formulation comprising an aqueous solution of polynucleotide and an oil-based phase comprising one or more surfactants. Suspension formation occurs as a result of mixing the two phases (aqueous and oil-based). In some embodiments, such a suspension can be delivered to an aqueous phase to form an oil-in-water emulsion. In some embodiments, delivery of a suspension to an aqueous phase results in the formation of an oil-in-water emulsion in which the oil-based phase comprising polynucleotides forms droplets that can range in size from nanometer-sized droplets to micrometer-sized droplets. In some embodiments, specific combinations of oils, surfactants, cosurfactants and/or co-solvents can be utilized to suspend polynucleotides in the oil phase and/or to form oil-in-water emulsions upon delivery into an aqueous environment.

In some embodiments, suspensions provide modulation of the release of polynucleotides into the surrounding environment. In such embodiments, polynucleotides release can be modulated by diffusion from a water immiscible depot followed by resolubilization into a surrounding environment (e.g. an aqueous environment).

In some embodiments, polynucleotides within a water immiscible depot (e.g. suspended within an oil phase) result in altered polynucleotides stability (e.g. altered degradation by nucleases).

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated such that upon injection, an emulsion forms spontaneously (e.g. when delivered to an aqueous phase). Such particle formation can provide a high surface area to volume ratio for release of polynucleotides from an oil phase to an aqueous phase.

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a nanoemulsion such as, but not limited to, the nanoemulsions described in U.S. Pat. No. 8,496,945. The nanoemulsions can comprise nanoparticles described herein. As a non-limiting example, the nanoparticles can comprise a liquid hydrophobic core which can be surrounded or coated with a lipid or surfactant layer. The lipid or surfactant layer can comprise at least one membrane-integrating peptide and can also comprise a targeting ligand (see, e.g., U.S. Pat. No. 8,496,945).

Cations and Anions

Formulations of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can include cations or anions. In some embodiments, the formulations include metal cations such as, but not limited to, $Zn^{2+}$, $Ca^{2+}$, $Cu^{2+}$, $Mg^{2+}$ and combinations thereof. As a non-limiting example, formulations include polymers and a polynucleotides complexed with a metal cation (see, e.g., U.S. Pat. Nos. 6,265,389 and 6,555,525).

In some embodiments, cationic nanoparticles comprising combinations of divalent and monovalent cations are formulated with polynucleotides. Such nanoparticles can form spontaneously in solution over a given period (e.g. hours, days, etc). Such nanoparticles do not form in the presence of divalent cations alone or in the presence of monovalent cations alone. The delivery of polynucleotides in cationic nanoparticles or in one or more depot comprising cationic nanoparticles can improve polynucleotide bioavailability by acting as a long-acting depot and/or reducing the rate of degradation by nucleases.

Molded Nanoparticles and Microparticles a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in nanoparticles and/or microparticles. As an example, the nanoparticles and/or microparticles can be made using the PRINT® technology by LIQUIDA TECHNOLOGIES® (Morrisville, N.C.) (see, e.g., International Pub. No. WO2007024323).

In some embodiments, the nanoparticles comprise a core of the polynucleotides disclosed herein and a polymer shell.

The polymer shell can be any of the polymers described herein and are known in the art. In an additional embodiment, the polymer shell can be used to protect the polynucleotides in the core.

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in microparticles. The microparticles can contain a core of the polynucleotides and a cortex of a biocompatible and/or biodegradable polymer. As a non-limiting example, the microparticles which can be used with the present disclosure can be those described in U.S. Pat. No. 8,460,709, U.S. Patent Appl. Publ. No. US20130129830 and International Patent Publication No WO2013075068. As another non-limiting example, the microparticles can be designed to extend the release of the polynucleotides of the present disclosure over a desired period of time (see e.g, extended release of a therapeutic protein in U.S. Patent Appl. Publ. No. US20130129830).

NanoJackets and NanoLiposomes

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in NanoJackets and NanoLiposomes by Keystone Nano (State College, Pa.). NanoJackets are made of compounds that are naturally found in the body including calcium, phosphate and can also include a small amount of silicates. Nanojackets can range in size from 5 to 50 nm and can be used to deliver hydrophilic and hydrophobic compounds such as, but not limited to, polynucleotides.

NanoLiposomes are made of lipids such as, but not limited to, lipids which naturally occur in the body. NanoLiposomes can range in size from 60-80 nm and can be used to deliver hydrophilic and hydrophobic compounds such as, but not limited to, polynucleotides. In one aspect, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a NanoLiposome such as, but not limited to, Ceramide NanoLiposomes.

Minicells

In one aspect, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in bacterial minicells. As a non-limiting example, bacterial minicells are those described in International Publication No. WO2013088250 or U.S. Patent Publication No. US20130177499. The bacterial minicells comprising therapeutic agents such as polynucleotides described herein can be used to deliver the therapeutic agents to brain tumors.

Semi-Solid Compositions

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated with a hydrophobic matrix to form a semi-solid composition. As a non-limiting example, the semi-solid composition or paste-like composition is made by the methods described in International Patent Publication No. WO201307604. The semi-solid composition can be a sustained release formulation as described in International Patent Publication No. WO0201307604.

In another embodiment, the semi-solid composition further has a micro-porous membrane or a biodegradable polymer formed around the composition (see e.g., International Patent Publication No. WO201307604).

The semi-solid composition using a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can have the characteristics of the semi-solid mixture as described in International Patent Publication No WO201307604 (e.g., a modulus of elasticity of at least $10^{-4}$ N·mm$^{-2}$, and/or a viscosity of at least 100mPa·s).

Exosomes

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in exosomes. The exosomes can be loaded with at least one polynucleotide and delivered to cells, tissues and/or organisms. As a non-limiting example, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be loaded in the exosomes described in International Publication No. WO2013084000.

Silk-Based Delivery

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in a sustained release silk-based delivery system. The silk-based delivery system can be formed by contacting a silk fibroin solution with a therapeutic agent such as, but not limited to, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof. As a non-limiting example, the sustained release silk-based delivery system which can be used in the present disclosure and methods of making such system are described in U.S. Patent Publication No. 20130177611.

Microparticles

In some embodiments, formulations comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, comprise microparticles. The microparticles can comprise a polymer described herein and/or known in the art such as, but not limited to, poly(a-hydroxy acid), a polyhydroxy butyric acid, a polycaprolactone, a polyorthoester and a polyanhydride. The microparticle can have adsorbent surfaces to adsorb biologically active molecules such as polynucleotides. As a non-limiting example microparticles for use with the present disclosure and methods of making microparticles are described in U.S. Patent Publication No. US2013195923 and US20130195898 and U.S. Pat. Nos. 8,309,139 and 8,206,749.

In another embodiment, the formulation is a microemulsion comprising microparticles and polynucleotides. As a non-limiting example, microemulsions comprising microparticles are described in U.S. Patent Publication Nos. 2013195923 and 20130195898 and U.S. Pat. Nos. 8,309,139 and 8,206,749.

Amino Acid Lipids

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in amino acid lipids. Amino acid lipids are lipophilic compounds comprising an amino acid residue and one or more lipophilic tails. Non-limiting examples of amino acid lipids and methods of making amino acid lipids are described in U.S. Pat. No. 8,501,824.

In some embodiments, the amino acid lipids have a hydrophilic portion and a lipophilic portion. The hydrophilic portion can be an amino acid residue and a lipophilic portion can comprise at least one lipophilic tail.

In some embodiments, the amino acid lipid formulations are used to deliver the polynucleotides to a subject.

In another embodiment, the amino acid lipid formulations deliver a polynucleotide in releasable form which comprises an amino acid lipid that binds and releases the polynucleotides. As a non-limiting example, the release of the polynucleotides can be provided by an acid-labile linker such as, but not limited to, those described in U.S. Pat. Nos. 7,098,032, 6,897,196, 6,426,086, 7,138,382, 5,563,250, and 5,505,931.

Microvesicles

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in microvesicles. Non-limiting examples of microvesicles include those described in US20130209544.

In some embodiments, the microvesicle is an ARRDC1-mediated microvesicles (ARMMs). Non-limiting examples of ARMMs and methods of making ARMMs are described in International Patent Publication No. WO2013119602.

Interpolyelectrolyte Complexes

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368.

Crystalline Polymeric Systems

In some embodiments, a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be formulated a crystalline polymeric system.

Crystalline polymeric systems are polymers with crystalline moieties and/or terminal units comprising crystalline moieties. Non-limiting examples of polymers with crystalline moieties and/or terminal units comprising crystalline moieties termed "CYC polymers," crystalline polymer systems and methods of making such polymers and systems are described in U.S. Pat. No. 8,524,259.

Excipients

Pharmaceutical formulations can additionally comprise a pharmaceutically acceptable excipient, which, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants, flavoring agents, stabilizers, antioxidants, osmolality adjusting agents, pH adjusting agents and the like, as suited to the particular dosage form desired. Various excipients for formulating pharmaceutical compositions and techniques for preparing the composition are known in the art (see *Remington: The Science and Practice of Pharmacy*, $21^{st}$ Edition, A. R. Gennaro (Lippincott, Williams & Wilkins, Baltimore, Md., 2006). The use of a conventional excipient medium can be contemplated within the scope of the present disclosure, except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

In some embodiments, a pharmaceutically acceptable excipient is at least 95%, at least 96%, at least 97%, at least 98%, at least 99%, or 100% pure. In some embodiments, an excipient is approved for use for humans and for veterinary use. In some embodiments, an excipient can be approved by United States Food and Drug Administration. In some embodiments, an excipient can be of pharmaceutical grade. In some embodiments, an excipient can meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients can optionally be included in pharmaceutical compositions. The composition can also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate [SPAN®60], sorbitan tristearate [SPAN®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly (vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); amino acids (e.g., glycine); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives can include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

In some embodiments, the pH of polynucleotide solutions is maintained between pH 5 and pH 8 to improve stability. Exemplary buffers to control pH can include, but are not limited to sodium phosphate, sodium citrate, sodium succinate, histidine (or histidine-HCl), sodium carbonate, and/or sodium malate. In another embodiment, the exemplary buffers listed above can be used with additional monovalent counterions (including, but not limited to potassium). Divalent cations can also be used as buffer counterions; however, these are not preferred due to complex formation and/or mRNA degradation.

Exemplary buffering agents can also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, *litsea cubeba*, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Cryoprotectants for mRNA

In some embodiments, the polynucleotide formulations comprise cryoprotectants. As used herein, the term "cryoprotectant" refers to one or more agent that when combined with a given substance, helps to reduce or eliminate damage to that substance that occurs upon freezing. In some embodiments, cryoprotectants are combined with polynucleotides in order to stabilize them during freezing. Frozen storage of mRNA between −20° C. and −80° C. can be advantageous for long term (e.g. 36 months) stability of polynucleotide. In some embodiments, cryoprotectants are included in polynucleotide formulations to stabilize polynucleotide through freeze/thaw cycles and under frozen storage conditions. Cryoprotectants of the present disclosure can include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

In some embodiments, the polynucleotide formulations comprise bulking agents. As used herein, the term "bulking agent" refers to one or more agents included in formulations to impart a desired consistency to the formulation and/or stabilization of formulation components. In some embodiments, bulking agents are included in lyophilized polynucleotide formulations to yield a "pharmaceutically elegant" cake, stabilizing the lyophilized polynucleotides during long term (e.g. 36 month) storage. Bulking agents of the present disclosure can include, but are not limited to sucrose, trehalose, mannitol, glycine, lactose and/or raffinose. In some embodiments, combinations of cryoprotectants and bulking agents (for example, sucrose/glycine or trehalose/mannitol) can be included to both stabilize polynucleotides during freezing and provide a bulking agent for lyophilization.

Non-limiting examples of formulations and methods for formulating the polynucleotides of the present disclosure are also provided in International Publication No WO2013090648 filed Dec. 14, 2012.

Naked Delivery

A polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be delivered to a cell (e.g., to a tumor cell) naked. As used herein in, "naked" refers to delivering polynucleotides free from agents which promote transfection. For example, the polynucleotides delivered to the cell, e.g., tumor cell, can contain no modifications.

The naked polynucleotides comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, can be delivered to the tumor cell using routes of administration known in the art, e.g., intratumoral administration, and described herein.

Parenteral and Injectable Administration

Liquid dosage forms for parenteral administration, e.g. intratumoral, include, but are not limited to, pharmaceutically acceptable emulsions, microemulsions, solutions, suspensions, syrups, and/or elixirs. In addition to active ingredients, liquid dosage forms can comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration, e.g., intratumoral administration, can comprise at least one inactive ingredient. Any or none of the inactive ingredients used can have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions can be formulated according to the known art using suitable dispersing agents, wetting agents, and/or suspending agents. Sterile injectable preparations can be sterile injectable solutions, suspensions, and/or emulsions in nontoxic parenterally acceptable diluents and/or solvents, for example, as a solution in 1,3-butanediol. Among the acceptable vehicles and solvents that can be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation can also comprise adjuvants such as local anesthetics, preservatives and buffering agents.

Injectable formulations, e.g., intratumoral, can be sterilized, for example, by filtration through a bacterial-retaining filter, and/or by incorporating sterilizing agents in the form of sterile solid compositions which can be dissolved or dispersed in sterile water or other sterile injectable medium prior to use.

Injectable formulations, e.g., intratumoral, can be for direct injection into a region of a tissue, organ and/or subject, e.g., tumor.

In order to prolong the effect of an active ingredient, it is often desirable to slow the absorption of the active ingredient from intratumoral injection. This can be accomplished by the use of a liquid suspension of crystalline or amorphous material with poor water solubility. The rate of absorption of the drug then depends upon its rate of dissolution which, in turn, can depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Dosage Forms

A pharmaceutical composition described herein can be formulated into a dosage form described herein, such as a topical, intranasal, intratracheal, or injectable (e.g., intravenous, intratumoral, intraocular, intravitreal, intramuscular, intracardiac, intraperitoneal, subcutaneous).

Liquid Dosage Forms

Liquid dosage forms for parenteral administration (e.g., intratumoral) include, but are not limited to, pharmaceutically acceptable emulsions, microemulsions, solutions, suspensions, syrups, and/or elixirs. In addition to active ingredients, liquid dosage forms can comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions can be mixed with solubilizing agents such as CREMOPHOR®, alcohols, oils, modified oils, glycols, polysorbates, cyclodextrins, polymers, and/or combinations thereof.

Injectable

Injectable preparations (e.g., intratumoral), for example, sterile injectable aqueous or oleaginous suspensions can be formulated according to the known art and can include suitable dispersing agents, wetting agents, and/or suspending agents. Sterile injectable preparations can be sterile injectable solutions, suspensions, and/or emulsions in nontoxic parenterally acceptable diluents and/or solvents, for example, a solution in 1,3-butanediol. Among the acceptable vehicles and solvents that can be employed include, but are not limited to, water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it can be desirable to slow the absorption of the active ingredient from subcutaneous or intramuscular injection. This can be accomplished by the use of a liquid suspension of crystalline or amorphous material with poor water solubility. The rate of absorption of the polynucleotides then depends upon its rate of dissolution which, in turn, can depend upon crystal size and crystalline form. Alternatively, delayed absorption of a parenterally administered polynucleotides can be accomplished by dissolving or suspending the polynucleotides in an oil vehicle. Injectable depot forms are made by forming microencapsule matrices of the polynucleotides in biodegradable polymers such as polylactide-polyglycolide. Depending upon the ratio of polynucleotides to polymer and the nature of the particular polymer employed, the rate of polynucleotides release can be controlled. Examples of other biodegradable polymers include, but are not limited to, poly(orthoesters) and poly(anhydrides). Depot injectable formulations can be prepared by entrapping the polynucleotides in liposomes or microemulsions which are compatible with body tissues.

Methods of Intratumoral Delivery

The pharmaceutical compositions disclosed herein are suitable for administration to tumors. The term "tumor" is used herein in a broad sense and refers to any abnormal new growth of tissue that possesses no physiological function and arises from uncontrolled usually rapid cellular proliferation. The term "tumor" as used herein relates to both benign tumors and to malignant tumors.

In certain embodiments, the disclosure provides a method of delivering a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, to a tumor comprising formulating the polynucleotide in the pharmaceutical composition described herein, e.g., in lipid nanoparticle form, and administering the pharmaceutical composition to a tumor. The administration of the pharmaceutical composition to the tumor can be performed using any method known in the art (e.g., bolus injection, perfusion, surgical implantation, etc.).

The delivery of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, alone or in combination, to a tumor using a pharmaceutical compositions for intratumoral administration disclosed herein can:

(i) increase the retention of the polynucleotide in the tumor;

(ii) increase the levels of expressed polypeptide in the tumor compared to the levels of expressed polypeptide in peritumoral tissue;

(iii) decrease leakage of the polynucleotide or expressed product to off-target tissue (e.g., peritumoral tissue, or to distant locations, e.g., liver tissue); or, (iv) any combination thereof, wherein the increase or decrease observed for a certain property is relative to a corresponding reference composition (e.g., composition in which compounds of formula (I) are not present or have been substituted by another ionizable amino lipid, e.g., MC3).

In one embodiment, a decrease in leakage can be quantified as increase in the ratio of polypeptide expression in the tumor to polypeptide expression in non-tumor tissues, such as peritumoral tissue or to another tissue or organ, e.g., liver tissue.

Delivery of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, to a tumor involves administering a pharmaceutical composition disclosed herein, e.g., in nanoparticle form, including the polynucleotide or combination thereof to a subject, where administration of the pharmaceutical composition involves contacting the tumor with the composition.

In the instance that the polynucleotide of any of the combination therapies disclosed herein (e.g., an mRNA encoding an immune response primer polypeptide, an mRNA encoding an immune response co-stimulatory signal polypeptide, an mRNA encoding a checkpoint inhibitor polypeptide, or a combination thereof) is an mRNA or a combination thereof, upon contacting a cell in the tumor with the pharmaceutical composition, a translatable mRNA (or translatable mRNAs) can be translated in the cell to produce a polypeptide (or polypeptides) of interest. However, mRNAs that are substantially not translatable may also be delivered to tumors. Substantially non-translatable mRNAs may be useful as vaccines and/or may sequester translational components of a cell to reduce expression of other species in the cell.

The pharmaceutical compositions disclosed herein can increase specific delivery. As used herein, the term "specific delivery," means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, by pharmaceutical composition disclosed herein (e.g., in nanoparticle form) to a target tissue of interest (e.g., a tumor) compared to an off-target tissue (e.g., mammalian liver).

The level of delivery of a nanoparticle to a particular tissue may be measured, for example, by comparing (i) the amount of protein expressed from a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, in a tissue to the weight of said tissue;

(ii) comparing the amount of the polynucleotide in a tissue to the weight of said tissue; or (iii) comparing the amount of protein expressed from a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, in a tissue to the amount of total protein in said tissue.

Specific delivery to a tumor or a particular class of cells in the tumor implies that a higher proportion of pharmaceutical composition including a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is delivered to the target destination (e.g., target tissue) relative to other off-target destinations upon administration of a pharmaceutical composition to a subject.

Methods for Improved Intratumoral Delivery

The present disclosure also provides methods to achieve improved intratumoral delivery of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, when a pharmaceutical composition disclosed herein (e.g., in nanoparticle form) is administered to a tumor. The improvement in delivery can be due, for example, to (i) increased retention of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, in the tumor;

(ii) increased levels of expressed polypeptide (e.g., immune response primer polypeptide, immune response co-stimulatory signal polypeptide, checkpoint inhibitor polypeptide, or a combination thereof) in the tumor compared to the levels of expressed polypeptide in peritumoral tissue;

(iii) decreased leakage of the polynucleotide or expressed product of to off-target tissue (e.g., peritumoral tissue, or to distant locations, e.g., liver tissue); or, (iv) any combination thereof, wherein the increase or decrease observed for a certain property is relative to a corresponding reference composition (e.g., composition in which compounds of formula (I) are not present or have been substituted by another ionizable amino lipid, e.g., MC3).

In one embodiment, a decrease in leakage can be quantified as increase in the ratio of polypeptide expression in the tumor to polypeptide expression in non-tumor tissues, such as peritumoral tissue or to another tissue or organ, e.g., liver tissue.

Another improvement in delivery caused as a result of using the pharmaceutical compositions disclosed herein is a reduction in immune response with respect to the immune response observed when other lipid components are used to deliver the same a therapeutic agent or polynucleotide encoding a therapeutic agent.

Accordingly, the present disclosure provides a method of increasing retention of a therapeutic agent (e.g., a polypeptide administered as part of the pharmaceutical composition) in a tumor tissue in a subject, comprising administering intratumorally to the tumor tissue a pharmaceutical composition disclosed herein, wherein the retention of the therapeutic agent in the tumor tissue is increased compared to the retention of the therapeutic agent in the tumor tissue after administering a corresponding reference composition.

Also provided is a method of increasing retention of a polynucleotide in a tumor tissue in a subject, comprising administering intratumorally to the tumor tissue a pharmaceutical composition disclosed herein, wherein the retention of the polynucleotide in the tumor tissue is increased compared to the retention of the polynucleotide in the tumor tissue after administering a corresponding reference composition.

Also provided is a method of increasing retention of an expressed polypeptide in a tumor tissue in a subject, comprising administering to the tumor tissue a pharmaceutical composition disclosed herein, wherein the pharmaceutical composition comprises a polynucleotide encoding the expressed polypeptide, and wherein the retention of the expressed polypeptide in the tumor tissue is increased compared to the retention of the polypeptide in the tumor tissue after administering a corresponding reference composition.

The present disclosure also provides a method of decreasing expression leakage of a polynucleotide administered intratumorally to a subject in need thereof, comprising administering said polynucleotide intratumorally to the tumor tissue as a pharmaceutical composition disclosed herein, wherein the expression level of the polypeptide in non-tumor tissue is decreased compared to the expression level of the polypeptide in non-tumor tissue after administering a corresponding reference composition.

Also provided is a method of decreasing expression leakage of a therapeutic agent (e.g., a polypeptide administered as part of the pharmaceutical composition) administered intratumorally to a subject in need thereof, comprising administering said therapeutic agent intratumorally to the tumor tissue as a pharmaceutical composition disclosed herein, wherein the amount of therapeutic agent in non-tumor tissue is decreased compared to the amount of therapeutic in non-tumor tissue after administering a corresponding reference composition.

Also provided is a method of decreasing expression leakage of an expressed polypeptide in a tumor in a subject, comprising administering to the tumor tissue a pharmaceutical composition disclosed herein, wherein the pharmaceutical composition comprises a polynucleotide encoding the expressed polypeptide, and wherein the amount of expressed polypeptide in non-tumor tissue is decreased compared to the amount of expressed polypeptide in non-tumor tissue after administering a corresponding reference composition.

In some embodiments, the non-tumoral tissue is peritumoral tissue. In other embodiments, the non-tumoral tissue is liver tissue.

The present disclosure also provided a method to reduce or prevent the immune response caused by the intratumoral administration of a pharmaceutical composition, e.g., a pharmaceutical composition comprising lipids known in the art, by replacing one or all the lipids in such composition with a compound of Formula (I). For example, the immune response caused by the administration of a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, in a pharmaceutical composition comprising MC3 (or other lipids known in the art) can be prevented (avoided) or ameliorated by replacing MC3 with a compound of Formula (I), e.g., Compound 18.

In some embodiments, the immune response observed after a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is administered in a pharmaceutical composition disclosed herein is not elevated compared to the immune response observed when the therapeutic agent or polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is administered in phosphate buffered saline (PBS) or another physiological buffer solution (e.g., Ringer's solution, Tyrode's solution, Hank's balanced salt solution, etc.).

In some embodiments, the immune response observed after a therapeutic agent or a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, is administered in a pharmaceutical composition disclosed herein is not elevated compared to the immune response observed when PBS or another physiological buffer solution is administered alone.

In some embodiments, no immune response is observed when a pharmaceutical composition disclosed herein is administered intratumorally to a subject.

Accordingly, the present disclosure also provides a method of delivering a therapeutic agent or a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, to a subject in need thereof, comprising administering intratumorally to the subject a pharmaceutical composition disclosed herein, wherein the immune response caused by the administration of the pharmaceutical composition is not elevated compared to the immune response caused by the intratumoral administration of (i) PBS alone, or another physiological buffer solution (e.g., Ringer's solution, Tyrode's solution, Hank's balanced salt solution, etc.);

(ii) the therapeutic agent or a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, in PBS or another physiological buffer solution; or the therapeutic agent or a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof in PBS or another physiological buffer solution; or, (iii) a corresponding reference composition, i.e., the same pharmaceutical composition in which the compound of Formula (I) is substituted by another ionizable amino lipid, e.g., MC3.

XII. KITS AND DEVICES

Kits

The disclosure provides a variety of kits for conveniently and/or effectively carrying out methods or compositions of the present disclosure. Typically kits will comprise sufficient amounts and/or numbers of components to allow a user to perform multiple treatments of a subject(s) and/or to perform multiple experiments.

In one aspect, the present disclosure provides kits comprising the polynucleotides of the disclosure. In some embodiments, the kit comprises one or more polynucleotides.

The kits can be for protein production, comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof. The kit can further comprise packaging and instructions and/or a delivery agent to form a formulation composition. The delivery agent can comprise a saline, a buffered solution, a lipidoid or any delivery agent disclosed herein.

In some embodiments, the buffer solution includes sodium chloride, calcium chloride, phosphate and/or EDTA. In another embodiment, the buffer solution includes, but is not limited to, saline, saline with 2 mM calcium, 5% sucrose, 5% sucrose with 2 mM calcium, 5% mannitol, 5% mannitol with 2 mM calcium, Ringer's lactate, sodium chloride, sodium chloride with 2 mM calcium and mannose (See e.g., U.S. Pub. No. 20120258046). In a further embodiment, the buffer solutions is precipitated or it is lyophilized. The amount of each component can be varied to enable consistent, reproducible higher concentration saline or simple buffer formulations. The components can also be varied in order to increase the stability of modified RNA in the buffer solution over a period of time and/or under a variety of conditions. In one aspect, the present disclosure provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present disclosure provides kits for protein production, comprising a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof, wherein the polynucleotides exhibits reduced degradation by a cellular nuclease, and packaging and instructions.

Devices

The present disclosure provides for devices which can incorporate a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof. For example, the device can incorporate a polynucleotide comprising an mRNA encoding an immune response primer polypeptide, a polynucleotide comprising an mRNA encoding an immune response co-stimulatory signal polypeptide, a polynucleotide comprising an mRNA encoding a checkpoint inhibitor polypeptide, or any combination thereof. These devices contain in a stable formulation the reagents to synthesize a polynucleotide in a formulation available to be immediately delivered to a subject in need thereof, such as a human patient.

Devices for administration can be employed to deliver a polynucleotide of any of the combination therapies disclosed herein, e.g., an mRNA encoding an immune response primer polypeptide, an mRNA encoding an immune response co-stimulatory signal polypeptide, an mRNA encoding a checkpoint inhibitor polypeptide, or a combination thereof according to single, multi- or split-dosing regimens taught herein. Such devices are taught in, for example, International Publication No. WO 2013151666 A2.

Method and devices known in the art for multi-administration to cells, organs and tissues are contemplated for use in conjunction with the methods and compositions disclosed herein as embodiments of the present disclosure. These include, for example, those methods and devices having multiple needles, hybrid devices employing for example lumens or catheters as well as devices utilizing heat, electric current or radiation driven mechanisms.

According to the present disclosure, these multi-administration devices can be utilized to deliver the single, multi- or split doses contemplated herein. Such devices are taught for example in, International Publication No. WO 2013151666 A2.

XIII. EQUIVALENTS AND SCOPE

Those skilled in the art will recognize, or be able to ascertain using no more than routine experimentation, many equivalents to the specific embodiments in accordance with the disclosure described herein. The scope of the present disclosure is not intended to be limited to the above Description, but rather is as set forth in the appended claims.

In the claims, articles such as “a,” “an,” and “the” may mean one or more than one unless indicated to the contrary or otherwise evident from the context. Claims or descriptions that include “or” between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

It is also noted that the term “comprising” is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

In addition, it is to be understood that any particular embodiment of the present disclosure that falls within the prior art can be explicitly excluded from any one or more of the claims. Since such embodiments are deemed to be known to one of ordinary skill in the art, they can be excluded even if the exclusion is not set forth explicitly herein. Any particular embodiment of the compositions of the disclosure (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1

Synthesis of Compounds According to Formula (I)

A. General Considerations

All solvents and reagents used were obtained commercially and used as such unless noted otherwise. $^{1}H$ NMR spectra were recorded in $CDCl_3$, at 300 K using a Bruker Ultrashield 300 MHz instrument. Chemical shifts are reported as parts per million (ppm) relative to TMS (0.00) for $^{1}H$. Silica gel chromatographies were performed on ISCO CombiFlash Rf+ Lumen Instruments using ISCO RediSep Rf Gold Flash Cartridges (particle size: 20-40 microns). Reverse phase chromatographies were performed on ISCO CombiFlash Rf+ Lumen Instruments using RediSep Rf Gold C18 High Performance columns. All final compounds were determined to be greater than 85% pure via analysis by reverse phase UPLC-MS (retention times, RT, in minutes) using Waters Acquity UPLC instrument with DAD and ELSD and a ZORBAX Rapid Resolution High Definition (RRHD) SB-C18 LC column, 2.1 mm, 50 mm, 1.8 μm, and a gradient of 65 to 100% acetonitrile in water with 0.1% TFA over 5 minutes at 1.2 mL/min. Injection volume was 5 μL and the column temperature was 80° C. Detection was based on electrospray ionization (ESI) in positive mode using Waters SQD mass spectrometer (Milford, Mass., USA) and evaporative light scattering detector.

The representative procedures described below are useful in the synthesis of Compounds 1-147.

The following abbreviations are employed herein:

THF: Tetrahydrofuran

DMAP: 4-Dimethylaminopyridine

LDA: Lithium Diisopropylamide rt: Room Temperature

DME: 1,2-Dimethoxyethane n-BuLi: n-Butyllithium

B. Compound 2: Heptadecan-9-yl 8-((2-hydroxyethyl)(tetradecyl)amino) octanoate Representative Procedure 1

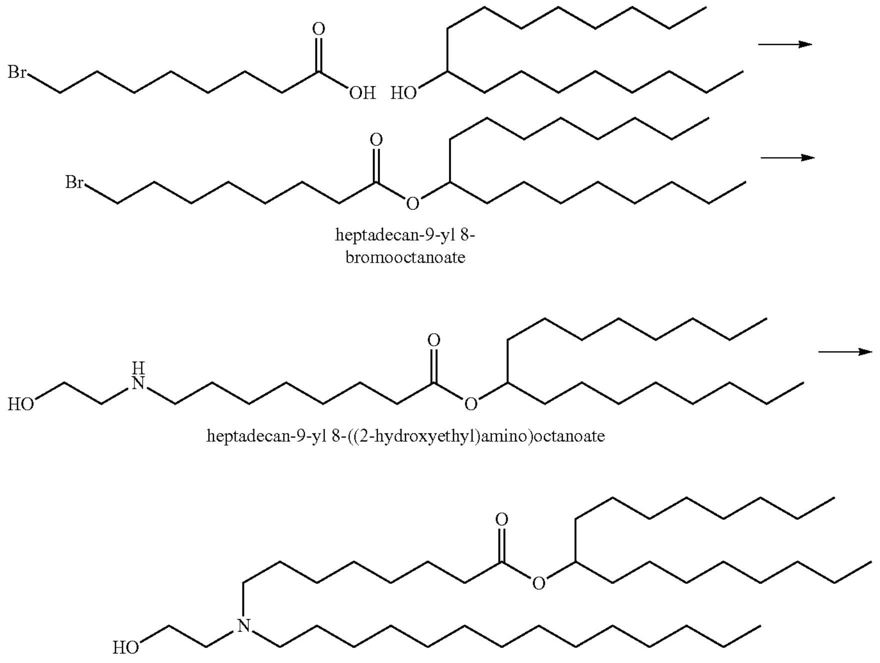

heptadecan-9-yl 8-bromooctanoate heptadecan-9-yl 8-((2-hydroxyethyl)amino)octanoate heptadecan-9-yl 8-((2-hydroxyethyl)(tetradecyl)amino)octanoate Heptadecan-9-yl 8-bromooctanoate (Method A)

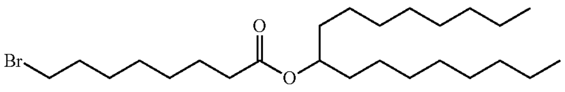 [SMILES: CCCCCCCCC(CCCCCCCC)OC(=O)CCCCCCCBr]

To a solution of 8-bromooctanoic acid (1.04 g, 4.6 mmol) and heptadecan-9-ol (1.5 g, 5.8 mmol) in dichloromethane (20 mL) was added N-(3-dimethylaminopropyl)-N'-ethyl-carbodiimide hydrochloride (1.1 g, 5.8 mmol), N,N-diisopropylethylamine (3.3 mL, 18.7 mmol) and DMAP (114 mg, 0.9 mmol). The reaction was allowed to stir at rt for 18 h. The reaction was diluted with dichloromethane and washed with saturated sodium bicarbonate. The organic layer was separated and washed with brine, and dried over $MgSO_4$. The organic layer was filtered and evaporated in vacuo. The residue was purified by silica gel chromatography (0-10% ethyl acetate in hexanes) to obtain heptadecan-9-yl 8-bromooctanoate (875 mg, 1.9 mmol, 41%).

$^1H$ NMR (300 MHz, $CDCl_3$) δ: ppm 4.89 (m, 1H); 3.42 (m, 2H); 2.31 (m, 2H); 1.89 (m, 2H); 1.73-1.18 (br. m, 36H); 0.88 (m, 6H).

Heptadecan-9-yl 8-((2-hydroxyethyl)amino)octanoate (Method B)

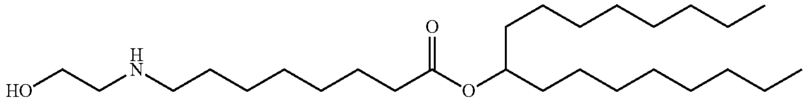 [SMILES: CCCCCCCCC(CCCCCCCC)OC(=O)CCCCCCCNCCO]

A solution of heptadecan-9-yl 8-bromooctanoate (3.8 g, 8.2 mmol) and 2-aminoethan-1-ol (15 mL, 248 mmol) in ethanol (3 mL) was allowed to stir at 62° C. for 18 h. The reaction mixture was concentrated in vacuo and the residue was taken-up in ethyl acetate and water. The organic layer was separated and washed with water, brine and dried over $Na_2SO_4$. The mixture was filtered and evaporated in vacuo. The residue was purified by silica gel chromatography (0-100% (mixture of 1% $NH_4OH$, 20% MeOH in dichloromethane) in dichloromethane) to obtain heptadecan-9-yl 8-((2-hydroxyethyl)amino)octanoate (3.1 g, 7 mmol, 85%). UPLC/ELSD: RT=2.67 min. MS (ES): m/z ($MH^+$) 442.68 for $C_{27}H_{55}NO_3$ $^1H$ NMR (300 MHz, $CDCl_3$) δ: ppm 4.89 (p, 1H); 3.67 (t, 2H); 2.81 (t, 2H); 2.65 (t, 2H); 2.30 (t, 2H); 2.05 (br. m, 2H); 1.72-1.41 (br. m, 8H); 1.40-1.20 (br. m, 30H); 0.88 (m, 6H).

Heptadecan-9-yl 8-((2-hydroxyethyl)(tetradecyl)amino)octanoate (Method C)

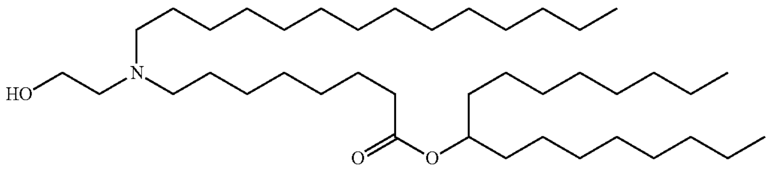 [SMILES: CCCCCCCCCCCCCCN(CCO)CCCCCCCC(=O)OC(CCCCCCCC)CCCCCCCC]

Chemical Formula: $C_{41}H_{83}NO_3$—Molecular Weight: 638.12

A solution of heptadecan-9-yl 8-((2-hydroxyethyl)amino)octanoate (125 mg, 0.28 mmol), 1-bromotetradecane (94 mg, 0.34 mmol) and N,N-diisopropylethylamine (44 mg, 0.34 mmol) in ethanol was allowed to stir at 65° C. for 18 h. The reaction was cooled to room temperature and solvents were evaporated in vacuo. The residue was taken-up in ethyl acetate and saturated sodium bicarbonate. The organic layer was separated, dried over $Na_2SO_4$ and evaporated in vacuo. The residue was purified by silica gel chromatography (0-100% (mixture of 1% $NH_4OH$, 20% MeOH in dichloromethane) in dichloromethane) to obtain heptadecan-9-yl 8-((2-hydroxyethyl)(tetradecyl)amino)octanoate (89 mg, 0.14 mmol, 50%). UPLC/ELSD: RT=3.61 min. MS (ES): m/z ($MH^+$) 638.91 for $C_{41}H8_3NO_3$. $^1H$ NMR (300 MHz, $CDCl_3$) δ: ppm 4.86 (p, 1H); 3.72-3.47 (br. m, 2H); 2.78-2.40 (br. m, 5H); 2.28 (t, 2H); 1.70-1.40 (m, 10H); 1.38-1.17 (br. m, 54H); 0.88 (m, 9H).

Synthesis of Intermediates

Intermediate A: 2-Octyldecanoic acid

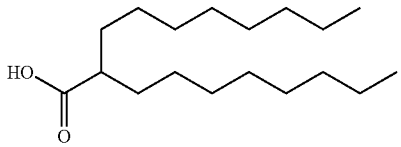 [SMILES: CCCCCCCCC(CCCCCCCC)C(=O)O]

A solution of diisopropylamine (2.92 mL, 20.8 mmol) in THF (10 mL) was cooled to −78° C. and a solution of n-BuLi (7.5 mL, 18.9 mmol, 2.5 M in hexanes) was added. The reaction was allowed to warm to 0° C. To a solution of decanoic acid (2.96 g, 17.2 mmol) and NaH (754 mg, 18.9 mmol, 60% w/w) in THF (20 mL) at 0° C. was added the solution of LDA and the mixture was allowed to stir at rt for 30 min. After this time 1-iodooctane (5 g, 20.8 mmol) was added and the reaction mixture was heated at 45° C. for 6 h. The reaction was quenched with 1N HCl (10 mL). The organic layer was dried over $MgSO_4$, filtered and evaporated in vacuo. The residue was purified by silica gel chromatography (0-20% ethyl acetate in hexanes) to yield 2-octyldecanoic acid (1.9 g, 6.6 mmol, 38%). $^1$H NMR (300 MHz, $CDCl_3$) δ: ppm 2.38 (br. m, 1H); 1.74-1.03 (br. m, 28H); 0.91 (m, 6H).

Intermediate B: 7-Bromoheptyl 2-octyldecanoate

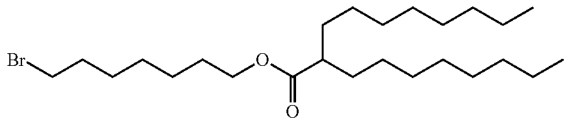 [SMILES: CCCCCCCCC(CCCCCCCC)C(=O)OCCCCCCCBr]

7-bromoheptyl 2-octyldecanoate was synthesized using Method A from 2-octyldecanoic acid and 7-bromoheptan-1-ol. $^1$H NMR (300 MHz, $CDCl_3$) δ: ppm 4.09 (br. m, 2H); 3.43 (br. m, 2H); 2.48-2.25 (br. m, 1H); 1.89 (br. m, 2H); 1.74-1.16 (br. m, 36H); 0.90 (m, 6H).

Intermediate C: (2-Hexylcyclopropyl)methanol

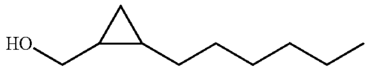

A solution of diethyl zinc (20 mL, 20 mmol, 1 M in hexanes), in dichloromethane (20 mL) was allowed to cool to −40° C. for 5 min. Then a solution of diiodomethane (3.22 mL, 40 mmol) in dichloromethane (10 mL) was added dropwise. After the reaction was allowed to stir for 1 h at −40° C., a solution of trichloro-acetic acid (327 mg, 2 mmol) and DME (1 mL, 9.6 mmol) in dichloromethane (10 mL) was added. The reaction was allowed to warm to −15° C. and stir at this temperature for 1 h. A solution of (Z)-non-2-en-1-ol (1.42 g, 10 mmol) in dichloromethane (10 mL) was then added to the −15° C. solution. The reaction was then slowly allowed to warm to rt and stir for 18 h. After this time saturated $NH_4Cl$ (200 mL) was added and the reaction was extracted with dichloromethane (3×), washed with brine, and dried over $Na_2SO_4$. The organic layer was filtered, evaporated in vacuo and the residue was purified by silica gel chromatography (0-50% ethyl acetate in hexanes) to yield (2-hexylcyclopropyl)methanol (1.43 g, 9.2 mmol, 92%). $^1$H NMR (300 MHz, $CDCl_3$) δ: ppm 3.64 (m, 2H); 1.57-1.02 (m, 12H); 0.99-0.80 (m, 4H); 0.72 (m, 1H), 0.00 (m, 1H).

C. Compound 18: Heptadecan-9-yl 8-((2-hydroxyethyl)(8-(nonyloxy)-8-oxooctyl)amino) octanoate

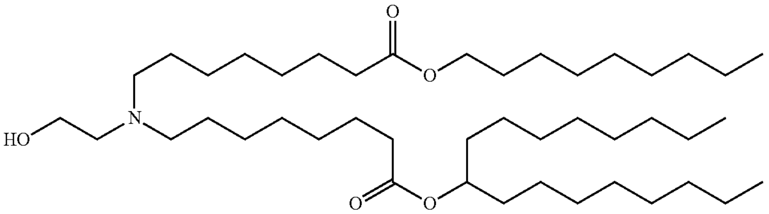 [SMILES: CCCCCCCCCOC(=O)CCCCCCCN(CCO)CCCCCCCC(=O)OC(CCCCCCCC)CCCCCCCC]

Chemical Formula: $C_{44}H_{87}NO_5$—Molecular Weight: 710.18

Compound 18 was synthesized according to the general procedure and Representative Procedure 1 described above. UPLC/ELSD: RT=3.59 min. MS (ES): m/z ($MH^+$) 710.89 for $C_{44}H_{87}NO_5$. $^1$H NMR (300 MHz, $CDCl_3$) δ: ppm 4.86 (m, 1H); 4.05 (t, 2H); 3.53 (br. m, 2H); 2.83-2.36 (br. m, 5H); 2.29 (m, 4H); 0.96-1.71 (m, 64H); 0.88 (m, 9H).

D. Compound 136: Nonyl 8-((2-hydroxyethyl)((9Z,12Z)-octadeca-9,12-dien-1-yl)amino)octanoate Representative Procedure 2

Nonyl 8-bromooctanoate (Method A)

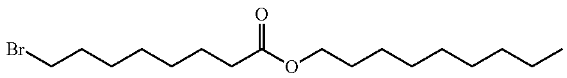 [SMILES: CCCCCCCCCOC(=O)CCCCCCCBr]

To a solution of 8-bromooctanoic acid (5 g, 22 mmol) and nonan-1-ol (6.46 g, 45 mmol) in dichloromethane (100 mL) were added N-(3-Dimethylaminopropyl)-N'-ethylcarbodiimide hydrochloride (4.3 g, 22 mmol) and DMAP (547 mg, 4.5 mmol). The reaction was allowed to stir at rt for 18 h. The reaction was diluted with dichloromethane and washed with saturated sodium bicarbonate. The organic layer was separated and washed with brine, dried over $MgSO_4$. The organic layer was filtered and evaporated under vacuum. The residue was purified by silica gel chromatography (0-10% ethyl acetate in hexanes) to obtain nonyl 8-bromooctanoate (6.1 g, 17 mmol, 77%).

$^1$H NMR (300 MHz, $CDCl_3$) δ: ppm 4.06 (t, 2H); 3.40 (t, 2H); 2.29 (t, 2H); 1.85 (m, 2H); 1.72-0.97 (m, 22H); 0.88 (m, 3H).

Nonyl 8-((2-hydroxyethyl)amino)octanoate

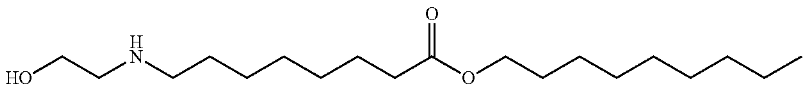 [SMILES: CCCCCCCCCOC(=O)CCCCCCCNCCO]

A solution of nonyl 8-bromooctanoate (1.2 g, 3.4 mmol) and 2-aminoethan-1-ol (5 mL, 83 mmol) in ethanol (2 mL) was allowed to stir at 62° C. for 18 h. The reaction mixture was concentrated in vacuum and the residue was extracted with ethyl acetate and water. The organic layer was separated and washed with water, brine and dried over $Na_2SO_4$. The organic layer was filtered and evaporated in vacuo. The residue was purified by silica gel chromatography (0-100% (mixture of 1% $NH_4OH$, 20% MeOH in dichloromethane) in dichloromethane) to obtain nonyl 8-((2-hydroxyethyl)amino)octanoate (295 mg, 0.9 mmol, 26%).

UPLC/ELSD: RT=1.29 min. MS (ES): m/z ($MH^+$) 330.42 for $C_{19}H_{39}NO_3$ $^1H$ NMR (300 MHz, $CDCl_3$) δ: ppm 4.07 (t, 2H); 3.65 (t, 2H); 2.78 (t, 2H); 2.63 (t, 2H); 2.32-2.19 (m, 4H); 1.73-1.20 (m, 24H); 0.89 (m, 3H)

Nonyl 8-((2-hydroxyethyl)((9Z,12Z)-octadeca-9,12-dien-1-yl)amino)octanoate

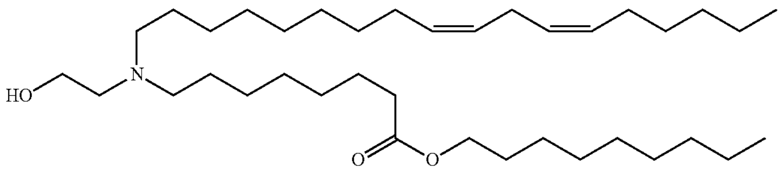 [SMILES: CCCCC/C=C\C/C=C\CCCCCCCCN(CCO)CCCCCCCC(=O)OCCCCCCCCC]

Chemical Formula: $C_{37}H_{71}NO_3$—Molecular Weight: 577.98

A solution of nonyl 8-((2-hydroxyethyl)amino)octanoate (150 mg, 0.46 mmol), (6Z,9Z)-18-bromooctadeca-6,9-diene (165 mg, 0.5 mmol) and N,N-diisopropylethylamine (65 mg, 0.5 mmol) in ethanol (2 mL) was allowed to stir at reflux for 48 h. The reaction was allowed to cool to rt and solvents were evaporated under vacuum. The residue was purified by silica gel chromatography (0-10% MeOH in dichloromethane) to obtain nonyl 8-((2-hydroxyethyl)((9Z,12Z)-octadeca-9,12-dien-1-yl)amino)octanoate (81 mg, 0.14 mmol, 30%) as a HBr salt.

UPLC/ELSD: RT=3.24 min. MS (ES): m/z ($MH^+$) 578.64 for $C_{37}H_{71}NO_3$ $^1H$ NMR (300 MHz, $CDCl_3$) δ: ppm 10.71 (br., 1H); 5.36 (br. m, 4H); 4.04 (m, 4H); 3.22-2.96 (br. m, 5H); 2.77 (m, 2H); 2.29 (m, 2H); 2.04 (br. m, 4H); 1.86 (br. m, 4H); 1.66-1.17 (br. m, 40H); 0.89 (m, 6H)

E. Compound 138: Dinonyl 8,8'-((2-hydroxyethyl)azanediyl)dioctanoate

Representative Procedure 3

Dinonyl 8,8'-((2-hydroxyethyl)azanediyl)dioctanoate

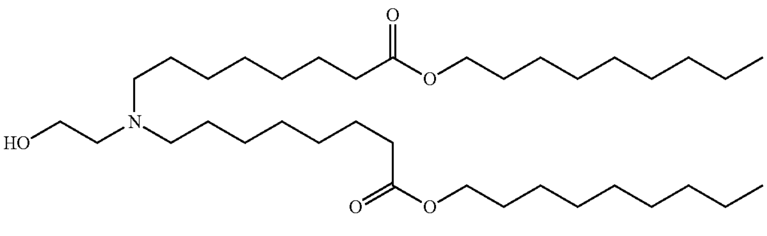 [SMILES: CCCCCCCCCOC(=O)CCCCCCCN(CCO)CCCCCCCC(=O)OCCCCCCCCC]

Chemical Formula: $C_{36}H_{71}NO_5$—Molecular Weight: 597.97

A solution of nonyl 8-bromooctanoate (200 mg, 0.6 mmol) and 2-aminoethan-1-ol (16 mg, 0.3 mmol) and N, N-diisopropylethylamine (74 mg, 0.6 mmol) in THF/$CH_3CN$ (1:1) (3 mL) was allowed to stir at 63° C. for 72 h. The reaction was cooled to rt and solvents were evaporated under vacuum. The residue was extracted with ethyl acetate and saturated sodium bicarbonate. The organic layer was separated, dried over $Na_2SO_4$ and evaporated under vacuum. The residue was purified by silica gel chromatography (0-10% MeOH in dichloromethane) to obtain dinonyl 8,8'-((2-hydroxyethyl)azanediyl)dioctanoate (80 mg, 0.13 mmol, 43%).

UPLC/ELSD: RT=3.09 min. MS (ES): m/z ($MH^+$) 598.85 for $C_{36}H_{71}NO_5$ $^1H$ NMR (300 MHz, $CDCl_3$) δ: ppm 4.05 (m, 4H); 3.57 (br. m, 2H); 2.71-2.38 (br. m, 6H); 2.29 (m, 4H), 1.71-1.01 (br. m, 49H), 0.88 (m, 6H).

All other compounds of formula (I) of this disclosure can be obtained by a method analogous to Representative Procedures 1-3 as described above.

Example 2

Production of Nanoparticle Compositions

A. Production of Nanoparticle Compositions

Nanoparticles can be made with mixing processes such as microfluidics and T-junction mixing of two fluid streams, one of which contains the polynucleotide and the other has the lipid components.

Lipid compositions are prepared by combining a lipid according to Formula (I), a phospholipid (such as DOPE or DSPC, obtainable from Avanti Polar Lipids, Alabaster, Ala.), a PEG lipid (such as 1,2-dimyristoyl-sn-glycerol methoxypolyethylene glycol, also known as PEG-DMG, obtainable from Avanti Polar Lipids, Alabaster, Ala.), and a structural lipid (such as cholesterol, obtainable from Sigma-Aldrich, Taufkirchen, Germany, or a corticosteroid (such as prednisolone, dexamethasone, prednisone, and hydrocortisone), or a combination thereof) at concentrations of about 50 mM in ethanol. Solutions should be refrigerated for storage at, for example, −20° C. Lipids are combined to yield desired molar ratios and diluted with water and ethanol to a final lipid concentration of between about 5.5 mM and about 25 mM.

Nanoparticle compositions including a polynucleotide and a lipid composition are prepared by combining the lipid solution with a solution including the a polynucleotide at lipid composition to polynucleotide wt:wt ratios between about 5:1 and about 50:1. The lipid solution is rapidly injected using a NanoAssemblr microfluidic based system at flow rates between about 10 ml/min and about 18 ml/min into the polynucleotide solution to produce a suspension with a water to ethanol ratio between about 1:1 and about 4:1.

For nanoparticle compositions including an RNA, solutions of the RNA at concentrations of 0.1 mg/ml in deionized water are diluted in 50 mM sodium citrate buffer at a pH between 3 and 4 to form a stock solution.

Nanoparticle compositions can be processed by dialysis to remove ethanol and achieve buffer exchange. Formulations are dialyzed twice against phosphate buffered saline (PBS), pH 7.4, at volumes 200 times that of the primary product using Slide-A-Lyzer cassettes (Thermo Fisher Scientific Inc., Rockford, Ill.) with a molecular weight cutoff of 10 kD. The first dialysis is carried out at room temperature for 3 hours. The formulations are then dialyzed overnight at 4° C. The resulting nanoparticle suspension is filtered through 0.2 m sterile filters (Sarstedt, Nümbrecht, Germany) into glass vials and sealed with crimp closures. Nanoparticle composition solutions of 0.01 mg/ml to 0.10 mg/ml are generally obtained.

The method described above induces nano-precipitation and particle formation. Alternative processes including, but not limited to, T-junction and direct injection, may be used to achieve the same nano-precipitation.

B. Characterization of Nanoparticle Compositions

A Zetasizer Nano ZS (Malvern Instruments Ltd, Malvern, Worcestershire, UK) can be used to determine the particle size, the polydispersity index (PDI) and the zeta potential of the nanoparticle compositions in 1×PBS in determining particle size and 15 mM PBS in determining zeta potential.

Ultraviolet-visible spectroscopy can be used to determine the concentration of a polynucleotide (e.g., RNA) in nanoparticle compositions. 100 μL of the diluted formulation in 1×PBS is added to 900 μL of a 4:1 (v/v) mixture of methanol and chloroform. After mixing, the absorbance spectrum of the solution is recorded, for example, between 230 nm and 330 nm on a DU 800 spectrophotometer (Beckman Coulter, Beckman Coulter, Inc., Brea, Calif.). The concentration of polynucleotide in the nanoparticle composition can be calculated based on the extinction coefficient of the polynucleotide used in the composition and on the difference between the absorbance at a wavelength of, for example, 260 nm and the baseline value at a wavelength of, for example, 330 nm.

For nanoparticle compositions including an RNA, a QUANT-IT™ RIBOGREEN® RNA assay (Invitrogen Corporation Carlsbad, Calif.) can be used to evaluate the encapsulation of an RNA by the nanoparticle composition. The samples are diluted to a concentration of approximately 5 μg/mL in a TE buffer solution (10 mM Tris-HCl, 1 mM EDTA, pH 7.5). 50 μL of the diluted samples are transferred to a polystyrene 96 well plate and either 50 μL of TE buffer or 50 μL of a 2% Triton X-100 solution is added to the wells. The plate is incubated at a temperature of 37° C. for 15 minutes. The RIBOGREEN® reagent is diluted 1:100 in TE buffer, and 100 μL of this solution is added to each well. The fluorescence intensity can be measured using a fluorescence plate reader (Wallac Victor 1420 Multilablel Counter; Perkin Elmer, Waltham, Mass.) at an excitation wavelength of, for example, about 480 nm and an emission wavelength of, for example, about 520 nm. The fluorescence values of the reagent blank are subtracted from that of each of the samples and the percentage of free RNA is determined by dividing the fluorescence intensity of the intact sample (without addition of Triton X-100) by the fluorescence value of the disrupted sample (caused by the addition of Triton X-100).

Exemplary formulations of the nanoparticle compositions are presented in TABLE E1 below.

TABLE E1

Exemplary formulations of nanopoarticle compositions

| Composition (mol %) | Components |
|---|---|
| 40:20:38.5:1.5 | Compound:Phospholipid:Chol:PEG-DMG |
| 45:15:38.5:1.5 | Compound:Phospholipid:Chol:PEG-DMG |
| 50:10:38.5:1.5 | Compound:Phospholipid:Chol:PEG-DMG |
| 55:5:38.5:1.5 | Compound:Phospholipid:Chol:PEG-DMG |
| 60:5:33.5:1.5 | Compound:Phospholipid:Chol:PEG-DMG |
| 45:20:33.5:1.5 | Compound:Phospholipid:Chol:PEG-DMG |

TABLE E1-continued

| Exemplary formulations of nanopoarticle compositions | |
|---|---|
| Composition (mol %) | Components |
| 50:20:28.5:1.5 | Compound:Phospholipid:Chol:PEG-DMG |
| 55:20:23.5:1.5 | Compound:Phospholipid:Chol:PEG-DMG |
| 60:20:18.5:1.5 | Compound:Phospholipid:Chol:PEG-DMG |
| 40:15:43.5:1.5 | Compound:Phospholipid:Chol:PEG-DMG |
| 50:15:33.5:1.5 | Compound:Phospholipid:Chol:PEG-DMG |
| 55:15:28.5:1.5 | Compound:Phospholipid:Chol:PEG-DMG |
| 60:15:23.5:1.5 | Compound:Phospholipid:Chol:PEG-DMG |
| 40:10:48.5:1.5 | Compound:Phospholipid:Chol:PEG-DMG |
| 45:10:43.5:1.5 | Compound:Phospholipid:Chol:PEG-DMG |
| 55:10:33.5:1.5 | Compound:Phospholipid:Chol:PEG-DMG |
| 60:10:28.5:1.5 | Compound:Phospholipid:Chol:PEG-DMG |
| 40:5:53.5:1.5 | Compound:Phospholipid:Chol:PEG-DMG |
| 45:5:48.5:1.5 | Compound:Phospholipid:Chol:PEG-DMG |
| 50:5:43.5:1.5 | Compound:Phospholipid:Chol:PEG-DMG |
| 40:20:40:0 | Compound:Phospholipid:Chol:PEG-DMG |
| 45:20:35:0 | Compound:Phospholipid:Chol:PEG-DMG |
| 50:20:30:0 | Compound:Phospholipid:Chol:PEG-DMG |
| 55:20:25:0 | Compound:Phospholipid:Chol:PEG-DMG |
| 60:20:20:0 | Compound:Phospholipid:Chol:PEG-DMG |
| 40:15:45:0 | Compound:Phospholipid:Chol:PEG-DMG |
| 45:15:40:0 | Compound:Phospholipid:Chol:PEG-DMG |
| 50:15:35:0 | Compound:Phospholipid:Chol:PEG-DMG |
| 55:15:30:0 | Compound:Phospholipid:Chol:PEG-DMG |
| 60:15:25:0 | Compound:Phospholipid:Chol:PEG-DMG |
| 40:10:50:0 | Compound:Phospholipid:Chol:PEG-DMG |
| 45:10:45:0 | Compound:Phospholipid:Chol:PEG-DMG |
| 50:10:40:0 | Compound:Phospholipid:Chol:PEG-DMG |
| 55:10:35:0 | Compound:Phospholipid:Chol:PEG-DMG |
| 60:10:30:0 | Compound:Phospholipid:Chol:PEG-DMG |

Example 3

Characterization of mRNA-Encoded Therapeutic Antibodies 1.1 Design of IgG mRNA Molecules Checkpoint inhibitor antibodies have been the focus on much recent attention in the scientific and medical communities given their widely-reported efficacy in cancer immunotherapy. The anti-CTLA-4 antibodies, ipilimumab and tremelimumab, have achieved considerable success in the clinic. In 2011, ipilimumab was approved for the treatment of late-stage melanoma that cannot be removed by surgery. In April 2015, tremelimumab was granted Orphan Drug Designation by US FDA for treatment of malignant mesothelioma. Despite its potential for fatal immune-mediated adverse reactions and unusual severe side effects, ipilimumab has more recently (October 2015) been approved for use as adjuvant therapy in stage III melanoma patients who are at high risk of melanoma recurrence following surgical intervention.

CTLA-4 is a negative regulatory surface molecule on T cells that competitively inhibits the CD28 co-stimulatory pathway by binding to the costimulatory molecules B7-1 and B7-2. Anti-CTLA-4 antibodies block this inhibitory signaling mechanism and allow T lymphocytes to destroy cancer cells.

The concept of using anti-CTLA-4 antibodies to treat cancer was first developed by James Allison and colleagues at the University of California, Berkeley. Much of this seminal work featured the CTLA-4 antagonist antibody 9D9 which was demonstrated to induce rejection of several tumor types in different mouse strains. The effectiveness of this CTLA-4 blockade was shown to correlate with the inherent immunogenicity of the tumor. These data led investigators to hypothesize that removing the "brakes" on a T cell response via CTLA-4 blockade would effectively allow the immune system to eliminate cancer cells and induce long-lasting anti-tumor immunity.

The efficacy of mRNA-produced 9D9 antibodies was tested in a widely employed in vivo model of cancer, the syngeneic colon cancer CT26 model. We designed mRNAs encoding both the 9D9 (IgG2b isotype) antibody and an IgG2a variant of 9D9 (termed "9D92a" or "9D92a$^a$"). mRNA sequences were generated encoding the full IgG antibody molecules, i.e., mRNAs encoding both the full heavy chain (HC) and full light chain (LC) of these antibodies.

The mRNA for these sequences was designed by adding proprietary 5' and 3' Untranslated Regions (UTRs) to the Open Reading Frames (ORF), which encoded the amino acid sequence of either the HC or the LC of the antibodies. The resulting HC and LC sequences were synthesized by In Vitro Transcription (IVT), using proprietary chemically modified nucleotides and formulated in Lipofectamine 2000 or Lipid Nanoparticles (LNP) using DLin-MC3-DMA (MC3) LNPs (Jayaraman et al., 2012) for in vitro and in vivo studies, respectively.

1.2 Confirmation of Anti-Tumor Efficacy of 9D9 Antibodies in the Mouse CT26 Cancer Model:

The efficacy of systemically administered recombinant 9D9 antibodies was tested in the mouse CT26 tumor model. Murine CT26 cells, developed in 1975 by exposing BALB/c mice to N-nitroso-N-methylurethane (NMU), result in a rapid-growing carcinoma that is easily implanted and readily metastasizes (Griswold and Corbett, Cancer 36:2441-2444 (1975)).

CT26 is one of the most extensively studied syngeneic mouse tumor models, used in the screening for and evaluation of small molecule cytotoxic agents and biological response modifiers for use in cancer immunotherapy. Unlike conventional xenograft models, which lack relevance due to the animals' immunocompromised status, this syngeneic mouse model provides an effective approach for studying how cancer therapies perform in the presence of a functional immune system.

For in vivo treatment studies, BALB/c mice were injected in the flank with $10^5$ tumor cells subcutaneously (SC) to establish SC tumors. Mice (n=14) were administered 5 mg/kg anti-CTLA-4 9D9 antibody at day 3, 6 and 9 following induction of tumors. Negative control mice (n=14) received no treatment. Mice were followed for several weeks and tumor burden and long-term survival were monitored. Mice were euthanized when tumors reached 2000 $mm^3$.

Clear activity, i.e., 90% survival, was seen in mice treated with 5 mg/kg dose of 9D9 (IgG2b) antibody as compared to 0% survival in untreated, control mice confirming the efficacy of these anti-CTLA-4 antibodies when systemically administered in the CT26 mouse cancer model.

1.3 In Vitro Characterization of mRNA-Encoded Anti-CTLA-4 Antibodies

Figure 1:
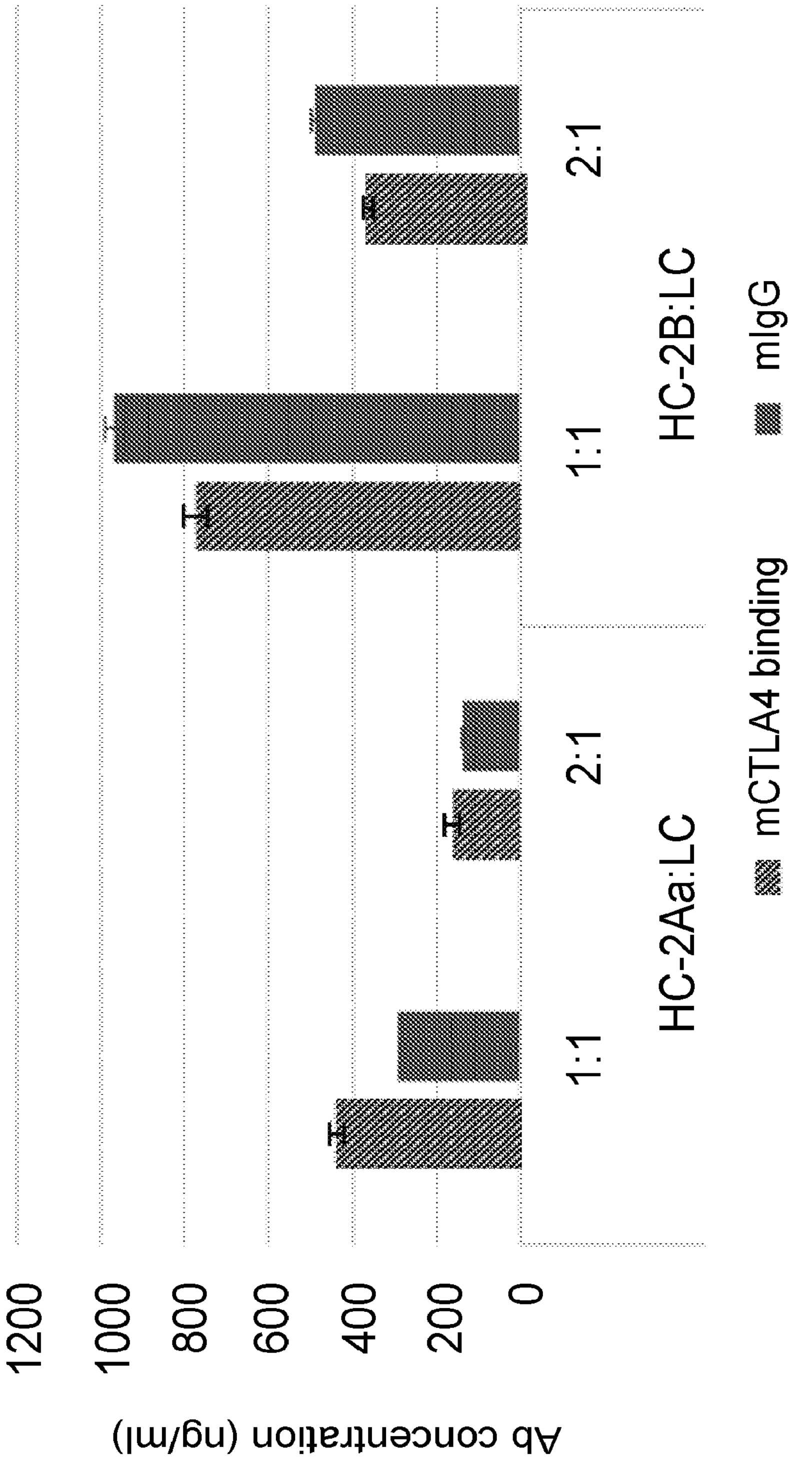

The following mRNAs encoding anti-CTLA-4 antibody heavy and light chains (HC and LC mRNAs) were designed and assayed for expression by measuring both CTLA-4-bound antibody and total IgG produced (FIG. 1): (1) 9D9 VH:mIgG2a (IgG2a$^a$ allele) plus 9D9 VL:mIgGk; and (2) 9D9 VH:mIgG2b plus 9D9 VL:mIgGk. HeLa cells were transfected in 6-well plates with mRNA formulated in Lipofectamine 2000. Cell supernatants were harvested at 18 hours post transfection. Supernatants were assayed for binding to CTLA-4-coated plates (mCTLA-4-His (Life Technologies)) and detection was with HRP-Goat anti-mouse IgG Fc, 1:10000 (JIR). Purified 9D9 antibody (BioXcell) was used for the standard curve in the CTLA-4-binding ELISA. The Mouse IgG total ELISA Ready-SET-Go® assay (eBioscience) was used for quantitating total mouse IgG, with a mouse IgG internal standard.

The data show significant expression and antigen-binding of both IgG2a and IgG2b forms of 9D9 antibody in HeLa cells transfected with IVT mRNAs encoding full LC and HC. Moreover, the data demonstrated higher 9D9 expression/activity when mRNAs are delivered at a molar ratio of 1:1 (HC:LC).

Experimental data also showed that full sequence antibodies expressed better than scFv's. Anti CTLA-4 antibodies 9D9 IgG2a (HC and LC mRNAs at a molar ration of 1:1) and IgG2b (HC and LC mRNAs at a molar ratio of 1:1) were transfected into cells in 6-well plates using 3 mg mRNA and 4.5 mg L2K per well. Supernatants were harvested after 24 h. Active antibody levels were 657 ng/well for 9D9 IgG2a and 1161 ng/well for 9D9 IgG2b. In contrast, expression of active antibodies after transfection with 3 different scFv constructs under the same experimental condition resulted in expression levels of 6.2 ng/well, 0 ng/well, and 94 ng/well, respectively.

Example 4

Therapeutic Efficacy of mRNA-Encoded CTLA-4 Antibodies 2.1 Therapeutic Efficacy of mRNA-Encoded 9D9 Antibodies in a CT26 Mouse Colon Carcinoma Model To evidence the therapeutic efficacy of the mRNA-encoded anti-CTLA-4 antibodies described supra, we studied these molecules in BALB/c mice challenged with subcutaneous (SC) tumors. The mRNAs were formulated in MC3 LNPs by mixing mRNAs encoding the HC and the LC at a molar ratio of 1:1, prior to encapsulation. LNPs routinely had a mean particle diameter of ~65-85 nM, a polydispersity index (PDI) of ~0.02-0.2 and an encapsulation efficiency (EE) of >95%.

2.1.1 Study Design

Animals were distributed into treatment groups according to body weight such that the mean body weight in each group was within 10% of the overall mean. Tumor cells were implanted subcutaneously in the low flank (between the right hip and sacral region) at Day 0. Mice were dosed individually by body weight on the day of treatment as described above. Intravenous (IV) dosing (0.5 mg mRNA per kg) was ~1.75 mass excess of HC mRNA compared to LC mRNA (i.e., 1:1 molar ratio) co-formulated in MC3 lipid nanoparticles (LNPs) (DLin-MC3-DMA:Cholesterol: DSPC:PEG-DMG-50:38.5:10:1.5 molar ratios).

Animals were evaluated for volume, body weight and general health assessments. The defined end point to sacrifice animals due to excessive tumor burden was a tumor volume≥2,000 $mm^3$. The monitoring of tumor growth delay/inhibition and survival were incorporated into the study design.

Recombinant 9D9 antibody was included as an internal control. Whole blood was isolated and serum samples were retained for further analysis. An overview of the study design is set forth in TABLE E2.

TABLE E2

Overview of the Therapeutic anti-CTLA-4 Study Design

| Group | # Animals | Compound | Route | Schedule | Dose (mg/kg/inj) |
|---|---|---|---|---|---|
| 1 | 14 | Untreated Control | NA | NA | NA |
| 2 | 14 | anti-CTLA-4 protein (BioXcell; IgG2b) | IP | D 3, 6, 9 | 5 |
| 3 | 14 | 9D9 IgG2b | IV | D 3 | 0.5 |
| 4 | 14 | 9D9 IgG2b | IV | D 3, 9 | 0.5 |
| 5 | 14 | 9D9 IgG2b | IV | D 3, 6, 9 | 0.5 |
| 6 | 14 | 9D9 IgG2a[a] | IV | D 3 | 0.5 |
| 7 | 14 | 9D9 IgG2a[a] | IV | D 3, 9 | 0.5 |
| 8 | 14 | 9D9 IgG2a[a] | IV | D 3, 6, 9 | 0.5 |
| 9 | 14 | NST (non-start) FIX | IV | D 3 | 0.5 |
| 10 | 14 | NST (non-start) FIX | IV | D 3, 9 | 0.5 |
| 11 | 14 | NST (non-start) FIX | IV | D 3, 6, 9 | 0.5 |
| 12 | 14 | PBS | IV | D 3 | 5 ml/kg |
| 13 | 14 | PBS | IV | D 3, 9 | 5 ml/kg |
| 14 | 14 | PBS | IV | D 3, 6, 9 | 5 ml/kg |

2.1.2 Results 2.1.2.1 Efficacy of Anti-CTLA-4 Protein Control Treatment

Figure 2A:
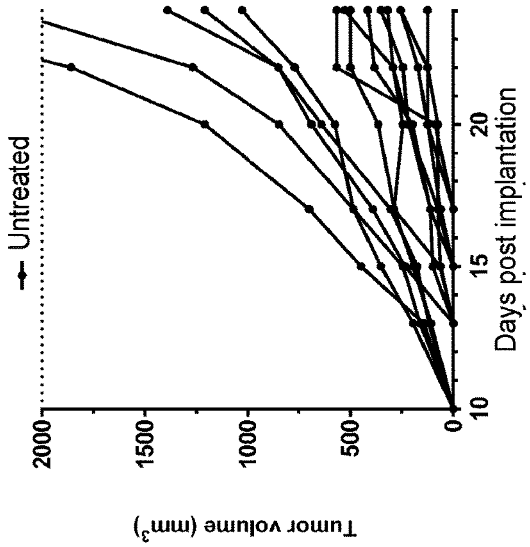
Figure 2B:
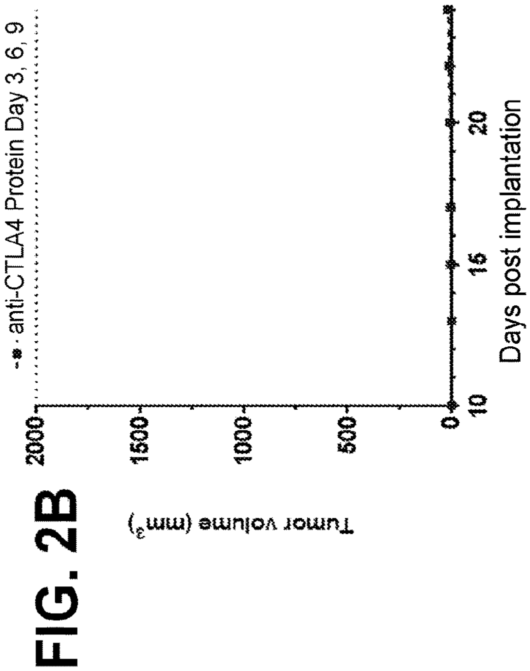
Figure 2C:
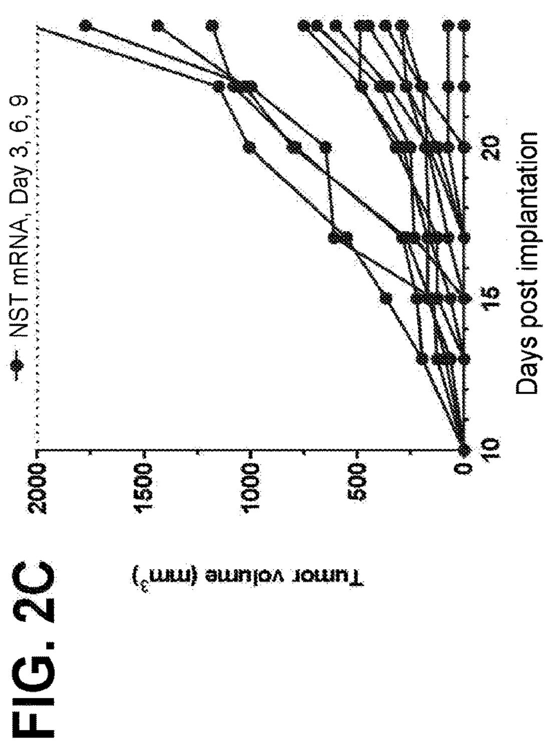

Mice treated with three doses of recombinant anti-CTLA-4 antibody (5 mg/kg at 3, 6 and 9 days post implantation) were assayed for tumor growth as described supra. Data are depicted for 24 days post-implantation (FIG. 2A-C). Control animals receiving negative control mRNA (i.e., mRNA encoding non-translated ("non-start") Factor IX ("NST FIX") (FIG. 2C) developed tumors at a similar rate as compared to untreated controls (FIG. 2A), as expected.

As previously demonstrated, tumor growth is delayed in animals treated with therapeutic dosing of anti-CTLA-4 antibodies (FIG. 2B) as compared to untreated animals or animals treated with negative-control mRNA.

2.1.2.2 Efficacy of Treatment with mRNAs Designed to Encode Anti-CTLA Antibodies To demonstrate the therapeutic efficacy of mRNAs encoding 9D9 anti-CTLA-4 antibodies, mRNAs encoding the IgG2b and IgG2aa variant 9D9 antibodies were administered following implantation and tumor growth was evaluated as compared to animals receiving negative control (NST-FIX) mRNA treatment described supra. Animals received a single dose or multiple doses of mRNA encoding 9D9 IgG2b (FIG. 3A-3F) or 9D9 IgG2a[a] (FIG. 4A-4F) (single dose=dosing at day 3; two doses=dosing at day 3 and day 9; three doses=dosing at days 3, 6 and 9). Negative control data for animals receiving 3 doses of negative control mRNA are as depicted supra and are reproduced for comparison purposes.

These data demonstrate a reduction in tumor burden in mice treated with mRNA encoding 9D9 (IgG2b) with mice receiving two systemic doses of MC3-LNP-formulated mRNA (0.5 mg/kg per dose) showing detectable reduction in tumor growth, and mice receiving three doses of mRNA exhibiting significant reduction in tumor growth, at 24 days post tumor induction.

Mice treated with only a single systemic (IV) dose of MC3-LNP-formulated mRNA encoding 9D9 (IgG2a) showed almost complete inhibition of tumor growth at 24 days post induction and mice receiving two or three doses of this mRNA exhibited complete inhibition of tumor growth.

All treatments (as well as each treatment regimen) were well-tolerated resulting in no overall morbidity or mortality. Each treatment was associated with an overall mean body weight gain.

2.1.3 Conclusions

This study was conducted to assess the activity of mRNAs encoding anti-CTLA-4 antibodies when administered systemically in a CT26 mouse carcinoma model. The studies presented herein demonstrate the therapeutic efficacy of mRNAs encoding two variants of the anti-CTLA-4 antibody 9D9 against lethal challenge with CT26 tumors in mice. Tumor burden, survival rates, changes in body weight and clinically relevant disease signs were investigated.

Mice treated with mRNA encoding 9D9 antibodies exhibited significant inhibition of tumor growth, with near complete inhibition of tumor growth observed at 24 days post tumor induction in mice receiving just a single dose (0.5 mg/kg of mRNA formulated in MC3) of mRNA encoding 9D9 (IgG2a) as well as in mice receiving multiple doses of mRNA encoding 9D9 (IgG2b) as compared to untreated mice and to mice receiving placebo (PBS) or non-translated mRNA treatment.

These data demonstrate a significant therapeutic effect for mRNA-encoded anti-CTLA-4 antibodies when mRNA is systemically administered at doses as low as 0.5 mg/kg in an in vivo CT26 mouse carcinoma model.

The studies presented herein utilize MC3-based LNPs. These LNPs have significant pre-clinical and clinical documentation and have been found to be acceptable for use in clinical trials by Alnylam for their ALN-TTR02 program (Coelho et al., 2013). LNPs in general have been shown to be very useful for mRNA delivery across several parenteral administration routes including intravenous (IV), intramuscular (IM), and subcutaneous (SC).

MC3-based LNPs have documented toxicity profiles across various species and may require pre-dosing and/or co-administration with anti-inflammatory (anti-histamines, acetaminophen, and dexamethasone) treatment. The majority of research with LNP formulated drugs has utilized IV administration although some SC and intradermal (ID) work has been reported. LNP-encapsulated mRNA-encoded antagonistic antibodies (administered systemically (IV)) have shown sufficient expression of two active IgG antibodies (9D9 IgG2b and 9D9 IgG2a), a therapeutic response as demonstrated by a reduction in growth of tumor tissue, and in addition survival against lethal induction of tumors with carcinoma cells (in this case, highly tumorigenic CT26 colon carcinoma cells).

Example 5

Extended Therapeutic Efficacy of mRNA-Encoded CTLA-4 Antibodies

The study described in TABLE E2 was followed out for more than 60 days.

Figure 5A:
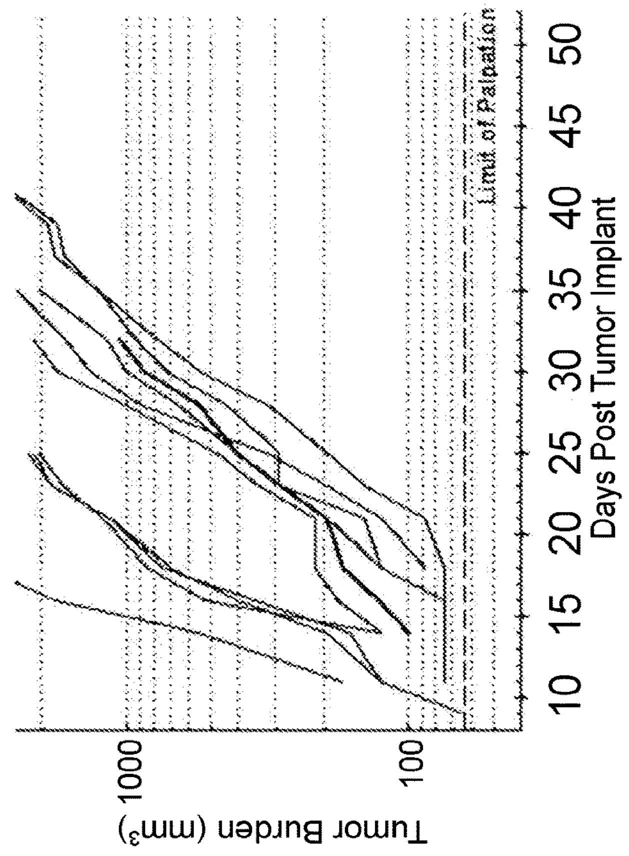
Figure 5B:
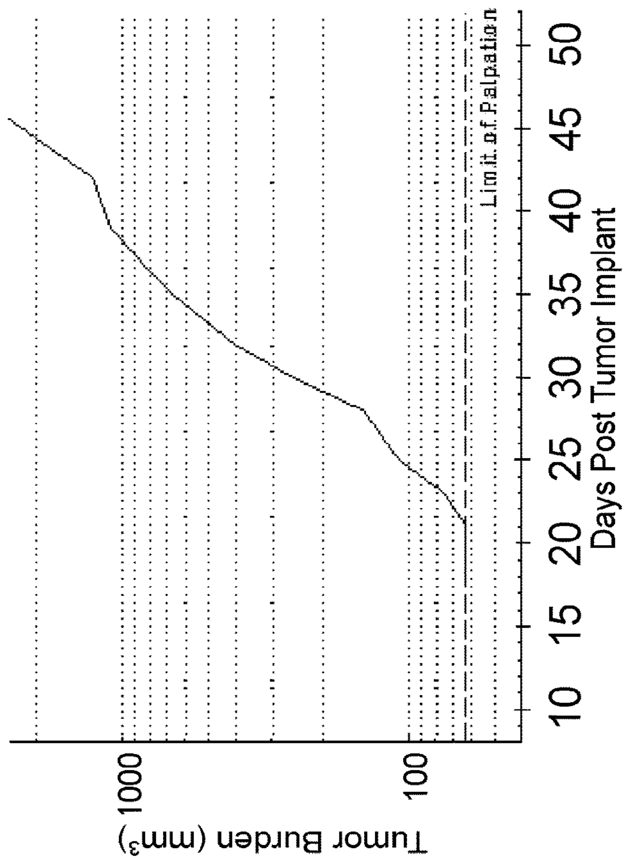

Mice treated with three doses of recombinant anti-CTLA-4 antibody (5 mg/kg at 3, 6 and 9 days post implantation) were assayed for tumor growth as described supra. The data shown in FIG. 5A-5B shows tumor growth in control animals (FIG. 5A), in which survival was 0%, compared to the tumor growth in animals treated with 3 doses (administered at days 3, 6 and 9) of 9D9 IgG2b antibody protein (FIG. 5B), which had a survival rate of 90%. Thus, as previously demonstrated, tumor growth was delayed in animals treated with therapeutic dosing of anti-CTLA-4 antibodies as compared to untreated animals.

When plasma levels of anti-CTLA-4 antibody were measured after administration of either anti-CTLA-4 antibody (protein) or mRNA encoding an anti-CTLA-4 antibody, it was noticeable that the serum levels of anti-CTLA-4 antibody were much higher after the administration of the anti-CTLA-4 antibody (protein). The administration of 5 mg/kg of anti-CTLA-4 protein resulted in serum levels of approximately 50 μg/mL. Serum protein levels of injected antibody protein remained more or less constant at the 24 hours, 48 hours, and 72 hours timepoints after administration.

Figure 6:
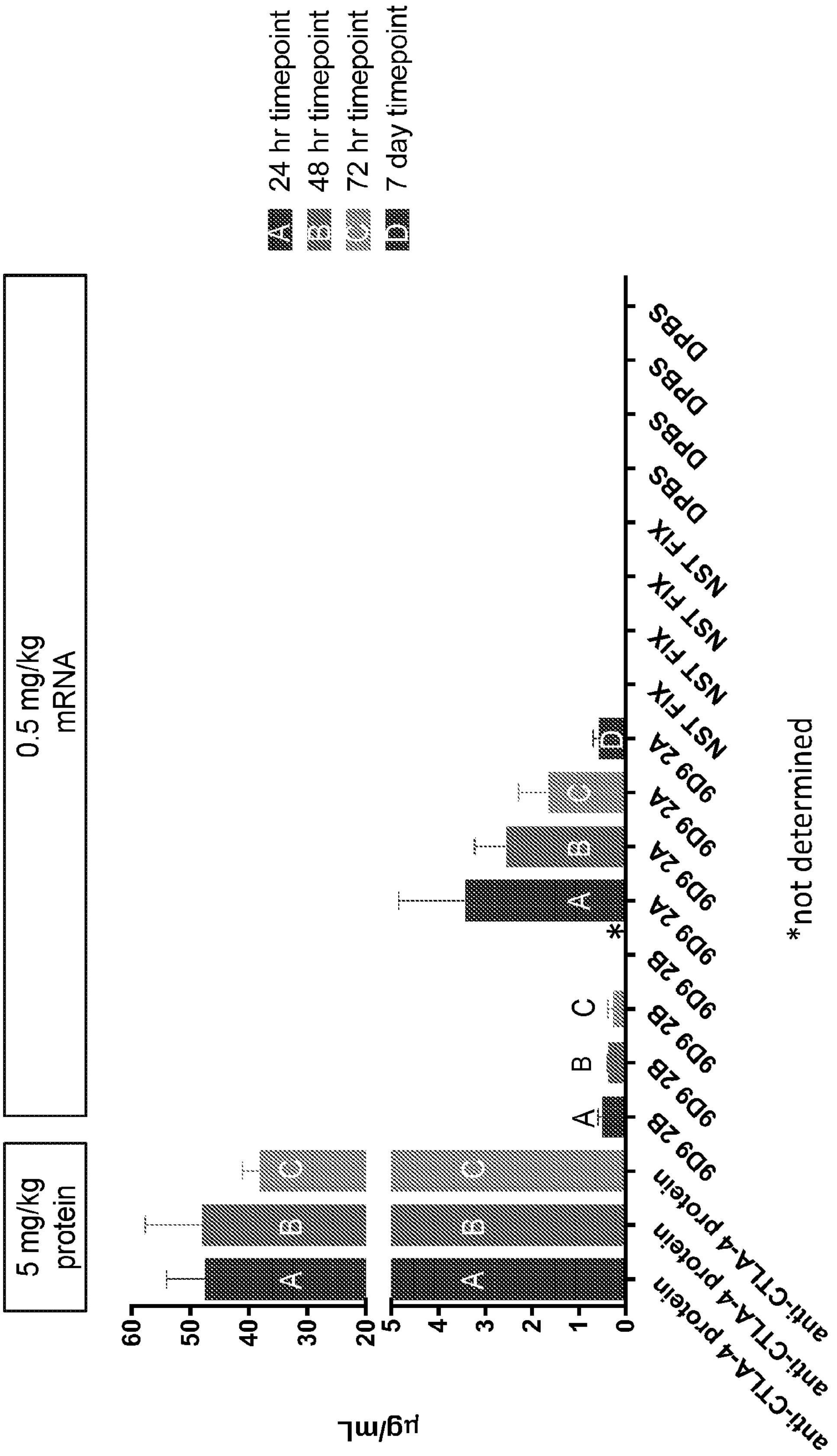

In contrast, the administration of 0.5 mg/kg mRNA encoding anti-CTLA-4 antibodies resulted in serum levels as low as 0.5 μg/mL (see FIG. 6). Serum levels of 9D9 2a antibody expressed after mRNA injection decreased from approximately 3.3 μg/mL at the 24 hours timepoint to approximately 2.8 μg/mL at the 48 hours timepoint. At the 72 hours timepoint the serum concentration had further decreased to approximately 1.7 μg/mL, and at the 7 day timepoint the serum concentration was approximately 0.5 μg/mL. Expression levels for 9D9 2b were considerably lower than the expression levels observed for the 9D9 2a antibody, e.g., at the 24 hours timepoint the total expression level of 9D9 IgG2b was approximately 0.5 μg/mL. See FIG. 6.

When measurements as described above were taken through Day 69 post cancer cell implantation/disease induction, there were only 2 animals remaining ("on study") that appeared to have actively growing tumors. The mRNA encoding the 9D9 2a variant appeared to have yielded a 93-100% apparent complete response (CR) rate (depending on dose regimen). This is compared to a 57% apparent complete response rate after 3 doses of the 9D9 2b antibody protein, and a 21% complete response rate after 3 doses of the 9D9 2b mRNA.

Figure 7A:
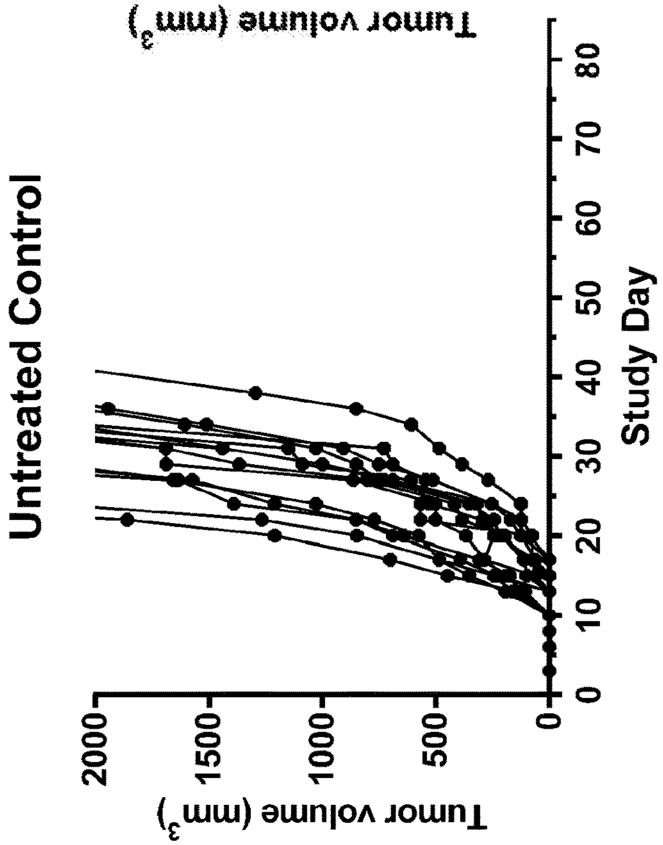
Figure 7B:
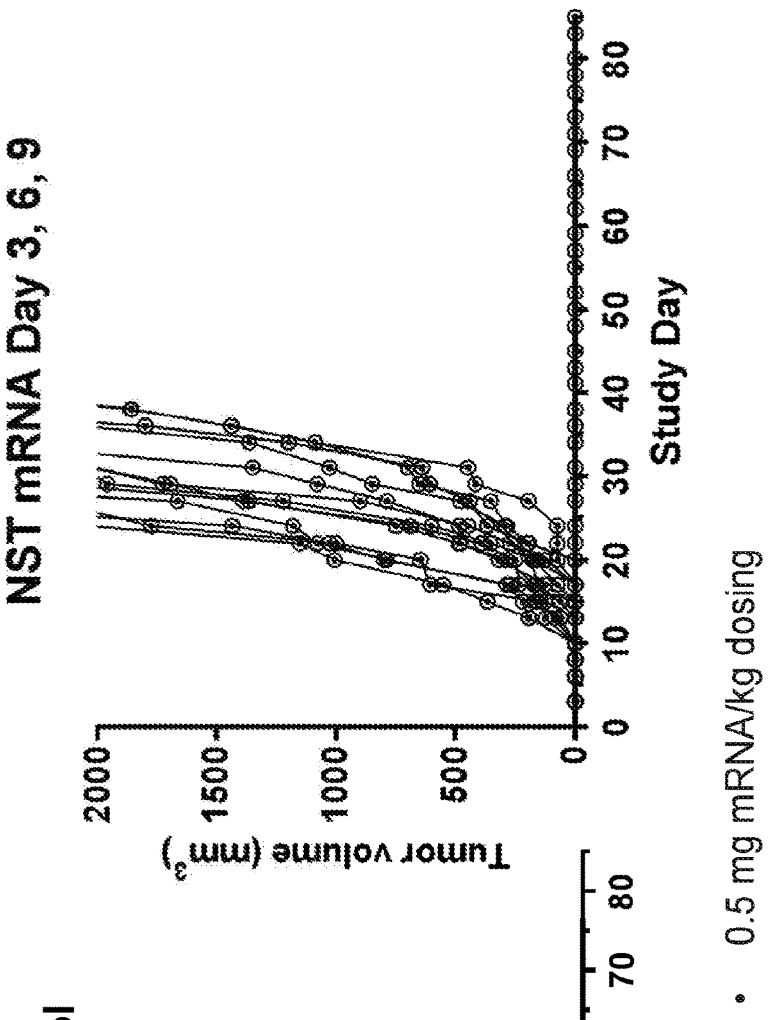
Figure 8:
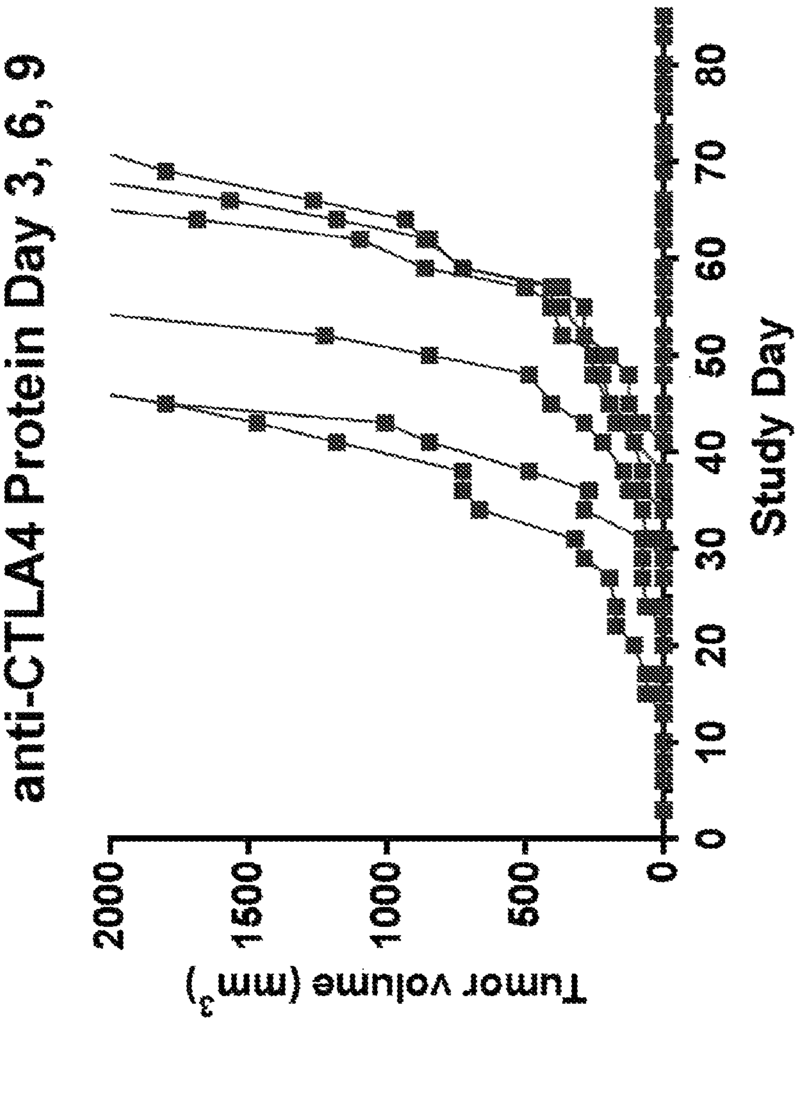

The measurements as described above in were also taken through Day 90 (post cancer cell implantation). FIG. 7A shows individual growth curves of the untreated arm of the study and FIG. 7B shows the negative control NST mRNA/LNP arm of the study. None of the untreated controls (0/14) survived to day 90. Only one of the NSP mRNA/LNP controls (1/14, i.e., 7% rate) survived to Day 90. However, when anti-CTLA-4 9D9 native antibody was administered in protein form in three 5 mg/kg doses at post-implantation days 3, 6 and 9, eight out of 14 animals survived to Day 90, i.e., the survival rate was 57%. See FIG. 8.

Figure 9:
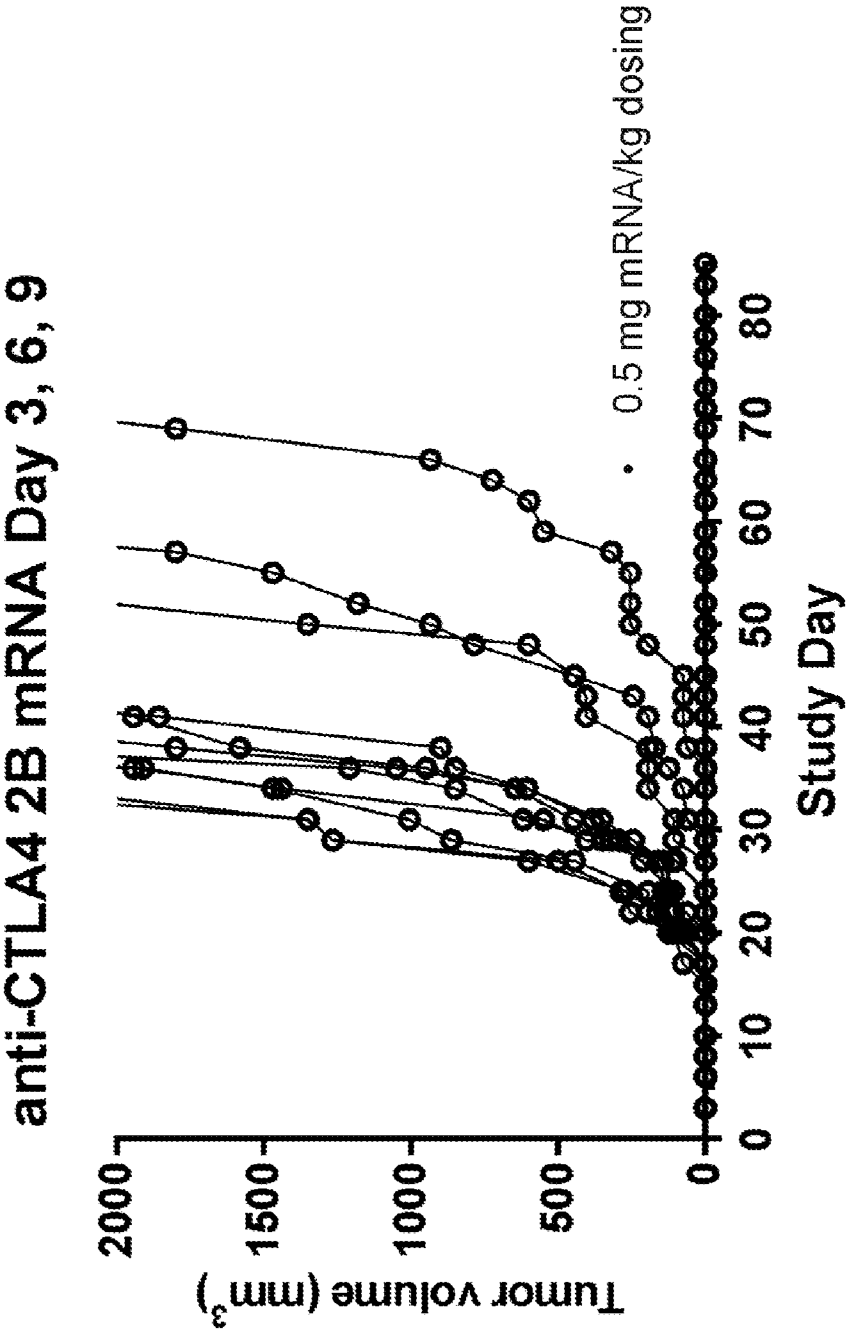

When mRNA encoding the anti-CTLA-4 9D9 2b antibody was administered in three 0.5 mg mRNA/kg doses at post-implantation days 3, 6, and 9, three out of 14 animals survived to Day 90, i.e., their survival rate was 21%. Note, however, that whereas none of the control animals survived past Day 40, three of the mRNA-treated animals survived past Day 40. See FIG. 9.

Figure 10:
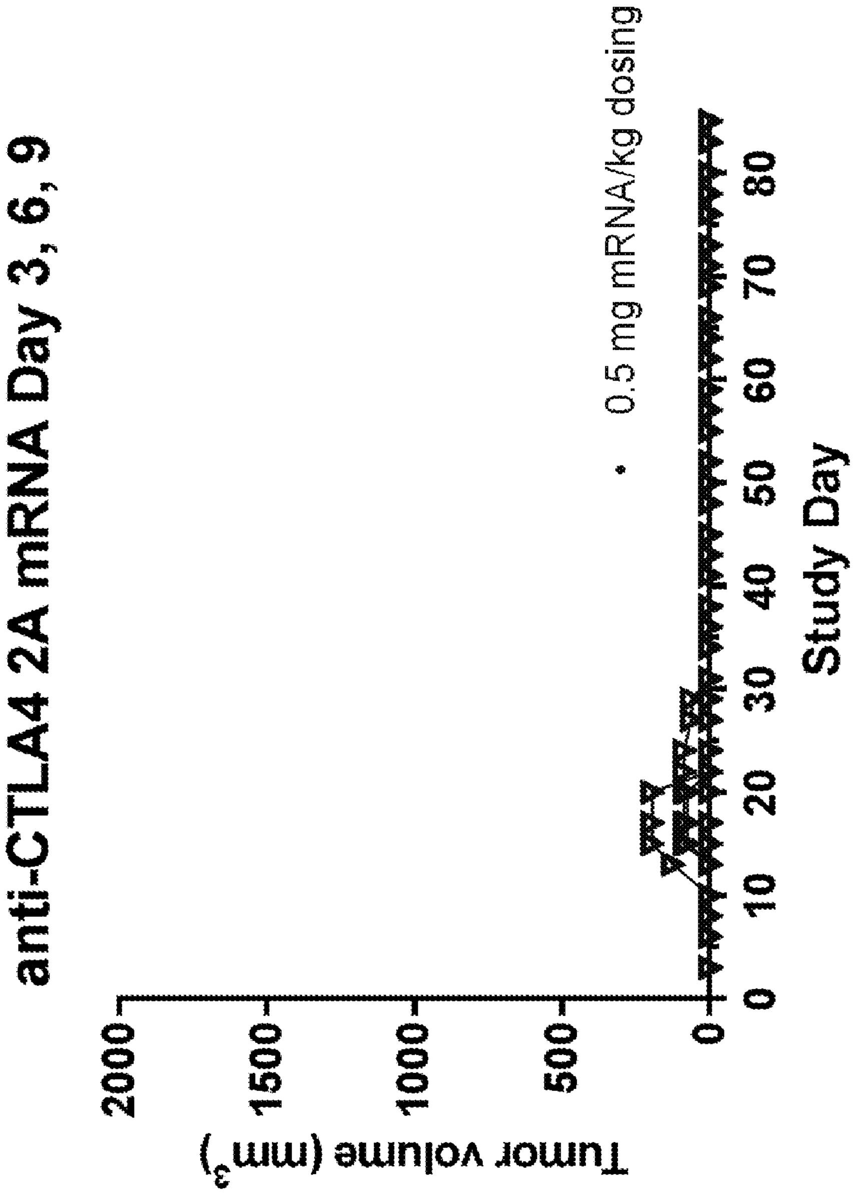
Figure 11A:
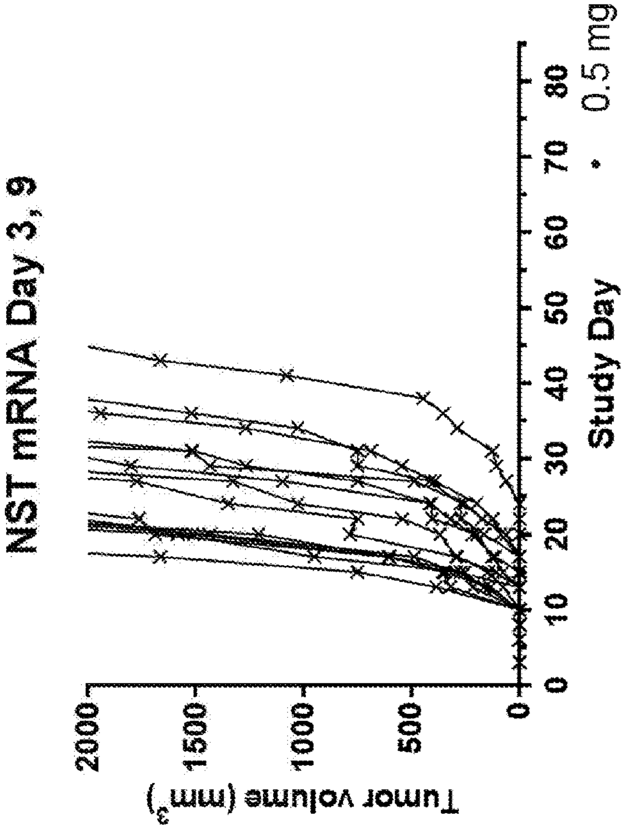
FIGS. 11A and 11B show individual tumor growth curves for animals treated with NST FIX mRNA control (FIG. 11A) and animals treated with mRNA designed to expressed anti-CTLA-4 9D9 2a (FIG. 11B). mRNAs were administered at 0.5 mg RNA/kg at day 3 and at day 9 after tumor implantation.
Figure 11B:
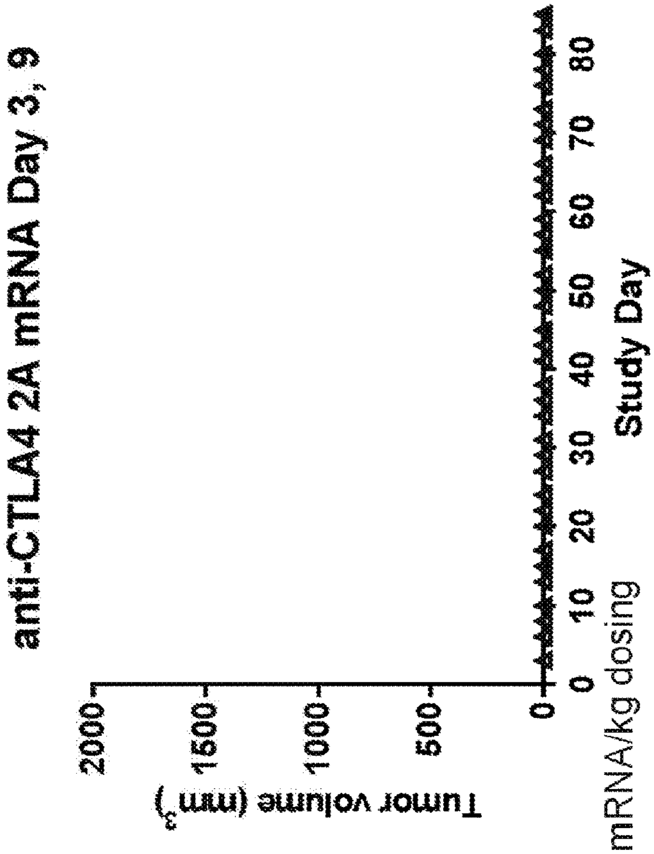
Figure 12B:
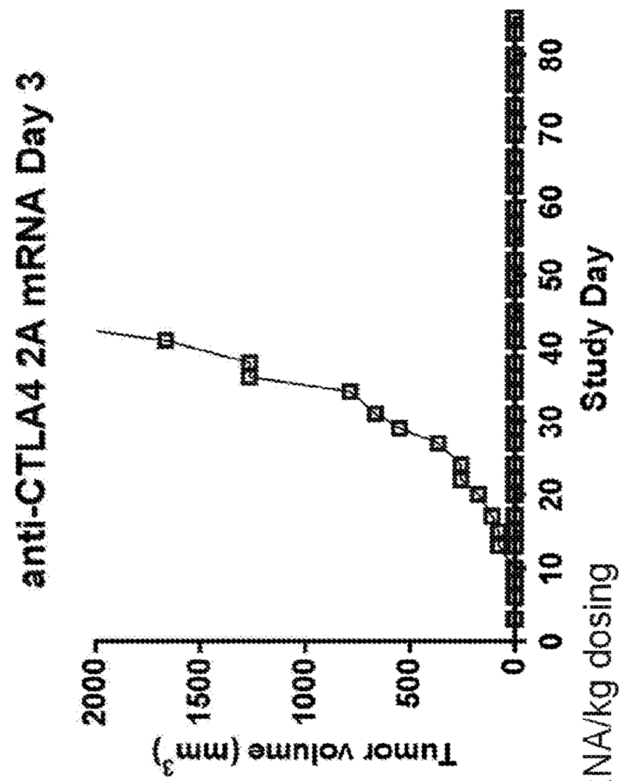
FIGS. 12A and 12B show individual tumor growth curves for animals treated with NST FIX mRNA control (FIG. 12A) and animals treated with mRNA designed to expressed anti-CTLA-4 9D9 2a (FIG. 12B). mRNAs were administered at 0.5 mg RNA/kg at day 3 after tumor implantation.
Figure 12A:
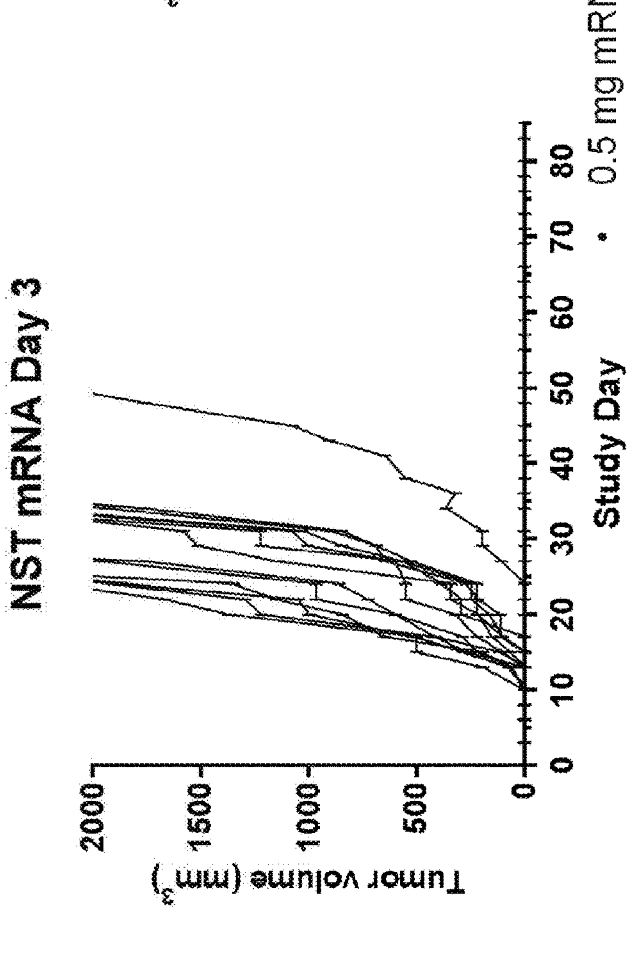
Figure 13:
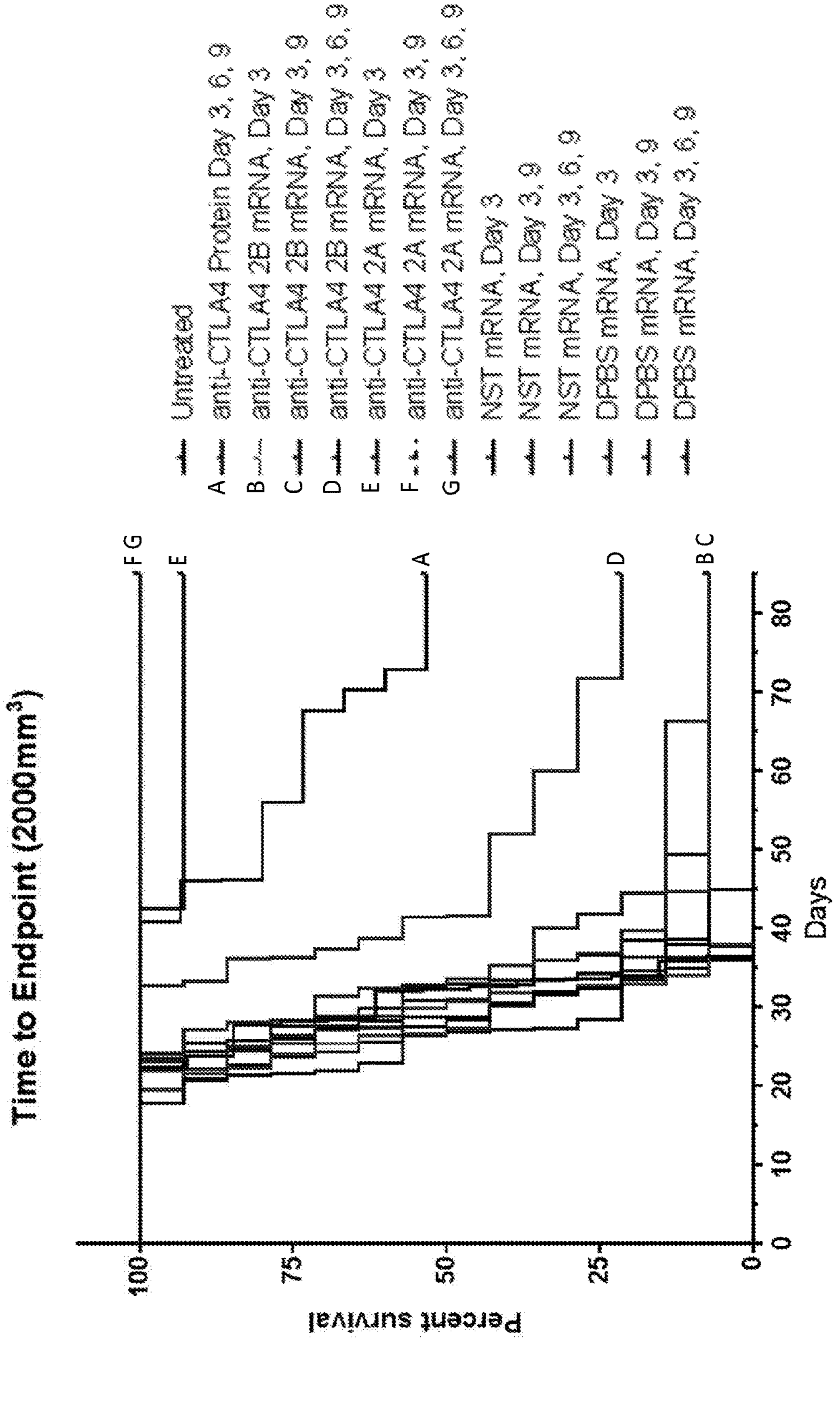
FIG. 13 shows the survival benefit from treatment with mRNAs encoding CTLA-4 antibodies.

When mRNA encoding the anti-CTLA-4 9D9 2b was administered under the same experimental conditions, 100% of the animals survived to Day 90. See FIG. 10. The same survival rate was observed when only two doses of mRNA were administered at day 3 and 9 of the study. See FIG. 11B and it control in FIG. 11A. Even when the mRNA administration was reduced to a single dose (see FIG. 12A and FIG. 12B), the survival rate was still 93% (13 out of 14). Survival curves showing the rates of survival after 1, 2 or 3 administrations are shown in FIG. 13.

When comparing response rates after administration of anti-CTLA-4 9D9 protein or mRNA form, it is important to note that the serum antibody concentration following protein administration was approximately 50 μg/ml, whereas the antibody concentration following mRNA administration was ~0.5-1.0 μg/mL (9B9 2a). Thus, even at serum antibody concentrations 50-100-fold lower, the efficacy for the mRNA-encoded antibody was far superior.

Again, these data demonstrate that a significant therapeutic effect for mRNA-encoded anti-CTLA-4 antibodies is achieved when mRNA is systemically administered at doses as low as 0.5 mg/kg in an in vivo CT26 mouse carcinoma model, and the such therapeutic effect when serum concentrations as low as 0.5 μg/mL.

These results indicate that targeting of CTLA-4 using mRNA-encoded antagonistic antibodies provides for effective immune responses against tumor cells and provides significant therapeutic benefit in combatting tumor growth.

Example 6

In Vivo Efficacy of a CD80Fc Chimera in a Colon Cancer Model

Prior studies of CD80Fc chimeric polypeptides have demonstrated the effectiveness of those polypeptides in treating mouse models of cancer. These data have been reported in studies such as Liu et al., *Clin. Cancer Res.* 11:8492-8502 (2005), hereby incorporated by reference in its entirety. Relevant methods and results from Liu et al. are summarized below in this Example.

A. Colon 26 Mouse Model of Melanoma

Colon 26 cells ($5\times10^6$ cells) were implanted into the left flank of 6-week old C57BL/6J mice to establish a colon cancer model. Treatment was started when tumors reached 0.5 cm in diameter. At 5, 6, 7, 8, and 9 days post implantation, chimeric polypeptides or isotype control antibodies were introduced intravenously as a 0.1 mL inoculum. For each tested polypeptide and polypeptide concentration, 5 mice were treated and the tumor volume was measured daily for 19 days after implantation. FIG. 14 presents the structure of the tested chimeric CD80Fc construct. FIG. 15 presents the average tumor volume for each group.

B. Results

Wang et al. tested six different CD80Fc concentrations' effectiveness in the Colon 26 mouse model of melanoma described above: 40 μg (open square); 20 μg (closed triangle); 10 μg (open triangle); 5 μg (closed circle); 1 μg (open circle); and 0.5 μg (ex mark). For comparison, mice were also treated with an isotype control antibody (closed square). As shown in FIG. 15, concentrations of CD80Fc above 5 μg significantly reduced tumor volume. Mice treaded with 40 μg CD80Fc showed a complete regression of implanted tumors. These data indicate that, once a signaling threshold has been reached, CD80 signaling facilitates significant anti-tumor activity against colon cancer.

Example 7

In Vitro Expression and Binding Capability of CD80Fc

Expression of chimeric CD80Fc polypeptides were measured in cancer cells following transfection with polynucleotides comprising a modified mRNA encoding a murine or human chimeric polypeptide. Polynucleotides used in this example comprised mRNAs encoding: (1) murine CD80's extracellular domain linked to murine IgG2Aa Fc domain ("mCD80-mIgG2Aa Fc"), (2) murine CD80's extracellular domain linked to murine IgG1 Fc domain with the D265A mutation ("mCD80-mIgG1 Fc D265A"), or (3) human CD80 linked to human IgG1 Fc domain ("HuCD80-hIgG1 Fc"). To measure expression, HeLa cells were seeded in 6-well plates and transfected with mCD80-mIgG2Aa Fc, mCD80-mIgG1 Fc D265A, or HuCD80-hIgG1 Fc. Control HeLa cells were mock-treated to mimic transfection. Following transfection, expression of chimeric CD80Fc constructs was determined. As illustrated in FIG. 16, all chimeric CD80Fc constructs were expressed at greater than 2000 ng/mL.

The ability of the CD80Fc polypeptides to interact with mouse CTLA-4 receptor was also determined. As shown in FIG. 17, both human and mouse CD80Fc polypeptides were able to specifically interact with CTLA-4.

Example 8

Costimulation of Jurkat IL-2 Production by CD80Fc

To measure the ability of chimeric CD80Fc polypeptides to provide costimulatory signal in cells, IL-2 production was measured in Jurkat cells after treatment with the CD80Fc polypeptides. Jurkat cells were first treated with PHA to provide primary T cell receptor signaling. Cells were then either mock treated or treated with a specific concentration of CD80Fc polypeptide that had been expressed from modified mRNA. Polynucleotides used in this example comprised mRNAs encoding (1) murine CD80's extracellular domain linked to murine IgG2Aa Fc domain ("mCD80-IgG2Aa Fc") or (2) human CD80 linked to human IgG1 Fc domain encoding "huCD80 Fc" and "rhuCD80Fc" respectively). Each chimeric polypeptide was administered at a range of concentrations including 62.5 ng/mL, 125 ng/mL, 250 ng/mL, 500 ng/mL, and 1000 ng/mL.

Each chimeric CD80Fc construct stimulated IL-2 secretion in a dose-dependent manner (see FIG. 18). Both mCD80-IgG2Aa Fc and rhuCD80Fc stimulated release of high levels of IL-2, with the mouse protein being slightly more potent. While the IL-2 secretion in response to huCD80Fc was less than the other chimeric CD80Fc polypeptides, huCD80Fc still showed a significant increase in IL-2 secretion relative to mock treated cells.

Example 9

In Vivo Efficacy of Modified mRNAs Encoding CD80Fc Polypeptides

In vivo efficacies of mRNAs encoding CD80Fc polypeptides were assessed in a B-cell lymphoma model.

A. Preparation of CD80Fc Modified mRNA

Each polynucleotide comprising a modified mRNA encoding a CD80Fc polypeptide was prepared as described above (CD80Fc IgG1 (D265A) and CD80Fc IgG2a). A negative control mRNA was also prepared (non-translatable version of the Factor IX mRNA containing multiple stop codons; NST-FIX). Both modified mRNAs were formulated in the same manner (Cap1, G5 RP mRNA in 1.5 mol % DMG MC3 LNP).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumor were monitored for size and palpability.

Once the tumors reached a mean size of approximately 100 $mm^3$, animals were separated into three groups of 12 mice each. Group I (control) was treated with a 12.5 μg dose of negative control mRNA, NST-FIX at each treatment time point. Group II was treated with repeated intratumoral doses of CD80Fc IgG1 (D265A) mRNA at a dose of 12.5 μg mRNA. Group III was treated with repeated intratumoral doses of CD80Fc IgG2a mRNA at a dose of 12.5 μg mRNA. Animals were dosed on Days 18, 25 and 32. Results are shown in FIGS. 19A, 19B, and 19C as a plot of tumor volume over time.

The study was carried out through Day 38. Otherwise, endpoints in the study were either death of the animal or a tumor volume reaching 2000 $mm^3$.

C. Results

FIG. 19A shows individual tumor growth in animals treated with control NST-FIX mRNA. FIG. 19B shows individual tumor growth in animals treated with CD80Fc IgG1 (D265A) mRNA. FIG. 19C shows individual tumor growth in animals treated with CD80Fc IgG2a mRNA. Multiple doses of the control modified mRNA had little effect on the tumor volume. In contrast, multiple doses of CD80Fc IgG2a mRNA reduced or decreased the size of tumors in some animals and inhibited the growth of tumors in some animals. Of the 12 mice given CD80Fc IgG2a mRNA, 7 mice had tumors whose size remained below 500 $mm^3$ at the study endpoint (see FIG. 19C, shaded area). In contrast, 11 of the 12 mice in the control group had tumors whose size was larger than 500 $mm^3$ at the study endpoint (see FIG. 19A). Treatment with CD80Fc IgG1 (D265A) mRNA had little effect on tumor volume, though one animal treated with CD80Fc IgG1 (D265A) mRNA had a complete response (i.e., tumor elimination). These data indicate that chimeric CD80Fc mRNA treatment reduces tumor growth and facilitates tumor elimination in a B-cell lymphoma model of cancer, particularly when paired with IgG2a Fc.

Example 10 mRNA Encoding Constitutively Active TLR4 mRNAs encoding constitutively active TLR4 ("caTLR4") were prepared from wild type human or mouse TLR4 sequences. The sequence encoding the wild type TLR4 signal peptide was replaced with a sequence encoding a human lysosome-associated membrane protein 1 ("hLAMP1") or mouse immunoglobulin kappa variable ("mIgk") signal peptide. The sequence encoding the TLR4 extracellular leucine-rich repeat domain ("LRR") domain was deleted and replaced with a sequence encoding a FLAG epitope having the motif DYKDDDDK (SEQ ID NO: 1258). Sequences encoding the TLR4 transmembrane domain ("TM") and intracellular toll/interleukin-1 receptor-like domain ("TIR") were retained in the mRNAs. Some of the mRNAs encoding caTLR4 were also prepared with a miR122 target site. Example mRNA and corresponding amino acid sequences are shown below.

FIG. 20 shows the structure of caTLR4 encoded by the mRNAs as compared to wild type TLR4.

Example 11

In Vitro Expression and Bioactivity of caTLR4 mRNA

Expression of caTLR4 mRNAs was confirmed by cell-free translation by QC. As shown in FIG. 21, human caTLR4 was expressed from an mRNA without any microRNA ("miR") target sites ("Hs caTLR4 miRless") as well as from an mRNA containing a miR122 target site ("Hs caTLR4 miR122"). Mouse caTLR4 was also expressed from an mRNA containing a miR122 target site ("Mm caTLR4 miR122").

The activity of the caTLR4 mRNAs was confirmed in vitro in THP1-Blue™ NF-κB cells (InvivoGen, San Diego, Calif.). THP1-Blue™ NF-κB cells have a stably integrated NF-κB-inducible secreted embryonic alkaline phosphatase (SEAP) construct. Expression of caTLR4 in these cells leads to activation of NF-κB and induction of SEAP expression, with SEAP levels in cell culture supernatant determined with QUANTI-Blue™ (InvivoGen, San Diego, Calif.) detection reagent and spectrophotometry at 620-655 nm according to manufacturer protocols.

Briefly, THP1-Blue™ MNF-κB cells were transfected with control mRNA, HS caTLR4 miRless, Hs caTLR4 miR122, or Mm caTLR4 miR122. Additional THP1-Blue™ NF-κB cells were infected with *Listeria monocytogenes* or were exposed to lipopolysaccharide (LPS). Alkaline phosphatase activity was then determined at different times after transfection with mRNA, infection with *Listeria*, or exposure to LPS. As shown in FIG. 11, expression of caTLR4 mRNAs induced alkaline phosphatase activity within 6 hours after transfection versus minimal levels observed with control mRNA transfection, *Listeria* infection, and LPS exposure. A continued response associated with transfection of caTLR4 mRNAs was observed at 18 hours (FIG. 22) and 30 hours (data not shown).

Example 12

In Vivo Activity of caTLR4 mRNA in Cancer Models

A mouse model of B-cell lymphoma was utilized to determine the in vivo effect of caTLR4 mRNA expression on tumor volume.

Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous B-cell lymphoma tumors. Tumors were measured for size ($mm^3$) over 30-40 days. Following implantation, mice were injected with intratumoral doses of either: (1) 12.5 μg of mRNA encoding NST FIX at 18, 25, and 32 days, (2) 12.5 μg of mRNA encoding mouse caTLR4 and containing a miR122 target site at 18, 25, and 32 days, (3) 3 μg of mRNA encoding NST 2001, (4) 0.5 g of interleukin-12 and 2.5 μg of mRNA encoding NST FIX, or (5) 0.5 μg of interleukin-12 and 2.5 μg of mRNA encoding caTLR4. Results are shown in FIGS. 23A, 23B, and 24A-24C.

Example 13

In Vitro Cell Surface Expression of an OX40L Polypeptide

Expression of an OX40L polypeptide was measured on the surface of cancer cells following treatment with a polynucleotide comprising an mRNA encoding an OX40L polypeptide.

A. Formulation of mOX40L_miR122

A polynucleotide comprising an mRNA encoding an OX40L polypeptide (murine OX40L) and further comprising a miRNA binding site (miR-122) was used in this example (mOX40L_miR122; SEQ ID NO: 1207). The OX40L modified mRNA was formulated in lipid nanoparticles (LNP) as described herein. (Moderna Therapeutics, Cambridge, Mass.).

B. Analysis of OX40L Cell-Surface Expression

Mouse melanoma cells (B16F10, ATCC No. CRL-6475; ATCC, Manassas, Va.) were seeded in 12-well plates at a density of 140,000 cells per well. Increasing doses of mOX40L_miR122 (SEQ ID NO: 1207; see FIG. 25) formulated in LNPs were added to each well directly after seeding the cells. Doses of mOX40L_miR122 included 6.3 ng, 12.5 ng, 25 ng, or 50 ng mRNA per well. Control cells were either mock-treated or treated with negative control mRNA (non-translatable version of the same mRNA containing multiple stop codons).

Following treatment, cell surface expression of OX40L was detected using flow cytometry. Cells were harvested by transferring the supernatants to a 96-well Pro-Bind U-bottom plate (Beckton Dickinson GmbH, Heidelberg, Germany). Cells from each well were then lifted with trypsin-free chelating solution, and stained with PE-conjugated anti-mouse OX40L antibody (R&D Systems, Minneapolis, Minn.) and visualized by flow cytometry. The results are shown in FIG. 26.

C. Results

FIG. 26 shows a dose-dependent expression of OX40L on the surface of B16F10 cancer cells after treatment with OX40L modified mRNA. All four doses of mOX40L_miR122 generated significant OX40L expression on the cell surface compared to control samples.

These results show that administering an OX40L modified mRNA results in expression of an OX40L polypeptide on the surface of target cells.

Example 14

In Vitro Expression Kinetics of OX40L on Cell Surface

In this example, expression levels of an OX40L polypeptide on the surface of cancer cells were measured over time. Quantitation of OX40L protein expression was also measured.

A. Formulation of mOX40L_miR122

A polynucleotide comprising an mRNA encoding an OX40L polypeptide (murine OX40L or human OX40L) and further comprising a miRNA binding site (miR-122) was used in this example (mOX40L_miR122, SEQ ID NO: 1207; hOX40L_miR122, SEQ ID NO: 1206). The OX40L modified mRNA was formulated in either lipid nanoparticles (LNP) as described above in Example 1 or formulated in LIPOFECTAMINE 2000 (L2K) (ThermoFisher Scientific, Waltham, Mass.) according to the manufacturer's instructions.

B. Cell Lines

Human cervical carcinoma cells (HeLa, ATCC No. CCL-2; ATCC, Manassas, Va.) were seeded at a density of 250,000 cells per well in 6-well plates. 24-hours post-seeding, L2K-formulated mOX40L_miR122 or hOX40L_miR122 containing 3 μg of mRNA was added to each well. The cells were treated with mOX40L_miR122 or hOX40L_miR122 in the presence or absence of 50 μg/ml mitomycin C 24 hours post-transfection.

Mouse colon adenocarcinoma cells (MC-38; Rosenberg et al., *Science* 233(4770):1318-21 (1986)) were seeded at a density of 300,000 cells per well in 6-well plates. LNP-formulated mOX40L_miR122 containing 3 μg of mRNA was added to each well 24 hours after seeding the cells. The MC-38 cells were treated with mOX40L_miR122 in the presence or absence of 25 μg/ml mitomycin C.

Control cells were mock-treated. Cell surface expression of OX40L was measured on Days 1, 2, 3, 5, and 7 following treatment with mOX40L_miR122 and Days 1, 2, 3, 4, and 5 following treatment with hOX40L_miR122. Cells were harvested and analyzed by flow cytometry as described above. The results for cells treated with mOX40L_miR122 are shown in FIG. 27A-27D; the results for cells treated with hOX40L_miR122 are shown in FIG. 27E. Cell lysates and cell culture supernatants were also harvested and analyzed for OX40L protein expression (quantitated in nanograms per well). The results for mouse and human OX40L protein quantitation following treatments are shown in FIGS. 27F and 27G, respectively.

C. Results

FIG. 27A-27D shows that OX40L was detected on the surface of HeLa cells out to at least Day 7 after treatment with mOX40L_miR122. FIG. 27A-27D also shows that cell surface expression of OX40L on MC-38 cells treated with mOX40L_miR122 returned to baseline by Day 5 after treatment. In both cell lines, the gradual reduction in cell surface expression levels of OX40L over time was blocked by the presence of mitomycin C. FIG. 27E shows that human OX40L expression was detected on the surface of HeLa cells out to at least Day 5 after treatment with hOX40L_miR122.

No significant shedding of the OX40L polypeptide was detected in culture supernatants. This suggests that the OX40L expressed from mRNA was not actively shed from the cell surface, which was confirmed in FIGS. 27F and 27G. Twenty-four hours after treatment with mOX40L_miR122, hOX40L_miR122, or mock treatment, cell lysates were prepared using standard cell lysis buffers and methods for protein analysis. FIG. 27F and FIG. 27G show that both mOX40L_miR122 (FIG. 27F) and hOX40L_miR122 (FIG. 27G) produced proteins that were recognized by commercially available ELISAs. The majority of the expressed protein was associated with the cell lysate, with only approximately 0.1% of the produced protein detected in the supernatant of transfected cells.

These results show that treatment of cells with an OX40L modified mRNA results in expression of an OX40L polypeptide on the surface of target cells. These results also show that only minor amounts of protein are shed from transfected cells.

Example 15

In Vitro Biological Activity of OX40L

T-cell activation involves two concurrent cell signaling events: a primary signal from the T-cell receptor complex (e.g., CD3 stimulation) and a second signal from a costimulatory ligand-receptor interaction (e.g., OX40L/OX40R interaction). Kober et al., European Journal of Immunology 38:2678-2688 (2008). In this example, the costimulatory biological activity of OX40L expressed on the surface of cells treated with mOX40L_miR122 or hOX40L_miR122 was assessed.

A. Preparation of OX40L-Expressing Cells

Mouse melanoma cells (B16F10, ATCC No. CRL-6475; ATCC, Manassas, Va.) were seeded in 6-well plates at a density of 300,000 cells per well. Human cervical carcinoma cells (HeLa) were seeded in 6-well plates as described above. A polynucleotide comprising an mRNA encoding an OX40L polypeptide and further comprising a miR-122 binding site (mouse OX40L, mOX40L_miR122, SEQ ID NO:

1207; human OX40L, hOX40L_miR122, SEQ ID NO: 1206) was formulated in L2K as described above. 24 hours after seeding the cells, formulations containing 3 μg of mOX40L_miR122 or hOX40L_miR122 mRNA were added to each well. Control cells were either mock-treated or treated with negative control mRNA (non-translatable version of the same mRNA except with no initiating codons). The cells were incubated for 24 hours at 37° C.

B. Preparation of Naïve $CD4^+$ T-cells

Spleens from C57BL/6 mice were removed and processed using standard techniques in the art to generate single cell suspensions of spleenocytes. Total $CD4^+$ T-cells were isolated from the spleenocyte suspensions using a mouse CD4 T cell isolation kit (Miltenyi, San Diego, Calif.). Naïve human $CD4^+$ T-cells were isolated from human peripheral blood mononuclear cells (PBMCs) by depleting non-CD4 cells using a commercially available magnetic bead T cell isolation kit.

C. T-Cell Activation Assay 200,000 T-cells were added to each well of transfected B16F10 cells or HeLa cells in the presence of agonistic anti-mouse CD3 antibody (R&D Systems, Minneapolis, Minn.) or agonistic anti-human CD3 antibody and soluble anti-human CD28; and the cells were co-cultured for 72 hours (mouse) or 120 hours (human). A schematic of the assays is shown in FIG. 28A.

After co-culture with T-cells, mouse IL-2 production was measured using a mouse IL-2 ELISA. (mouse IL-2 DuoSet ELISA, R&D Systems, Minneapolis, Minn.). The amount of IL-2 produced by the $CD4^+$ T-cells serves as an indicator of T-cell activation. Results are shown in FIG. 28B. Human IL-2 production was measured using a human IL-2 ELISA (human IL-2 DuoSet ELISA, R&D Systems, Minneapolis, Minn.). Results are shown in FIGS. 28C, 28D, and 28E.

D. Results

FIG. 28B shows that OX40L expression on the surface of B16F10 cells treated with mOX40L_miR122 elicits a T-cell IL-2 response in vitro. The mOX40L_miR122 mRNA induced about 12 ng/ml of IL2. B16F10 cells treated with non-translated negative control mRNA showed baseline levels of T-cell activation comparable to mock-treated cells (i.e., about 6 ng/ml of IL2). Therefore, the mOX40L_miR122 mRNA induced about two fold higher IL2 expression compared to a control (mock treated or non-translated mRNA).

FIGS. 28C and 28D show that, in the presence of plate-coated anti-human CD3 antibody and soluble anti-human CD28 as the primary T-cell activators, co-culture with the OX40L mRNA transfected HeLa cells greatly enhanced IL-2 production. Without OX40L expression, little to no IL-2 production was detected. FIG. 28E shows a similar level of increased human IL-2 production when the same experiment was performed with pre-stimulated (i.e., non-naïve) $CD4^+$ T-cells.

These results show that the OX40L polypeptide is biologically active as a costimulatory molecule.

Example 16

In Vivo Expression Levels of OX40L Modified mRNA

To investigate in vivo expression levels of a polynucleotide comprising modified mRNA, a polynucleotide comprising an mRNA encoding luciferase and further comprising a miR-122 binding site was prepared (SEQ ID NO: 1210). The luciferase modified mRNA was formulated in MC3 LNP. (US Publication no. US20100324120).

A. MC-38 Colon Adenocarcinoma Mouse Model

MC-38 colon adenocarcinoma tumors were established subcutaneously in C57BL/6 mice. (Rosenberg et al., Science 233(4770):1318-21 (1986)).

B. Treatment with Luciferase Modified mRNA

Once the MC-38 tumors reached approximately 200 $mm^3$, mice were treated with a single intratumoral dose of 3.125 μg, 6.25 μg, 12.5 μg, 25 μg, or 50 μg of luciferase modified mRNA (SEQ ID NO: 1210; Cap1, G5 RP mRNA in 1.5% DMG MC3 LNP). Control animals were treated with intratumoral dose of PBS. 24 hours post-treatment, animals were anesthetized, injected with the luciferase substrate D-luciferin and the bioluminescence imaging (BLI) from living animals was evaluated in an IVIS imager 15 minutes later. Signals from tumor tissue were obtained and compared with signals from liver tissue in the same animal. Results are shown in FIG. 29.

C. Results

FIG. 29 shows that the luciferase signal in tumor tissue was detected out to 48 hours post-dosing. FIG. 29 also shows that the three highest doses of modified mRNA (50 μg, 25 μg, and 12.5 μg) yielded comparable luciferase signals in tumor tissue. The 12.5 μg dose of modified mRNA yielded a high tumor signal with a lower liver (normal tissue) signal in the MC-38 colon carcinoma mouse model.

These results show that administration of a polynucleotide comprising a modified mRNA and a miRNA binding site preferentially targets tumor tissues over normal tissues.

Example 17

In Vivo Dose-Dependent Expression of OX40L in B16F10 Tumors

In vivo expression of OX40L was assessed in a B16F10 tumor model.

A. Preparation of OX40L Modified mRNA

A polynucleotide comprising an mRNA encoding an OX40L polypeptide (murine OX40L) and further comprising a miRNA binding site (miR-122) was prepared (mOX40L_miR122; SEQ ID NO: 1207). The OX40L modified mRNA was formulated in MC3 LNP as described in US20100324120. Negative control mRNA was also prepared (OX40L_NST, SEQ ID NO: 1209; a non-translatable version of the same mRNA except no initiating codons).

B. Mouse Melanoma B16F10 Tumor Model

Subcutaneous B16F10 tumors were established in C57BL/6 mice. (Overwijk et al. *Current Protocols in Immunology* Ch. 20, Unit 20.1 (2001)).

Once the tumor size reached approximately 200 $mm^3$, animals were treated with a single intratumoral dose of mOX40L_miR122 (Cap1, G5 RP mRNA in 0.5 mol % DMG MC3 LNP) at a dose of 5 μg mRNA (approximately 0.25 mg/kg) or 15 μg mRNA (approximately 0.75 mg/kg). Control animals were treated with equivalent doses of negative control mRNA, OX40L_NST. Additional control animals were treated with PBS.

C. Measurement of OX40L in Tumor Tissue

Animals were sacrificed 8 hours and 24 hours after dosing. Tumor tissue was harvested and analyzed for expression of OX40L using a mouse OX40L ELISA assay (R&D Systems, Minneapolis, Minn.). Results are shown in FIG. 30 as the amount of OX40L present per gram of tumor tissue.

D. Results

FIG. 30 shows that a single intratumoral dose of 5 μg mOX40L_miR122 resulted in over 200 ng OX40 L/g tumor tissue at both 8 hours and 24 hours post dosing. FIG. 30 also shows that a single intratumoral dose of 15 μg mOX40L_miR122 resulted in over 500 ng OX40 L/g tumor tissue at both 8 hours and 24 hours post-dosing.

In contrast, less than 100 ng OX40L was detectable in the liver of animals treated with the higher 15 μg dose of mOX40L_miR122.

These data show that administration of mOX40L_miR122 results in significant levels of OX40L polypeptide expression in the tumor tissue.

Example 18

In Vivo Expression of OX40L in MC-38 Tumors

In vivo expression of OX40L was assessed in a MC-38 tumor model.

A. Preparation of OX40L Modified mRNA

A polynucleotide comprising an mRNA encoding an OX40L polypeptide (murine OX40L) and further comprising a miRNA binding site (miR-122) was prepared (mOX40L_miR122; SEQ ID NO: 1207). The OX40L modified mRNA was formulated in MC3 LNP as described above. A negative control mRNA was also prepared (non-translatable version of the same mRNA containing multiple stop codons; OX40L_NST; SEQ ID NO: 1209).

B. MC-38 Colon Adenocarcinoma Mouse Model

MC-38 colon adenocarcinoma tumors were established subcutaneously in C57BL/6 mice. (Rosenberg et al., *Science* 233(4770):1318-21 (1986)).

Once the tumors reached a mean size of approximately 100 $mm^3$, animals were treated with a single intratumoral dose of mOX40L_miR122 (Cap1, G5 RP mRNA in 1.5 mol % DMG MC3 LNP) at a dose of 12.5 μg mRNA. Control animals were treated with an equivalent dose of negative control mRNA, OX40L_NST. Additional control animals were left untreated ("NT"). For dose-response experiments, animals were administered an intratumoral injection of 3.125, 6.25, or 12.5 μg mOX40L_miR122; control animals were left untreated or treated with 12.5 μg negative control mRNA.

C. Measurement of OX40L in Tumor Tissue

To measure OX40L expression over time, animals were sacrificed 3, 6, 24, 48, 72, and 168 hours after dosing. Tumor tissue was harvested and analyzed for expression of OX40L using ELISA (R&D Systems, Minneapolis, Minn.), as described above in Example 5. Results are shown in FIG. 31A as the amount of OX40L present per gram of tumor tissue.

To measure OX40L expression as a function of dose-response, animals were sacrificed 24 hours after dosing and tumor tissue was harvested for analysis as described above. Tumor tissue, liver tissue, and spleen tissue were analyzed for quantity of OX40L protein (FIG. 31B-31D, upper) and mRNA (FIG. 31B-31D, lower).

Tumor cells were also analyzed for expression of OX40L on the cell surface using flow cytometry (data not shown). Tumor tissue was minced and processed through cell strainers to prepare single cell suspensions. Cell suspensions were stained with PE-conjugated anti-mouse OX40L antibody (R&D Systems, Minneapolis, Minn.), and visualized by flow cytometry.

D. Results

FIG. 31A shows that a single intratumoral dose of 12.5 μg mOX40L_miR122 resulted in up to 1200 ng OX40 L/g tumor tissue at 24 hours post dosing. The optical densities for two of the 24-hour OX40L-treated samples were above the standard range, resulting in underestimated values shown in FIG. 31A. FIG. 31A also shows OX40L expression was detectable in tumor tissue out to 168 hours (7 days) post dosing. In contrast, control treated animals showed no detectable OX40L in tumor tissue at any time point. FIG. 31B shows a dose-dependent increase in OX40L protein (upper) and mRNA (lower) in tumor tissue. FIGS. 31C and 31D show the presence of OX40L protein and mRNA in liver and spleen (respectively) are lower than the amounts present in the tumor tissue.

Flow cytometry results showed that approximately 6.5% of all live, tumor-associated cells were positive for OX40L expression (data not shown).

These data show that administration of mOX40L_miR122 results in significant levels of OX40L polypeptide expression in the tumor tissue.

Example 19

In Vivo Efficacy of OX40L Modified mRNA in a Colon Adenocarcinoma Model

In vivo efficacy of a polynucleotide comprising an mRNA encoding an OX40L polypeptide was assessed.

A. Preparation of OX40L Modified mRNA

A polynucleotide comprising an mRNA encoding an OX40L polypeptide (murine OX40L) and further comprising a miRNA binding site (miR-122) was prepared as described above (mOX40L_miR122; SEQ ID NO: 1207). A negative control mRNA was also prepared (non-translatable version of the same mRNA containing multiple stop codons; NT OX40L_miR122; SEQ ID NO: 1209). Both modified mRNAs were formulated in MC3 LNP as described above.

B. MC-38 Colon Adenocarcinoma Mouse Model

MC-38 colon adenocarcinoma tumors were established subcutaneously in C57BL/6 mice as described above.

Fourteen days after tumor cell inoculation, animals were treated twice weekly for three weeks with an intratumoral dose of MC3 LNP-formulated modified mRNA (15 μg mRNA per dose). Control animals were treated with an equivalent dose and regimen of negative control mRNA, NT OX40L_miR122 (SEQ ID NO: 1209).

Tumor volume was measured at the indicated time points using manual calipers. Tumor volume was recorded in cubic millimeters.

The in vivo efficacy study was carried out through Day 42 post-dosing. At the completion of the study, the full data sets were analyzed and presented in FIGS. 32A and 32B. Final Kaplan-Meier survival curves were prepared and are shown in FIG. 32C. Endpoints in the study were either death of the animal or a tumor volume reaching 1500 $mm^3$.

C. Results

FIG. 32A shows that administering a control modified mRNA had little effect on the tumor volume, as assessed at the study completion (Day 42 after the first dose). FIG. 32B shows that administering mOX40L_miR122 to the mice inhibited or slowed tumor growth in some animals and reduced or decreased the size of the tumor in some animals, as assessed at study completion (Day 42).

FIG. 32C shows that animals receiving mOX40L_miR122 had longer survival times as measured on Day 42 compared to control animals.

These data show that mOX40L_miR122 polynucleotides have anti-tumor efficacy when administered in vivo.

Example 20

In Vivo Expression of OX40L in A20 Tumors

Mouse models of B-cell lymphoma using the A20 cell line are useful for analyzing a tumor microenvironment. (Kim et al., Journal of Immunology 122(2):549-554 (1979); Donnou et al., Advances in Hematology 2012:701704 (2012)). Therefore, in vivo expression of OX40L and the tumor microenvironment were assessed in an A20 B-cell lymphoma tumor model.

A. Preparation of OX40L Modified mRNA

A polynucleotide comprising an mRNA encoding an OX40L polypeptide (murine OX40L) and further comprising a miRNA binding site (miR-122) was prepared as described above (mOX40L_miR122; SEQ ID NO: 1207). The OX40L modified mRNA was formulated in MC3 LNP as described above. A negative control mRNA was also prepared (non-translatable version of the same mRNA containing multiple stop codons; NT OX40L; SEQ ID NO: 1209).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumor were monitored for size and palpability.

Once the tumors reached a mean size of approximately 1300 $mm^3$, animals were separated into two groups. Group I was treated with a single intratumoral dose of mOX40L_miR122 (Cap1, G5 RP mRNA in 0.5 mol % DMG MC3 LNP) at a dose of 15 μg mRNA. Group II (controls) was treated with an equivalent dose of negative control mRNA, NT OX40L.

C. Measurement of OX40L in Tumor Tissue

Tumor tissue was harvested 24 hours after dosing and analyzed for expression of OX40L using ELISA (R&D Systems, Minneapolis, Minn.), as described above. Results are shown in FIG. 33A as the amount of OX40L present per gram of tumor tissue.

A20 tumor cells were also analyzed for cell surface expression of OX40L. Tumor tissue was minced and processed through cell strainers to prepare single cell suspensions. Cells were stained with anti-mouse OX40L antibody (goat IgG polyclonal, PE conjugated; R&D Systems, Minneapolis, Minn.) and anti-mouse CD45 antibody (clone 30-F11, PE-Cy5 conjugated; eBioscience, San Diego, Calif.) to identify leukocytes (i.e., A20 cancer cells and infiltrating immune cells). The cells were subsequently analyzed by flow cytometry. Results are shown in FIGS. 33B and 33C.

D. Results

FIG. 33A shows that a single intratumoral dose of 15 μg mOX40L_miR122 resulted in up to 250 ng OX40 L/g tumor tissue at 24 hours after dosing. In contrast, control treated animals showed less than 100 ng OX40L in tumor tissue 24 hours after dosing.

FIG. 33B shows that approximately 3% of all live, $CD45^+$ cells (i.e., tumor cells) expressed OX40L on the cell surface. In a similar experiment, approximately 15.8% total live cells from the tumor were found to express introduced OX40L, compared to less than 0.5% OX40L-positive live cells in tumors treated with the negative control mRNA (FIG. 33C).

These data show that administration of mOX40L_miR122 results in significant levels of OX40L polypeptide expression in the tumor tissue.

Example 21

In Vivo Pharmacodynamic Effects of OX40L

The ability of mOX40L_miR122 mediated OX40L expression to recruit natural killer (NK) cells to the tumor site was assessed.

A. A20 B-Cell Lymphoma Tumor Model

The B-cell lymphoma tumors described above in Example 8 were also assessed for NK cell infiltration following treatment. As described above, mice were treated with a single intratumoral dose of either mOX40L_miR122 or control NT OX40L mRNA (15 μg dose; Cap1, G5 RP mRNA in 0.5 mol % DMG MC3 LNP). 24 hours after dosing, tumors were harvested as described above and processed through cell strainers to prepare single cell suspensions.

B. Natural Killer Cell Infiltration

Single cell suspensions were incubated with anti-mouse NKp46 antibody (clone 29A1.4, PerCP-eFluor® 710 conjugated; eBioscience, San Diego, Calif.), which is specific to the NK cell marker p46 (CD335), and anti-mouse CD3 antibody (clone 145-2C11, FITC conjugated; BioLegend, San Diego, Calif.), which is specific to T-cells. The cells were analyzed based on $CD45^+$ expression for leukocyte, as well as NKp46 and CD3ε expression using flow cytometry. NK cells are $p46^+$ and $CD3^-$. Results are shown in FIGS. 34A and 34B.

C. Results

FIG. 34A shows that animals treated with mOX40L_miR122 exhibited approximately 5-fold increase in the relative number of NK cells within A20 tumors 24 hours after dosing. FIG. 34B shows the individual animal data from the same study.

These results show that treatment with a polynucleotide comprising an mRNA encoding an OX40L polypeptide increased the number of NK cells within the tumor microenvironment.

Example 22

In Vivo Efficacy of OX40L Modified mRNA in a B-Cell Lymphoma Model

In vivo efficacy of mOX40L_miR122 was assessed in a B-cell lymphoma model.

A. Preparation of OX40L Modified mRNA

A polynucleotide comprising an mRNA encoding an OX40L polypeptide (murine OX40L) and further comprising a miRNA binding site (miR-122) was prepared as described above (mOX40L_miR122; SEQ ID NO: 1207). A negative control mRNA was also prepared (non-translatable version of the Factor IX mRNA containing multiple stop codons; NST-FIX, SEQ ID NO: 1208). Both modified mRNAs were formulated in the same manner (Cap1, G5 RP mRNA in 1.5 mol % DMG MC3 LNP).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumor were monitored for size and palpability.

Once the tumors reached a mean size of approximately 100 $mm^3$, animals were separated into two groups. Group I was treated with repeated intratumoral doses of mOX40L_miR122 (Cap1, G5 RP mRNA in 1.5 mol % DMG MC3 LNP) at a dose of 12.5 μg mRNA. Group II (control) was treated with an equivalent dose of negative control mRNA, NST-FIX. Animals were dosed on Days 20, 23, 27, 30, 34, 37, 41, 44, 48, and 51. Results are shown in FIGS. 35A, 35B, 35C, and 35D.

The study was carried out through Day 57. Final Kaplan-Meier survival curves were prepared and are shown in FIG. 35D. Endpoints in the study were either death of the animal or a tumor volume reaching 2000 $mm^3$.

C. Results

FIG. 35A shows individual tumor growth in animals treated with control NST-FIX mRNA. FIG. 35B shows individual tumor growth in animals treated with mOX40L_miR122. Arrows represent dosing days. Multiple doses of a control modified mRNA had little effect on the tumor volume. In contrast, multiple doses of mOX40L_miR122 reduced or decreased the size of tumors in some animals or inhibited the growth of tumors in some animals.

FIG. 35C shows the average tumor size for each group as assessed at Day 35 of the study. These data show that administering mOX40L_miR122 reduced or inhibited tumor growth compared to treatment with control mRNA. The following formula was used to calculate the percentage of tumor growth inhibition (TGI) at Day 34 compared to Day 19:

$$TGI\ \%=[(Vc-Vt)/Vc-Vo)]\times 100$$

Using the formula above and the data shown in FIG. 35C, the TGI % for mOX40L_miR122 was 57%. In other words, animals treated with mOX40L_miR122 showed 57% tumor growth inhibition between Days 19 and 34 compared to control treated animals.

FIG. 35D shows that animals receiving mOX40L_miR122 had longer survival times as measured on Day 42 compared to control animals.

These data show that mOX40L_miR122 polynucleotides have anti-tumor efficacy when administered in vivo.

Example 23

In Vivo Memory Immune Response mOX40L_miR122 was assessed for its ability to induce an adaptive (memory) immune response in the MC-38 adenocarcinoma model.

A. Preparation of OX40L Modified mRNA

A polynucleotide comprising an mRNA encoding an OX40L polypeptide (murine OX40L) and further comprising a miRNA binding site (miR-122) was prepared as described above (mOX40L_miR122; SEQ ID NO: 1207). A negative control mRNA was also prepared (non-translatable version of the OX40L mRNA containing multiple stop codons; NST-OX40L, SEQ ID NO: 1209). Both modified mRNAs were formulated in the same manner (Cap1, G5 RP mRNA in 1.5 mol % DMG MC3 LNP).

B. MC-38 Colon Adenocarcinoma Model

MC-38 colon adenocarcinoma tumors were established subcutaneously in C57BL/6 mice as described above.

Seven days after tumor cell inoculation, animals were treated every three days (Q3D) for a maximum of 10 intratumoral doses of MC3 LNP-formulated modified mRNA (12.5 μg mRNA per dose). Control animals were treated with an equivalent dose and regimen of negative control mRNA, NT OX40L_miR122.

Tumor volume was measured at the indicated time points using manual calipers. Tumor volume was recorded in cubic millimeters. At Day 60 post-tumor inoculation, six apparent complete responder animals (CR) from the mOX40L_miR122 group were re-challenged with $5\times10^5$ MC-38 tumor cells; as a control, six naïve animals were also inoculated with $5\times10^5$ MC-38 cells. The results of the analysis are shown in FIGS. 36A and 36B.

C. Results

FIG. 36A shows individual tumor growth in animals treated with control NST-OX40L mRNA, mOX40L_miR122, or PBS. FIG. 36A shows that 6 out of 15 animals administered mOX40L_miR122 (40%) exhibited a complete response with no significant tumor growth as measured on Day 60. In comparison, animals administered the negative control mRNA construct or PBS showed significant tumor growth through Day 60. (FIG. 36A). These results show that administering an mRNA encoding an OX40L polypeptide reduces or decreases the size of a tumor or inhibits the growth of a tumor.

At Day 60, six complete responders ("CR") from the mOX40L_miR122 group and six naïve control animals were re-challenged with MC-38 cells. FIG. 36B shows individual tumor growth in animals re-challenged with MC-38 cells. Animals previously administered mOX40L_miR122 showed no tumor growth (0/6 animals) for 23 days after re-challenge with tumor cells. In comparison, 67% (6/9 animals) of the animals in the naïve control group showed tumor growth at Day 23. These results show that administering an mRNA encoding an OX40L polypeptide induces a memory immune response with anti-tumor effects.

Example 24

Sustained In Vivo Expression of OX40L in A20 Tumors

In vivo expression of OX40L in the tumor microenvironment was assessed in an A20 B-cell lymphoma tumor model at various timepoints after one and/or two doses of a polynucleotide comprising an mRNA encoding an OX40L polypeptide.

A. Preparation of OX40L Modified mRNA

A polynucleotide comprising an mRNA encoding an OX40L polypeptide (murine OX40L) and further comprising a miRNA binding site (miR-122) was prepared as described above (mOX40L_miR122; SEQ ID NO: 1207). The OX40L modified mRNA was formulated in MC3 LNP as described above. A negative control mRNA was also prepared (non-translatable version of the same mRNA containing multiple stop codons; NST-OX40L; SEQ ID NO: 1209).

B. A20 B-Cell Lymphoma Tumor Model

B-cell lymphoma tumors were established as described above. Once the tumors reached a mean size of approximately 1300 $mm^3$, animals were separated into three groups. Group I was treated with a single intratumoral dose of mOX40L_miR122 (Cap 1, G5 RP mRNA in 0.5 mol % DMG MC3 LNP) at a dose of 15 μg mRNA. Group II (control) was treated with an equivalent dose of negative control mRNA, NT OX40L. Group III was treated with an intratumoral injection of PBS. Each group also comprised a sub-group of animals that received a second dose of mRNA or PBS 7 days after the first dose.

C. Measurement of OX40L Expression

Live cells from A20 tumor cells were analyzed for cell surface expression of OX40L. Tumor tissue was minced and processed through cell strainers to prepare single cell suspensions. Live cells were stained with anti-mouse OX40L antibody (goat IgG polyclonal, PE conjugated; R&D Systems, Minneapolis, Minn.). The cells were subsequently analyzed by flow cytometry. Results are shown in FIG. 37.

D. Results

FIG. 37 shows statistically significant OX40L expression at 24 hours, 72 hours, and 7 days after a single dose of mOX40L_miR122. In particular, FIG. 37 shows that OX40L expression in A20 tumors is sustained at 72 hours and 7 days after a single dose of mOX40L_miR122. These data In animals receiving a second dose, statistically significant OX40L expression was detected 24 hours after the second dose of mOX40L_miR122.

These data show that administration of mOX40L_miR122 results in significant, sustained levels of OX40L polypeptide expression in the tumor tissue.

Example 25

Identity of Cell Types Expressing OX40L after mRNA Treatment

The identity of cell types expressing OX40L post-mRNA treatment within A20 and MC38 tumors was evaluated. A polynucleotide comprising an mRNA encoding an OX40L polypeptide (murine OX40L) and further comprising a miRNA binding site (miR-122) was prepared as described above. Mouse models of A20 tumors and MC38 tumors were established as described above.

A. Cell Differentiation by Flow Cytometry

Cells within A20 tumors were differentiated by CD19 and CD45 antibodies, which identify CD 19-expressing B-lymphoma A20 cancer cells ($CD19^+$, $CD45^+$) from the non-cancer immune infiltrates ($CD19^-$, $CD45^+$) and the non-cancer/nonimmune cells ($CD19^-$, $CD45^-$), respectively. Results are shown in FIG. 38A. Cells within MC38 tumors were differentiated by CD45 marker to differentiate infiltrating host immune cells ($CD45^+$) from cancer cells and non-immune host cells ($CD45^-$). Results are shown in FIG. 38B. Immune infiltrate cells were differentiated with CD11b antibody. $CD11b^+$ immune infiltrate cells were separately analyzed for OX40L expression. Results are shown in FIG. 38C.

B. Results

FIG. 38A shows that in A20 tumors treated with mOX40L_miR122, 76% of the OX40L expressing cell population were the A20 tumor cells themselves, whereas approximately 19% of the OX40L positive cell population were infiltrating immune cells within the A20 tumors. The population of OX40L expressing host immune cells was shown to be predominantly myeloid lineage cells, as determined by positive staining for CD11b. Of the $CD11b^+$ myeloid lineage cells in the A20 tumors, an average of 25.4% were positive for OX40L expression (FIG. 38C).

FIG. 38B shows that in MC38 tumors, the majority of OX40L positive cells were cancer cells (an average of 57.3%), while 35.6% of the positive cells were immune infiltrates, again primarily derived from myeloid lineage ($CD45^+$, CD11b+).

These data show that administration of mOX40L_miR122 results in OX40L expression in a significant percentage of the tumor environment post-intratumoral mRNA administration, and that a majority of OX40L-expressing cells were cancer cells followed by myeloid immune cell infiltrates.

Example 26

Modulation of Immune Cell Populations within Tumors Treated with OX40L mRNA

Given the demonstrated activity of OX40L on innate immune natural killer (NK) cells and adaptive CD4+/CD8+ T cells, the objective of the following studies was to evaluate the pharmacodynamic effects of OX40L intratumoral treatment on tumor-associated immune cell populations. Mouse A20 and MC38 tumor models were established as described above.

A. Cell Differentiation by Flow Cytometry

A20 tumors were treated with a single 12.5 μg dose of mOX40L_miR122 or control mRNA (RNA/LNP) formulated in lipid nanoparticles. Tumor samples were initially analyzed 24 hours following treatment. NK cells were differentiated using an antibody against the mature NK cell surface marker, DX5. Results are shown in FIG. 39A. Other tumor samples were analyzed 14 days after treatment with mOX40L_miR122. $CD4^+$ and $CD8^+$ T-cells were identified using anti-mouse CD4 and anti-mouse CD8 antibodies, respectively. Results are shown in FIG. 39B-39C.

A similar experiment was performed in the MC38 tumor model. Mice with MC38 tumors were administered a single intratumoral injection of mOX40L_miR122 or NST-OX40L. In some animals a second dose of mRNA was administered 6 days after the first dose. Immune cell infiltrate was assessed for $CD8^+$ cells 24 hours and 72 hours after each dose of mRNA. Results are shown in FIG. 39D.

B. Results

FIG. 39A shows that 24 hours after administration of mOX40L_miR122 to A20 tumors, NK cells infiltration significantly increased in OX40L-dosed animals compared to controls. FIG. 39B-39C show that 14 days after administration of mOX40L_miR122 to A20 tumors, both $CD4^+$ (FIG. 39B) and $CD8^+$ (FIG. 39C) T-cell infiltration into the tumor microenvironment significantly increased compared to control tumor samples.

FIG. 39D shows a significant increase in infiltrating $CD8^+$ T-cells 72 hours after a second dose of mOX40L_miR122 in MC38 tumors compared to control treated tumors.

These data from two tumor models demonstrate that administration of a polynucleotide comprising an mRNA encoding an OX40L polypeptide promotes increased numbers of both innate and adaptive immune cells within the tumor microenvironment.

Example 27

In Vivo Efficacy in A20 Tumors

In vivo efficacy was assessed in the A20 tumor model. A20 tumors were established as described above.

A. Tumor Treatment

Mice were treated with either 12.5 μg per dose mOX40L_miR122 in LNP, 12.5 μg per dose negative control mRNA designed not to be translated into protein in LNP (NST-OX40L), a PBS negative control, or left untreated. mRNA/LNPs and negative controls were dosed in a 25 μl volume directly into the A20 tumor lesions at a frequency of once every 7 days for up to 6 maximum doses. The tumor volumes of individual animals are shown in FIG. 40A (measured as $mm^3$). A Kaplan-Meier survival curve of the same animals is shown in FIG. 40B. The x-axes of both graphs are Days post disease induction, i.e. subcutaneous cancer cell implantation.

B. Results

FIG. 40A shows that an increased number of animals treated with mOX40L_miR122 exhibited tumor growth inhibition compared to control animals. All of the control animals (30/30) were sacrificed by Day 60 post disease induction (primarily due to reaching the pre-determined tumor burden endpoint≥2000 mm3). In contrast, 4/9 animals or 44% of the mOX40L_miR122-treated mice had not yet reached the tumor burden endpoint by Day 98.

FIG. 40B shows the survival benefit of mOX40L_miR122 treatment, in which 2 mice in the mOX40L_miR122 arm (as designated by asterisk* in FIG. 40A) and 1 from the PBS group were removed from the study due to tumor ulceration and not included in the survival estimate. By this criteria, 2/8 or 25% of the OX40L mRNA treated animals were apparent complete responders by Day 98 post implantation compared to 0/29 of the control animals.

These data show the in vivo efficacy of administering a polynucleotide comprising an mRNA encoding an OX40L polypeptide (mOX40L_miR122) in the A20 tumor model.

Example 28 miR-122 Modulates OX40L Expression

The effects of incorporating a miR-122 binding site into the polynucleotide were assessed.

A. Preparation of OX40L Modified mRNA

A polynucleotide comprising an mRNA encoding an OX40L polypeptide (murine OX40L) and further comprising a miRNA binding site (miR-122) was prepared as described above (mouse OX40L, mOX40L_miR122, SEQ ID NO: 1207; human OX40L, hOX40L_miR122, SEQ ID NO: 1206). Polynucleotides comprising an mRNA encoding mouse OX40L polypeptide or human OX40L polypeptide, each without a miR-122 binding site, were also prepared to compare the effects of the presence of the miR-122 binding site.

B. Cell Transfections

Primary human hepatocytes, human liver cancer cells (Hep3B), and human cervical carcinoma cells (HeLa) were transfected with a polynucleotide comprising an mRNA encoding human OX40L polypeptide (hOX40L) or a polynucleotide comprising an mRNA encoding human OX40L polypeptide and further comprising a miR-122 binding site (hOX40L_miR122). Cells were analyzed for OX40L expression 6 hours, 24 hours, and 48 hours after transfection. Results are shown in FIG. 41A. The same experiment was also performed with mouse OX40L, as shown in FIG. 41B.

C. Results

FIG. 41A shows that incorporating a miR-122 binding site into the polynucleotide markedly reduced human OX40L expression in primary hepatocytes at later timepoints. Specifically, at 24 hours post-transfection, OX40L expression was reduced by 88% from 6,706 ng/well in cells treated with a hOX40L (no miR-122 binding site) to 814 ng/well in cells treated with hOX40L_miR122 (comprising a miR-122 binding site). At 48 hours post-transfection, OX40L expression was reduced by 94% from 11,115 ng/well to 698 ng/well in cells treated with a polynucleotide comprising a miR-122 binding site.

FIG. 41B shows similar results for mouse OX40L. Incorporating a miR-122 binding site into the polynucleotide reduced mouse OX40L expression in primary hepatocytes by 85% at 24 hours (from 1,237 ng/well to 182 ng/well) and by 91% at 48 hours (from 1,704 ng/well to 161 ng/well).

These data show that incorporating a microRNA binding site (miR-122) into a polynucleotide comprising an mRNA encoding an OX40L polypeptide reduces expression of the OX40L polypeptide in primary hepatocytes compared to a polynucleotide lacking a miR-122 binding site.

Example 29

Efficacy of Intravenous Administration of OX40L_miR122 mRNA in a Subcutaneous P388D1 Model The P388D1 cell line is a myeloid cell-derived cancer isolated from a mouse of the DBA/2 strain. The P388D1 syngeneic tumor model was used to assess the efficacy of intravenously administered OX40L_miR122 mRNA formulated in C18 PEG containing lipid nanoparticles (LNPs).

A. Study Design

P388D1 cells were implanted subcutaneously in DBA/2 mice. Treatment began 3 days post implantation and continued for 3 weeks (to 20 days post implant.) Briefly, $0.5\times10^6$ P388D1 cells were implanted subcutaneously into female DBA2 mice at day 0. Mice were enrolled in treatment study based on emergence of palpable tumors at day 3. During the treatment period, animals exhibiting >20% weight loss, tumor burden >2000 $mm^3$, or other signs of distress were humanely euthanized.

Treatment arms included:

PBS control;

Negative control mRNA (NST-mOX40L-miR122) MC3-DSPE LNP, 0.5 mg/kg (dosing once weekly); and mOX40L-miR122 MC3-DSPE LNP, 0.5 mg/kg (dosing once weekly)

B. Results

Treatment with LNPs carrying mOX40L mRNA at 0.5 mg/kg produced delay in tumor growth in 3/10 mice compared to mice treated with both negative control (NST-OX40L) LNP and PBS. FIG. 42A shows continued tumor growth in mice treated with PBS control. FIG. 42B shows continued tumor growth in mice treated with negative control mRNA formulated with MC3-DSPE LNP. FIG. 142C shows reduced or delayed tumor growth in mice treated with mOX40L-miR122 formulated with MC3-DSPE LNP. Arrows indicate dose days post tumor implantation (days 4, 11, and 18). As shown in FIG. 42C, delayed tumor growth was observed in animals treated with mOX40L-miR122.

FIG. 43 shows that an overall increase in survival was observed in animals with reduced tumor growth after mOX40L-miR122 treatment. No animal in either control group survived beyond Day 17. In contrast, survival for animals treated with mOX40L-miR122 was extended to Day 25.

Animals were also observed for adverse clinical signs at least once daily. Individual body weights were recorded 3 times weekly. Changes in body weight during treatment are shown in FIG. 44.

Control animals (PBS treated, shown by shaded circles in FIG. 44) exhibited clinical signs, such as weight loss and mortality, that were typical for animals with advanced disease in this model. Mice were humanely euthanized upon appearance of advanced clinical signs, excessive weight loss or at study termination.

Treatment with the LNPs carrying negative control mRNA (NST treated, shown by shaded squares in FIG. 44) and mOX40L-miR122 (shown by open circles in FIG. 44) were well-tolerated, with weight loss, necropsy findings and clinical signs similar to those of the NST control group. None of the observations within any group suggested issues with tolerance to treatment.

Example 30

In Vivo Anti-Tumor Efficacy of IL12 Modified mRNA in a Colon Adenocarcinoma (MC38) Syngeneic Model (Intravenous Administration)

The in vivo anti-tumor efficacy of murine IL12 mRNA, administered as a single intravenous (IV) dose in mice bearing M38 adenocarcinoma tumors, was assessed.

A. Preparation of IL12 Modified mRNA and Control

A polynucleotide comprising a nucleotide sequence encoding an IL12 polypeptide (murine IL12) and a miRNA binding site (miR-122) in its 3' UTR was prepared. (mIL12_miR122). A negative control mRNA was also prepared (non-translatable version of mRNAs), e.g., NST-FIX. Both modified mRNAs were formulated in MC3 lipid nanoparticles (LNP). See, U.S. Patent Pub. 2010/0324120, incorporated herein by reference in its entirety.

FIG. 45 shows a comparison of protein expression from sequence optimized mRNA encoding IL12B-linker-IL12A fusion protein (sequences comprising an miRNA (miR-122) binding site) over the corresponding mRNA comprising wild-type IL12A and wild-type IL12B sequences.

B. MC-38 Colon Adenocarcinoma Mouse Model

MC-38 colon adenocarcinoma tumors were implanted subcutaneously in mice as described in Rosenberg et al., *Science* 233:1318-1321 (1986)).

Ten days after tumor implantation, two groups of animals were administered a single intravenous dose of LNP-formulated IL12 modified mRNA (at a dose of either 0.1 mg/kg (group 4) or 0.05 mg/kg (group 5). Two groups of control animals were treated with equivalent doses of negative control mRNA (NST-FIX LNP) (group 7 and group 8), PBS (group 1), or IL12 protein, 1 μg (group 2).

Tumor volume was measured using manual calipers. Tumor volume mean to day 24 (FIG. 46) was recorded in cubic millimeters ($mm^3$).

C. Results

Higher AUC and $C_{max}$ for IL12 plasma levels were observed following administration of IL12 mRNA in lipid nanoparticle (LNP) compared to the corresponding IL12 recombinant protein (FIG. 47A). Higher AUC and $C_{max}$ for IFNγ plasma levels were observed following administration of IL12 mRNA administered in lipid nanoparticle (LNP) compared to IL12 recombinant protein (FIG. 47B). The higher AUC levels for IL12 and IFNγ plasma levels observed following treatment with IL12 mRNA administered in lipid nanoparticle (LNP) at 0.1 mpk and 0.05 mpk, compared to treatment with IL12 recombinant protein at approximately 0.05 mpk are shown in FIG. 47C. The numbers in parentheses indicate the x-fold increase for mRNA over protein.

FIG. 46 depicts the robust efficacy of a single intravenous (IV) dose of IL12 mRNA in lipid nanoparticle (LNP), at doses of 0.1 mg/kg (Group 4) and 0.05 mg/kg (Group 5) (as indicated by lines with the inverted triangles), compared to Groups 1 (PBS), 2 (IL12 protein), 7 and 8 (controls NST-FIX, 0.1 mg/kg and 0.05 mg/kg, respectively).

FIGS. 48A-48F depict the mean tumor volume and the number of complete responses (CR) seen following administration of a single intravenous (IV) dose of: IL12 mRNA in lipid nanoparticle (LNP), at doses of 0.1 mg/kg (Group 4)(FIG. 48F) and 0.05 mg/kg (Group 5)(FIG. 48E), PBS (Group 1)(FIG. 48A), IL12 protein (Group 2)(FIG. 48D), controls NST-FIX, 0.1 mg/kg and 0.05 mg/kg (Groups 7 and 8, respectively) (FIG. 48C and FIG. 48B, respectively). Complete responses (CRs) are shown in FIG. 48E and FIG. 48F only. FIG. 48E shows that 6 of 8 CRs were seen in Group 5 (IL12 mRNA in lipid nanoparticle (LNP), at a dose of 0.05 mg/kg). FIG. 48F shows that 5 of 9 CRs were seen in Group 4 (IL12 mRNA in lipid nanoparticle (LNP), at a dose of 0.1 mg/kg). Aside from the IL12 mRNA groups, no other group observed any CRs.

FIG. 49 depicts the survival benefit at day 47 post tumor-implantation from a single intravenous (IV) dose of IL12 mRNA in lipid nanoparticle (LNP) at a dose of 0.05 mg/kg (group 5) and at a dose of 0.1 mg/kg (group 4).

Notably, FIGS. 5-7 demonstrate the advantage of administering intravenous IL12 mRNA over protein in terms of improved pharmacokinetics (PK), pharmacodynamics (PD), and therapeutic efficacy, with a single IV dose.

FIG. 50 depicts the tolerability advantage of local (intratumoral) administration of IL12 mRNA over systemic (intravenous) administration. Nine (9) of 10 mice intratumorally administered IL12 mRNA were viable at day 20 compared to 3 of 12 mice intravenously administered IL12 mRNA.

Example 31

In Vivo Anti-Tumor Efficacy of IL12 Modified mRNA in a Colon Adenocarcinoma (MC38) Model (Intratumoral Administration)

The in vivo anti-tumor efficacy of IL12 mRNA, administered intratumorally in mice bearing M38 adenocarcinoma tumors, was assessed.

A. Preparation of IL12 Modified mRNA and Control

A polynucleotide comprising a nucleotide sequence encoding an IL12 polypeptide (murine IL12) and a miRNA binding site (miR-122) was prepared (mIL12_miR122). A negative control mRNA, NST-FIX mRNA, was also prepared. Both modified mRNAs were formulated in MC3 lipid nanoparticles (LNP). See, U.S. Patent Pub. 2010/0324120, incorporated herein by reference in its entirety.

B. MC-38 Colon Adenocarcinoma Mouse Model

MC-38 colon adenocarcinoma tumors were implanted subcutaneously in mice as described in Rosenberg et al., *Science* 233:1318-1321 (1986)).

Ten days after tumor implantation, animals were administered a single intratumoral dose of MC3 LNP-formulated murine IL12 modified mRNA (4 μg mRNA per dose). Two groups of control animals were treated with an equivalent dose and regimen of negative control mRNA (NST-FIX LNP) or PBS.

Tumor volume was measured at the indicated time points in FIG. 51B using manual calipers. Tumor volume mean to day 24 (FIG. 51A) and individual tumor volume to day 47 (FIG. 51B) were recorded in cubic millimeters ($mm^3$). Endpoints in the study were either death of the animal or a tumor volume reaching 1500 $mm^3$.

C. Results

FIG. 51A shows that mean tumor volume was reduced when MC3 LNP-formulated murine IL12 modified mRNA was administered. In contrast, administering a control modified mRNA (NST-FIX) or PBS to the mice had little effect on reducing the tumor volume mean when assessed up to day 24.

FIG. 51B shows that administering MC3 LNP-formulated murine IL12 modified mRNA to the mice decreased individual tumor volumes in some animals compared to animals administered control modified mRNA (NST-FIX) or PBS. Complete responses (CRs) were seen in 3 of 7 animals (44%), with 3 animals removed due to ulceration. This data shows that mIL12_miR122 polynucleotides have anti-tumor efficacy when administered intratumorally in vivo.

Example 32

In Vivo Anti-Tumor Efficacy of Murine IL12 Modified mRNA in a B-Cell Lymphoma (A20) Syngeneic Model The in vivo anti-tumor efficacy of murine IL12 mRNA, administered intratumorally in mice bearing A20 B-cell lymphoma tumors, was assessed.

A. Preparation of IL12 Modified mRNAs and Controls

A polynucleotide comprising a nucleotide sequence encoding an IL12 polypeptide (murine IL12) without a miRNA binding site (miRless) was prepared. (IL12 miRless). A polynucleotide comprising a nucleotide sequence encoding an IL12 polypeptide (murine IL12) and a miRNA binding site (miR-122) was prepared (mIL12miR122). The miR-122 binding element was incorporated to decrease protein production from the liver. A negative control mRNA (NST) was also prepared (non-translatable version of the same mRNA) (NST IL12_miRless). All modified mRNAs were formulated in MC3 lipid nanoparticles (LNP). See, US20100324120, incorporated herein by reference in its entirety.

B. A20 B-Cell Lymphoma Tumor Model

Mouse models of B-cell lymphoma using the A20 cell line are useful for analyzing tumors. (Kim et al., *Journal of Immunology* 122:549-554 (1979); Donnou et al., *Advances in Hematology* 2012:701704 (2012), incorporated herein by reference in their entirety). A20 cells are derived from a B cell lymphoma from a BALB/c mouse and are typically grown in syngeneic mice as a subcutaneous implant. 500,000 A20 cells were implanted subcutaneously in BALB/c mice to generate subcutaneous tumors. Tumors were monitored for size and palpability.

Once the tumors reached an average size of 100 $mm^3$, the mice were cohorted into three groups. One test group was administered intratumorally mIL12_miRless in MC3-based lipid nanoparticles (LNP) at a dose of 5 μg of mRNA (FIG. 52B, FIG. 53A). The second test group was administered intratumorally mIL12_miR122 in MC3-based lipid nanoparticles (LNP) of 5 μg of mRNA (FIG. 53B). The control group was administered an equivalent dose of non-translated control mRNA (NST) (FIG. 52A). Animals were dosed on day 10 post implantation.

The study was carried out through day 50 post implantation. Endpoints in the study were either death of the animal or a pre-determined endpoint of 2000 $mm^3$ tumor volume.

C. Results

FIG. 52A shows that tumor volume (measured in $mm^3$) increased over time in all 12 animals treated with 5 μg control NST mRNA. FIG. 52B shows that tumor volume decreased over time in some animals treated with mIL12_miRless compared to animals administered control mRNA (NST). Complete responses (CRs) were seen in 5 of 12 animals (42%).

FIG. 53A and FIG. 53B compare changes in tumor volume between animals treated with 5 μg mIL12_miRless (FIG. 53A) and animals treated with 5 μg mIL12-miR122 (FIG. 53B). Complete responses (CR) were achieved in 5 out of 12 mice in the miL12 miRless group (FIG. 53A) and 6 out of 12 mice in the IL12-miR122 group (FIG. 53B).

The data in FIG. 53A and FIG. 53B show that mIL12_miRless and mIL12-miR122 polynucleotides have comparable anti-tumor efficacy when administered intratumorally in vivo.

Example 33

Single and Multidose In Vivo Anti-Tumor Efficacy of a Modified IL12 mRNA

The in vivo anti-tumor efficacy of a modified murine IL12 mRNA, administered as a single 0.5 μg dose and a multidose (0.5 μg for 7 days×6), was studied in BALB/C mice bearing A20 B-cell lymphoma tumors.

A. Modified IL12 mRNA

A polynucleotide comprising a nucleotide sequence encoding an IL12 polypeptide (murine IL12) and a miRNA binding site (miR-122) was prepared. (mIL12_miR122). A polynucleotide comprising a nucleotide sequence encoding an IL12 polypeptide (murine IL12) without a miRNA binding site (miRless) was prepared. (mL12_miRless). One group of mIL12_miR122 mRNA was formulated in MC3-based lipid nanoparticles (LNP). See, US20100324120, incorporated herein by reference in its entirety. Another group of mIL12_miR122 mRNA was formulated in compound 18-based lipid nanoparticles (LNP).

B. Dosing

On day 10 post implantation, two groups of mice bearing A20 tumors (n=12 in each group) were administered a single 0.5 μg dose of murine IL12 mRNA in the form of IL12 miRless- or IL12 miR122-mRNA in MC3-based LNP.

Also on day 10 post implantation, another group of mice bearing A20 tumors was intratumorally administered weekly dosing of 0.5 μg of IL12 miR122 mRNA in MC3-based LNP for 7 days×6.

Also on day 10 post implantation, another group of mice bearing A20 tumors was intratumorally administered weekly dosing of 0.5 μg of IL12 miR122 mRNA in compound 18-based LNP for 7 days×6.

Finally, 10 days post implantation, another group of mice bearing A20 tumors (n=12 per group) was administered weekly dosing of 0.5 μg non-translated negative control mRNA (NST) in either MC3-based LNP or compound 18-based LNP for 7 days x 6.

C. Results

As shown in FIG. 54A and FIG. 54B, in vivo anti-tumor efficacy in a B-cell lymphoma tumor model (A20) was achieved after mice bearing A20 tumors were administered a single dose of 0.5 μg murine IL12 mRNA in MC3-based lipid nanoparticle (LNP). FIG. 54A depicts decreased tumor volume in some mice administered IL12 miRless (0.5 μg), and that four (4) complete responses (CR) were achieved. FIG. 54B depicts decreased tumor volume in some mice administered IL12 miR122 (0.5 μg), and that three (3) complete responses (CR) were achieved.

As shown in FIG. 55A and FIG. 55B, in vivo anti-tumor efficacy was enhanced with a weekly dosing regimen of IL12 miR122 mRNA in MC3-based LNP (0.5 μg mRNA for 7 days×6), compared to single dosing. FIG. 55A shows that three (3) complete responses (CR) were achieved in the 12 A20-bearing mice administered a single dose of 0.5 μg IL12 miR122 mRNA. FIG. 55B shows that five (5) CRs were achieved in the 12 A20-bearing mice administered weekly dosing of 0.5 μg IL12 miR122 mRNA for seven (7) days×6.

As shown in FIG. 56A and FIG. 56B, in vivo anti-tumor efficacy of weekly intratumoral doses of 0.5 μg IL12 mRNA in compound 18-based lipid nanoparticle (LNP) administered to A20-bearing mice was similar to the in vivo anti-tumor efficacy of IL12 mRNA in MC3-based LNP. FIG. 56A shows the individual tumor volume ($mm^3$) for 12 mice administered 0.5 μg IL12 miR122 in MC3-based LNP for 7 days×6. Complete responses (CR) were achieved in 5 out of 12 animals. FIG. 56B shows the individual tumor volumes for 12 mice administered 0.5 μg of IL12 mRNA in compound 18-based LNP for 7 days×6. Complete responses (CR) were also achieved in 5 out of 12 animals.

As shown in FIG. 57A and FIG. 57B, tumor growth was observed in mice bearing A20 tumors administered weekly dosing (7 days×6) of 0.5 μg non-translated negative control mRNA (NST) in MC3-based lipid nanoparticle (LNP) (FIG. 57A) and 0.5 μg NST in compound 18-based LNP (FIG. 57B).

This data shows that polynucleotides comprising modified murine IL12 mRNA (both miR122 and miRless) show anti-tumor efficacy at low doses (0.5 μg). It also shows that in vivo anti-tumor efficacy can potentially be enhanced with a multiple dosing regimen. Finally, the data shows in vivo anti-tumor efficacy when 0.5 μg IL12 miR122 mRNA in MC3-based and compound 18-based LNP is administered intratumorally weekly (for 7 days×6). In contrast, tumor growth was observed in mice bearing A20 tumors administered weekly dosing (7 days×6) of 0.5 μg non-translated negative control mRNA (NST) in MC3-based lipid nanoparticle (LNP) and in compound 18-based LNP.

Example 34

Analysis of Levels of IL12 p70, IFNγ, IP10, IL6, GCSF, and GROα in Plasma and Tumors of A20-Bearing Mice Following Administration of Murine IL12 mRNA On day 10 post implantation, groups of mice bearing A20 tumors (n=12 in each group) were administered a dose of miR122 IL12 mRNA (at 5 μg, 2.5 μg, or 0.5 μg) in MC3-based LNP or compound 18-based LNP, NST or IL12 protein at the same dosages, or PBS.

The levels of tumor and plasma IL12 p70, as well as the level of other cytokines, were determined at 6 and 24 hours after administration of the dosages. The levels of IL12 (p70) were determined using a sandwich ELISA commercial kit. The levels of IFNγ, IP10, IL6, G-CSF, and GROα were also determined._

Results:

FIG. 58A and FIG. 58B show dose-dependent levels of IL12 in plasma (FIG. 58A) and tumor (FIG. 58B) at 6 hours and 24 hours following administration of the indicated doses of murine IL12 mRNA in a lipid nanoparticle (LNP) to mice bearing A20 tumors.

FIG. 59A and FIG. 59B show elevated levels of IL12 in plasma and tumor following administration of the indicated doses of murine IL12 mRNA in compound 18-based LNPs compared to murine IL12 mRNA in MC3-based LNPs. FIG. 59C shows plasma and tumor IL12 levels at 6 hours and 24 hours.

FIG. 60A and FIG. 60B show increased levels of IFNγ at 6 hours and 24 hours in plasma (FIG. 60A) and in tumor (FIG. 60B) following administration of murine IL12 mRNA to mice bearing A20 tumors.

FIG. 61A and FIG. 61B show increased levels of IP10 at 6 hours and 24 hours in plasma (FIG. 61A) and in tumor (FIG. 61B) following administration of murine IL12 mRNA to mice bearing A20 tumors.

FIG. 62A and FIG. 62B show decreased levels of IL6 at 6 hours and 24 hours in plasma (FIG. 62A) and in tumor (FIG. 62B) following administration of murine IL12 mRNA in compound 18-based LNP compared to murine IL12 mRNA in MC3-based LNP.

FIG. 63A and FIG. 63B show decreased levels of GCSF at 6 hours and 24 hours in plasma (FIG. 63A) and in tumor (FIG. 63B) following administration of murine IL12 mRNA in compound 18-based LNP compared to murine IL12 mRNA in MC3-based LNP.

FIG. 64A and FIG. 64B show decreased levels of GROα at 6 hours and at 24 hours in plasma (FIG. 64A) and tumor (FIG. 64B) following administration of murine IL12 RNA in compound 18-based LNP compared to murine IL12 mRNA in MC3-based LNP.

The data in this example show dose dependent levels of murine IL12 in plasma and tumor with intratumoral administration of murine IL12 mRNA. The data also show increased IL12 levels in plasma and tumor from compound 18-based LNPs compared to MC3-based LNP, as well as increased IFNγ and IP10 levels, attributable to administration of murine IL12 mRNA. Finally, this example shows decreased levels of IL6, GCSF, and GROα in plasma and tumor with compound 18-formulated murine IL12 mRNA compared to MC3-formulated murine IL12 mRNA.

Example 35

In Vivo Anti-Tumor Efficacy of Intravenous (IV) Administration of IL12_miR122 mRNA in a Subcutaneous A20 Model A. Study Design 500,000 A20 cells were implanted subcutaneously in BALB/c mice. A20 tumor-bearing mice were cohorted into 2 treatment groups (N=10) when tumor averages reached approximately ~100 $mm^3$. Mice were IV dosed with 0.5 mg/kg murine mRNA in a C18 PEG containing LNP (MC3:cholesterol:DSPC:PEG-DSPE at mol % s of 50:38.5:10:1.5) every 7 days (Q7D).

The control group were treated with negative control mRNA formulated in LNP, whereas the treatment group were dosed with LNPs containing murine IL12 mRNA with a miR122 binding element with in the 3' UTR. Both the use of the C18-containing LNP and the incorporation of the miR122 binding element were meant to mitigate potential protein production from the liver.

Tumor volumes and body weights were measured twice a week, and general clinical observations made in accordance with an accepted IACUC protocol until a pre-determined endpoint of 2000 $mm^3$ tumor volume was reached.

B. Efficacy Data

The individual tumor volumes from mice treated with weekly dosing of IL 12 murine mRNA plus a miR122 binding element formulated in a C18 PEG-containing LNP are shown in FIG. 65B compared to appropriate negative controls in FIG. 65A. Dosing days are indicated by vertical red hashed lines, and the pre-determined endpoint of 2000 $mm^3$ tumor volume indicated by horizontal black hashed line.

C. Assessment of Side Effects/Toxicity

The individual body weights from mice treated with weekly dosing of murine IL12 mRNA plus a miR122 binding element formulated in a C18 PEG-containing LNP are shown in FIG. 66B compared to appropriate negative controls in FIG. 66A.

D. Conclusion

The intravenous administration of murine IL12 mRNA delayed the growth of A20 tumors as compared to an appropriate negative control (i.e., IV treatment of identically formulated mRNA with a miR122 binding element that had no start "NST" codons). The efficacious dosing of 0.5 mg/kg Q7D was well-tolerated as determined by general clinical observations and more quantitatively by body weight measurements.

Example 36

In Vivo Anti-Tumor Efficacy of Intraperitoneal (IP) Administration of IL12 Modified Murine mRNA in an IP MC38 Model A. Study Design The luciferase reporter gene was integrated within the MC-38 colon cell line to enable measurement of bioluminescence from these cells if grown in a context that tumor burden could not be assessed by caliper in live animals. The light output from these cells has been correlated with tumor burden.

500,000 MC-38 luciferase-enabled (MC38-luc) cells were inoculated in the peritoneal cavity as a model of colon cancer metastasis to this space. Mice were assigned to various treatment groups based on bioluminescent signal, and treatment started 7 days post disease induction.

Mice were treated with a single intraperitoneal (IP) dose of murine mRNA formulated in a LNP (MC3:cholesterol: DSPC:PEG-DMGat mol % s of 50:38.5:10:1.5) and compared to a single IP dose of 1 μg recombinant mouse IL12 protein. A single dose of 2 fixed dose levels of mRNA (2 and 4 μg) were administered at day 7 post disease induction, and murine IL12 mRNAs with and without a miR122 binding element were assessed in different treatment groups compared to appropriate negative controls (non-start NST mRNA with a miR122 binding element encapsulated in an identically formulated LNP).

Tumor volumes and body weights were frequently measured, and general clinical observations made in accordance with appropriate IACUC protocols.

B. Efficacy Data

Bioluminescence (BL) was used as a surrogate for tumor burden and measured on several days including day 22 post disease induction as depicted in FIG. 67. Treatment groups and dose levels are indicated below the X-axis in FIG. 68. From left to right, mice were administered no treatment, 2 μg mIL12_miRless, 2 μg mIL12_miR122, 2 μg NST_OX40L_122, 4 μg mIL12_miRless, 4 μg mIL12_miR122, 4 μg NST_OX40L_122, and 1 μg rm IL12. Mice treated with murine IL12 mRNA in all arms exhibited lower BL signal than negative controls.

C. Assessment of Side Effects/Toxicity

The treatments were generally well tolerated, and no treatment groups exhibited a body weight loss average of over 10%.

D. Conclusion

As shown in FIG. 68, mice treated with both fixed doses of murine IL12 mRNA exhibited lower levels of BL signal as a measure of tumor burden compared to negative controls, and this inhibited BL level was associated with an apparent survival benefit of intraperitoneally-dosed murine IL12 mRNA. Murine IL12 mRNA that contained a miR122 binding domain within the 3' UTR exhibited similar efficacy to mRNA without this regulatory element (miR-less). The effective doses employed were considered generally well-tolerated.

Example 37 mRNA Encoding IL15 and hIL15Rα

Human sequence optimized (hOpt) mRNA encoding human IL15 was prepared along with mRNAs encoding wild type human IL15Rα, the extracellular domain of human IL15Rα, wild type mouse IL15Rα, and the extracellular domain of mouse IL15Rα. See TABLES 10 and 11.

Example 38

In Vitro Expression and Bioactivity of hOpt IL15 mRNA

HeLa cells in 6-well tissue culture plates were transfected with hOpt IL15 mRNA alone or in combination with human IL15Rα extracellular domain ("ECD") mRNA, human IL15Rα wild type ("WT") mRNA, mouse IL15Rα ECD mRNA, or mouse IL15Rα WT mRNA. The amount of secreted, cell-associated, and total IL15 produced by the transfected HeLa cells in each well was determined. The half maximal effective concentration ("EC50") in CTLL-2 cells associated with corresponding transfections as well as administration of recombinant human IL15 protein was also determined. Results are shown in TABLE E3.

TABLE E3

Amounts of IL15 produced by hOpt IL15 mRNA and $EC_{50}$ in vitro

| Source of IL15 | Secreted IL15 (pmol/ well)* | Cell-associated IL15 (pmol/ well)* | Total IL15 (pmol/ well)* | $EC_{50}$ CTLL-2 cells (nM) |
|---|---|---|---|---|
| hOpt IL15 mRNA | 3.6 | 5.2 | 8.8 | 0.013 |
| hOpt IL15 mRNA + hIL15Rα ECD mRNA | 78.2 | 7.9 | 86.1 | 0.058 |
| hOpt IL15 mRNA + hIL15Rα WT mRNA | 26.1 | 67.9 | 94.0 | 0.053 |
| hOpt IL15 mRNA + mIL15Rα ECD mRNA | 40.8 | 6.3 | 47.1 | 0.021 |
| hOpt IL15 mRNA + mILI5Rα WT mRNA | 29.5 | 109.4 | 138.9 | 0.039 |
| Recombinant hIL15 protein | — | — | — | 0.062 |

*Based on transfection of HeLa cells in 6-well plates.

The activities of mRNA-produced IL15 and the various IL15/IL15Rα complexes was confirmed in primary mouse T cells (data not shown).

Example 39

In Vivo Expression and Bioactivity of hOpt IL15 mRNA

Non-tumor bearing C57BI/6J female mice were injected intravenously with a single dose of 0.5, 0.25, or 0.1 mg/kg hOpt IL15 mRNA alone, or 0.5 mg/kg hOpt IL15 mRNA (FIG. 69A shows the structure of the construct) co-administered with 0.5, 0.25, or 0.1 mg/kg of either: (1) human IL15Rα wild type ("WT") mRNA, (2) human IL15Rα extracellular domain ("ECD") mRNA, (3) mouse IL15Rα WT mRNA, or (4) mouse IL15Rα ECD mRNA. Additional mice were injected intraperitoneally with 5 μg IL15 recombinant protein alone or with 0.5 mg/kg NST-OX40L alone. Mice receiving no treatment were also used as controls.

Body weight changes were determined at 2, 4, 6, 8, 10, 12, and 14 days after administration. As shown in FIG. 69B, co-administration of 0.5 mg/kg hOpt IL15 mRNA and 0.5 mg/kg of either mouse or human IL15Rα WT mRNA was not tolerated due to body weight loss. Co-administration of 0.5 mg/kg hOpt IL15 mRNA and 0.25 mg/kg of either mouse or human IL15Rα WT mRNA yielded some body weight loss, yet appeared to be a maximum tolerated dose (MTD). Co-administration of 0.5 mg/kg hOpt IL15 mRNA with any of the tested doses of either mouse or human IL15Rα ECD mRNA was tolerated.

IL15 plasma concentrations were also determined at 24, 48, and 72 hours after administration. As shown in FIG. 70, the highest levels of plasma IL15 were produced from co-administration of 0.5 mg/kg hOpt IL15 mRNA and 0.5 mg/kg of either mouse or human IL15Rα WT mRNA. The groups with the most body weight loss in FIG. 69B exhibited the highest IL15 plasma levels at 72 hours in FIG. 70.

In a subset of mice receiving co-administration of 0.5 mg/kg hOpt IL15 mRNA and 0.5 mg/kg of either mouse or human IL15Rα WT mRNA, spleens were harvested at 8 days after administration, and spleen weights and spleen cell counts were determined. As shown in FIG. 71 and FIG. 72, co-administration of 0.5 mg/kg hOpt IL15 mRNA and 0.5 mg/kg of either mouse or human IL15Rα WT mRNA induced significant increases in both spleen weight and spleen cell counts. As shown in FIG. 72, spleenocyte numbers of $CD8^+$ T cells, NK cells, and NK T cells were all markedly increased. Expansion of $CD8^+$ T cells and NK cells were also seen in peripheral blood (data not shown).

Example 40 mRNA Encoding Constitutively Active IL18 mRNAs encoding constitutively active IL18 ("IL18") were prepared from wild type human or mouse IL18 sequences. mRNAs were prepared encoding wild-type human IL18 (hIL18 WT; SEQ ID NO: 564), wild-type mature human IL18 having the human tissue plasminogen activator signal peptide at its N terminus (htPA-hIL18 mRNA), wild type mature human IL18 having the human IL12 signal peptide at its N terminus (hIL2sp-hIL18 mRNA), wild-type murine IL18 (miL18 WT), wild-type mature murine IL18 having the murine tissue plasminogen activator signal peptide at its N terminus (mtPA-mIL18 mRNA), and wild type mature murine IL18 having the murine IL12 signal peptide at its N terminus (mIL2sp-mIL18). FIG. 73 shows the structure of IL18 encoded by the mRNAs as compared to wild type IL18.

Example 41

In Vitro Expression and Bioactivity of IL18 mRNA

Expression of IL18 mRNAs was confirmed by cell-free translation by QC into HeLa cells. Both wild type human and mouse IL18 were expressed in HeLa cell lysate, while IL2spIL18 from both human and mouse were expressed in HeLa cells lysate, with some expression in HeLa cell supernatant. HeLa cells were seeded in 6-well plates and transfected with hiL18 WT mRNA, htPA-hIL18 mRNA, hIL2sp-hIL18 mRNA, mIL18 WT mRNA, mtPA-mIL18 mRNA, or mIL2sp-mIL18 mRNA. Following transfection, expression of IL18 was determined using anti-IL 18 antibody to detect IL18. FIG. 74A.

The ability of recombinant mIL2sp-mIL18 or miL18 WT protein to induce expression of interferon-γ in murine CTLL2 cells was measured. CTLL2 cells were cultured in standard media and transfected with mIL2sp-mIL18 or miL18 WT. Both mIL2sp-mIL18 or miL18 WT caused the CTLL2 cells to secret interferon-γ. FIG. 74B.

Example 42

In Vivo Efficacy of Combining IL23 and IL18 Modified mRNAs in a B-Cell Lymphoma Model In vivo efficacy of modified mRNAs encoding IL23 and IL18 was assessed in a B-cell lymphoma model.

A. Preparation of IL23 and IL18 Modified mRNA

A polynucleotide comprising a modified mRNA encoding an IL23 polypeptide (murine IL23) was prepared as described above. A polynucleotide comprising a modified mRNA encoding an IL18 polypeptide (murine IL18) having the murine IL12 signal peptide was also prepared as described above. A negative control mRNA was also prepared (non-translatable version of the Factor IX mRNA containing multiple stop codons; NST-FIX. The modified mRNAs were all formulated in the same manner (Cap1, G5 RP mRNA in 1.5 mol % DMG MC3 LNP).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumors were monitored for size and palpability. Once the tumors reached a mean size of approximately 100 mm3, animals were separated into two groups of 12 mice each. Group I was treated with repeated intratumoral doses of mIL23 mRNA at a dose of 12.5 ug mRNA. Group II was treated with a mixture of IL23 mRNA (6.25 ug) and IL12sp-IL18 mRNA (6.25 ug). Animals were dosed on Days 18, 25 and 32, as indicated by the arrows in FIGS. 75A and 75B. Results are shown in FIGS. 75A and 75B as a plot of tumor volume over time. The study was carried out through Day 38. Otherwise, endpoints in the study were either death of the animal or a tumor volume reaching 2000 mm3.

C. Results

FIG. 75A shows individual tumor growth in animals treated with mRNA encoding murine IL23. FIG. 75B shows individual tumor growth in animals treated with a combination of mRNAs, one of which encodes murine IL18 having the murine IL12 signal peptide and one of which encodes murine IL23. Multiple doses of IL23 mRNA reduced or decreased the size of tumors in some animals and inhibited the growth of tumors in some animals. In one animal treated with IL23 mRNA, treatment led to a complete response (i.e., tumor elimination) prior to day 38 (see FIG. 75A). Of the 12 mice given IL23 mRNA, 9 mice had tumors whose size remained below 500 mm3 at the study endpoint (see FIG. 75A, shaded area).

When mice were treated with the combination of mRNAs encoding IL18 and IL23, tumor growth was impacted to a greater degree than with the single mRNA treatment. In 9 animals that received mRNAs encoding IL18 and IL23, treatment led to a complete response prior to day 38 (see FIG. 75B). Of the 12 mice treated with the combination, 11 mice had tumors whose size remained below 500 mm3 at the study endpoint (see FIG. 75B, shaded area). These data indicate that IL23 mRNA treatment reduces tumor growth and facilitates tumor elimination in a B-cell lymphoma model of cancer, and that combination therapy using mRNAs encoding IL18 and IL23 is more effective in treating tumors than IL23 mRNA alone.

Example 43

In Vitro Expression of Single Chain IL23 mRNA

Expression of secreted IL23 polypeptide was measured in the cultured media of cancer cells following transfection with polynucleotides comprising an mRNA encoding a murine or human IL23 polypeptide. Polynucleotides comprising an mRNA encoding a murine IL23 polypeptide ("muIL23-mRNA") or a human IL23 polypeptide (SEQ ID NO: 983, polypeptide; SEQ ID NO: 984, polynucleotide) ("huIL23-mRNA") were used in this example. IL23 polynucleotides were constructed as single chain constructs, with the Gly6Ser linker (GS linker) connecting the p40 and p19 subunits of IL23 (see FIG. 76).

HeLa cells were seeded in 6-well plates and transfected with muIL23-mRNA (SEQ ID NO: 82) or huIL23-mRNA (SEQ ID NO: 984). Following transfection, expression of IL23 was determined. These assays detected 2691 ng/mL murine IL23 and 1393 ng/mL human IL23. These data indicate that introducing IL23 mRNA into cells facilitates the expression and secretion of IL23.

Example 44

In Vivo Efficacy of IL23 Modified mRNA in a B-Cell Lymphoma Model

In vivo efficacy of modified mRNA encoding IL23 was assessed in a B-cell lymphoma model.

A. Preparation of IL23 Modified mRNA

A polynucleotide comprising a modified mRNA encoding an IL23 polypeptide (murine IL23) was prepared as described above. A negative control mRNA was also prepared (non-translatable version of the Factor IX mRNA containing multiple stop codons; NST-FIX). Both modified mRNAs were formulated in the same manner (Cap1, G5 RP mRNA in 1.5 mol % DMG MC3 LNP).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumor were monitored for size and palpability.

Once the tumors reached a mean size of approximately 100 $mm^3$, animals were separated into two groups of 12 mice each. Group I (control) was treated with negative control mRNA, NST-FIX, at a dose of 12.5 μg mRNA at each time point. Group II was treated with repeated intratumoral doses of mIL23 mRNA at a dose of 12.5 μg mRNA. Animals were dosed on Days 18, 25 and 32, as indicated by the arrows in FIGS. 77A and 77B. Results are shown in FIGS. 77A and 77B as a plot of tumor volume over time. The study was carried out through Day 38. Otherwise, endpoints in the study were either death of the animal or a tumor volume reaching 2000 $mm^3$.

C. Results

FIG. 77A shows individual tumor growth in animals treated with control NST-FIX mRNA. FIG. 77B shows individual tumor growth in animals treated with IL23 mRNA. Multiple doses of the control modified mRNA had little effect on the tumor volume. In contrast, multiple doses of IL23 mRNA reduced or decreased the size of tumors in some animals and inhibited the growth of tumors in some animals. In one animal treated with IL23, treatment led to a complete response (i.e., tumor elimination). Of the 12 mice given IL23 mRNA, 9 mice had tumors whose size remained below 500 $mm^3$ at the study endpoint (see FIG. 77B, shaded area). In contrast, 11 of the 12 mice in the control group had tumors whose size was larger than 500 mm3 at the study endpoint (see FIG. 77A, shaded area). These data indicate that IL23 mRNA treatment reduces tumor growth and facilitates tumor elimination in a B-cell lymphoma model of cancer.

Example 45

In Vivo Efficacy of Combinations of Interleukin Polypeptides IL12 Plus IL18 and IL23 Plus IL18

Prior studies of interleukin polypeptides have demonstrated the effectiveness of interleukins in treating mouse models of cancer. These data have been reported in studies such as Wang et al., *J. Dermatological Sci.* 36:66-68 (2004), hereby incorporated by reference in its entirety. Relevant methods and results from Wang et al. are summarized below in this Example.

A. B16 Mouse Model of Melanoma

B16 melanoma cells ($1\times10^5$ cells) were implanted into the upper abdominal skin of syngeneic male C57BL/6J mice to establish a cutaneous melanoma model. At 5 and 7 days post implantation, cDNA vectors encoding one or more interleukin polypeptides were introduced into the mice via gene gun. The tested vectors expressed IL12 (pcDNA-IL12), IL18 (pcDNA-mproIL18/mICE), IL23 (pcDNA-IL23), or a GFP control (phGFP-105-C1). For each vector or combination of vectors, 5 mice were treated and the tumor volume was measured at days 5, 7, 9, 12, 14, 17, and 21. FIG. 78A presents the average tumor volume for each group. Final Kaplan-Meier survival curves were prepared and are shown in FIG. 78B.

B. Results

Wang et al. tested six different therapies' effectiveness in the B16 mouse model of melanoma described above: IL23 plus IL18 (solid square); IL12 plus IL18 (open circle); IL12 alone (solid triangle); IL23 alone (ex-mark); IL18 alone (open square); and a GFP-expression control (solid circle). As shown in FIG. 78A, the gene-gun therapy with both IL23 and IL18 plasmids resulted in the significant suppression of the implanted tumor by the 14th day after tumor implantation, compared to that with the control GFP ($P<0.01$) or IL18 expression vector alone ($P<0.05$). The therapy with IL23 and IL18 cDNA showed equivalent anti-tumor effect to that of IL12 and IL18 cDNA. Therapy with IL23 alone was more effective in suppressing tumor growth than the GFP control. The antitumor effect of the IL23 and IL18 combination also contributed to an improvement in the survival rate and the life span of the rats relative to either plasmid alone (FIG. 78B).

Example 46

In Vivo Efficacy of Combining IL23 and IL18 Modified mRNAs in a B Cell Lymphoma Model In vivo efficacy of modified mRNAs encoding IL23 and IL18 was assessed in a B cell lymphoma model.

Preparation of IL23 and IL18 Modified mRNA

A polynucleotide comprising a modified mRNA encoding an IL23 polypeptide (murine IL23) was prepared as described above. A polynucleotide comprising a modified mRNA encoding an IL18 polypeptide (murine IL18) was also prepared as described above. A negative control mRNA was also prepared (non-translatable version of the Factor IX mRNA containing multiple stop codons; NST-FIX). The modified mRNAs were all formulated in the same manner (Cap1, G5 RP mRNA in 1.5 mol % DMG MC3 LNP).

B. A20 B-Cell Lymphoma Tumor Model

B-cell lymphoma tumors were established subcutaneously in BALB/c mice. Mouse B-cell lymphoma cells (A20, ATCC No. TIB-208; ATCC, Manassas, Va.) were cultured according to the vendor's instructions. Cells were inoculated subcutaneously in BALB/c mice to generate subcutaneous tumors. Tumors were monitored for size and palpability.

Once the tumors reached a mean size of approximately 100 mm3, animals were separated into two groups of 12 mice each. Group I was treated with repeated intratumoral doses of mIL23 mRNA at a dose of 12.5 μg mRNA. Group II was treated with a mixture of IL23 mRNA (6.25 μg) and IL18 mRNA (6.25 μg). Animals were dosed on Days 18, 25 and 32, as indicated by the arrows in FIGS. 79A and 79B. Results are shown in FIGS. 79A and 79B as a plot of tumor volume over time or % survival rate over time, respectively.

The study was carried out through Day 38. Otherwise, endpoints in the study were either death of the animal or a tumor volume reaching 2000 $mm^3$.

C. Results

FIG. 79A shows individual tumor growth in animals treated with the different mRNAs. FIG. 79B shows % survival rate in animals treated with the different mRNAs. Multiple doses of IL23 mRNA reduced or decreased the size of tumors in some animals and inhibited the growth of tumors in some animals. In one animal treated with IL23 mRNA, treatment led to a near complete response (i.e., minimal tumor growth) by day 21 (see FIG. 79A). Of the 12 mice given IL23 mRNA, 9 mice had tumors whose size remained below 500 mm3 at the study endpoint (see FIG. 79A).

When mice were treated with the combination of mRNAs encoding IL18 and IL23, tumor growth was impacted to a greater degree than with the single mRNA treatment. In 9 animals that received mRNAs encoding IL18 and IL23, treatment led to a complete response prior to day 38 (see FIG. 79B). Of the 12 mice treated with the combination, 11 mice had tumors whose size remained below 500 mm3 at the study endpoint (see FIG. 79B).

These data indicate that IL23 mRNA treatment reduces tumor growth and facilitates tumor elimination in a B-cell lymphoma model of cancer, and that combination therapy using mRNAs encoding IL18 and IL23 may be more effective in treating tumors than IL23 mRNA alone.

Other Embodiments

It is to be understood that the words which have been used are words of description rather than limitation, and that changes can be made within the purview of the appended claims without departing from the true scope and spirit of the disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (1263 sequences)

SEQ ID NO: 1 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 2 - protein, 126 aa, Homo sapiens [sequence omitted]

SEQ ID NO: 3 - protein, 188 aa, Homo sapiens
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 4 - protein, 56 aa, Homo sapiens
MACLGFQRHKAQLNLATRTWPCTLLFFLLFIPVFCKAPPTEPECEKQFQPYFIPIN

SEQ ID NO: 5 - protein, 58 aa, Homo sapiens
MACLGFQRHKAQLNLATRTWPCTLLFFLLFIPVFCKAKEKKPSYNRGLCENAPNRARM

SEQ ID NO: 6 - protein, 79 aa, Homo sapiens
MACLGFQRHKAQLNLATRTWPCTLLFFLLFIPVFCKAMHVAQPAVVLASSRGIASFVSKEKKPSYNRGLCENAPNRARM

SEQ ID NO: 7 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 8 - DNA, 503 bp, Homo sapiens
ggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactaccggtkggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacac

SEQ ID NO: 9 - protein, 166 aa, Homo sapiens
GVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYRDVWGQGTTVTVSSASTKGPSVFPLAPCSRSTSESTAALGCLVKDYFPEPVTVSWNSGALTSGVH

SEQ ID NO: 10 - DNA, 417 bp, Homo sapiens
ccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcctctgttgtgtgcctgctgaataacttctatcccagagaggccaaagta

SEQ ID NO: 11 - protein, 139 aa, Homo sapiens
PSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKV

SEQ ID NO: 12 - protein, 167 aa, Homo sapiens
GVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVH

SEQ ID NO: 13 - protein, 139 aa, Homo sapiens; identical to SEQ ID NO: 11

SEQ ID NO: 14 - protein, 10 aa, Homo sapiens
GFTFSSYGMH

SEQ ID NO: 15 - protein, 15 aa, Homo sapiens
VIWYDGSNKYYADSV

SEQ ID NO: 16 - protein, 16 aa, Homo sapiens
DPRGATLYYYYYGMDV

SEQ ID NO: 17 - protein, 11 aa, Homo sapiens
RASQSINSYLD

SEQ ID NO: 18 - protein, 7 aa, Homo sapiens
AASSLQS

SEQ ID NO: 19 - protein, 9 aa, Homo sapiens
QQYYSTPFT

SEQ ID NO: 20 - DNA, 1413 bp, Homo sapiens
atggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 21 - protein, 451 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 22 - DNA, 714 bp, Homo sapiens
atggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtga

SEQ ID NO: 23 - protein, 214 aa, Homo sapiens
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - DNA, 1392 bp, Homo sapiens
atggagtttgggctgagctgggttttcctcgttgctcttttaagaggtgtccagtgtcaggtgcagctggtggagtctgggggaggcgtggtccagcctgggaggtccctgagactctcctgtgtagcgtctggattcaccttcagtagccatggcatgcactgggtccgccaggctccaggcaaggggctggagtgggtggcagttatatggtatgatggaagaaataaatactatgcagactccgtgaagggccgattcaccatctccagagacaattccaagaacacgctgtttctgcaaatgaacagcctgagagccgaggacacggctgtgtattactgtgcgagaggaggtcacttcggtccttttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 25 - protein, 463 aa, Homo sapiens
MEFGLSWVFLVALLRGVQCQVQLVESGGGVVQPGRSLRLSCVASGFTFSSHGMHWVRQAPGKGLEWVAVIWYDGRNKYYADSVKGRFTISRDNSKNTLFLQMNSLRAEDTAVYYCARGGHFGPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 26 - DNA, 708 bp, Homo sapiens
atggaaaccccagcgcagcttctcttcctcctgctactctggctcccagataccaccggagaaattgtgttgacgcagtctccaggcaccctgtctttgtctccaggggaaagagccaccctctcctgcagggccagtcagagtattagcagcagcttcttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcaccctggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 27 - protein, 235 aa, Homo sapiens
METPAQLLFLLLLWLPDTTGEIVLTQSPGTLSLSPGERATLSCRASQSISSSFLAWYQQRPGQAPRLLIYGASSRATGIPDRFSGSGSGTDFTLTISRLEPEDFAVYYCQQYGTSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - protein, 167 aa, Homo sapiens
GVVQPGRSLRLSCVASGFTFSSHGMHWVRQAPGKGLEWVAVIWYDGRNKYYADSVKGRFTISRDNSKNTLFLQMNSLRAEDTAVYYCARGGHFGPFDYWGQGTLVTVSSASTKGPSVFPLAPCSRSTSESTAALGCLVKDYFPEPVTVSWNSGALTSGVHTFPAVLQ

SEQ ID NO: 29 - protein, 141 aa, Homo sapiens
QSPGTLSLSPGERATLSCRASQSISSSFLAWYQQRPGQAPRLLIYGASSRATGIPDRFSGSGSGTDFTLTISRLEPEDFAVYYCQQYGTSPWTFGQGTKVEIKRTVAAPSVFIFPPSDEQLKSGTASVVCLLNNFYPREAK

SEQ ID NO: 30 - protein, 10 aa, Homo sapiens
GFTFSSHGMH

SEQ ID NO: 31 - protein, 15 aa, Homo sapiens
VIWYDGRNKYYADSV

SEQ ID NO: 32 - protein, 9 aa, Homo sapiens
GGHFGPFDY

SEQ ID NO: 33 - protein, 12 aa, Homo sapiens
RASQSISSSFLA

SEQ ID NO: 34 - protein, 7 aa, Homo sapiens
GASSRAT

SEQ ID NO: 35 - protein, 10 aa, Homo sapiens
CQQYGTSPWT

SEQ ID NO: 36 - DNA, 1392 bp, Homo sapiens
atggagtttgggctgagctgggttttcctcgttgctcttttaagaggtgtccagtgtcaggtgcagctggtggagtctgggggaggcgtggtccagcctgggaggtccctgagactctcctgtgtagcgtctggattcaccttcagtagccatggcatgcactgggtccgccaggctccaggcaaggggctggagtgggtggcagttatatggtatgatggaagaaataaatactatgcagactccgtgaagggccgattcaccatctccagagacaattccaagaacacgctgtttctgcaaatgaacagcctgagagccgaggacacggctgtgtattactgtgcgagaggaggtcacttcggtccttttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 37 - protein, 463 aa, Homo sapiens
MEFGLSWVFLVALLRGVQCQVQLVESGGGVVQPGRSLRLSCVASGFTFSSHGMHWVRQAPGKGLEWVAVIWYDGRNKYYADSVKGRFTISRDNSKNTLFLQMNSLRAEDTAVYYCARGGHFGPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 38 - DNA, 459 bp, Homo sapiens
cctgggaggtccctgagactctcctgtgcagcgtctggattcaccttcagtagtcatggcatccactgggtccgccaggctccaggcaaggggctggagtgggtggcagttatatggtatgatggaagaaataaagactatgcagactccgtgaagggccgattcaccatctccagagacaattccaagaacacgctgtatttgcaaatgaacagcctgagagccgaggacacggctgtgtattactgtgcgagagtggccccactggggccacttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagc

SEQ ID NO: 39 - protein, 153 aa, Homo sapiens
PGRSLRLSCAASGFTFSSHGIHWVRQAPGKGLEWVAVIWYDGRNKDYADSVKGRFTISRDNSKNTLYLQMNSLRAEDTAVYYCARVAPLGPLDYWGQGTLVTVSSASTKGPSVFPLAPCSRSTSESTAALGCLVKDYFPEPVTVSWNSGALTS

SEQ ID NO: 40 - DNA, 440 bp, Homo sapiens
cagtctccaggcaccctgtctttgtctccaggggaaagagccaccctctcctgcagggccagtcagagtgtcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaggattttgcagtgtattactgtcaacagtatggtaggtcaccattcactttcggccctgggaccaaagtagatatcaagcgaactgtggctgcaccatctgtcttcatcttcccgccatctgatgagcagttgaaatctggaactgcctctgttgtgtgcctgctgaataacttctatcccagagaggccaaagtacagtggaaaggtggata

SEQ ID NO: 41 - protein, 146 aa, Homo sapiens
QSPGTLSLSPGERATLSCRASQSVSSYLAWYQQKPGQAPRLLIYGASSRATGIPDRFSGSGSGTDFTLTISRLEPEDFAVYYCQQYGRSPFTFGPGTKVDIKRTVAAPSVFIFPPSDEQLKSGTASVVCLLNNFYPREAKVQWKGG

SEQ ID NO: 42 - protein, 153 aa, Homo sapiens; identical to SEQ ID NO: 39

SEQ ID NO: 43 - protein, 146 aa, Homo sapiens; identical to SEQ ID NO: 41

SEQ ID NO: 44 - protein, 10 aa, Homo sapiens
GFTFSSHGIH

SEQ ID NO: 45 - protein, 15 aa, Homo sapiens
VIWYDGRNKDYADSV

SEQ ID NO: 46 - protein, 9 aa, Homo sapiens
VAPLGPLDY

SEQ ID NO: 47 - protein, 11 aa, Homo sapiens
RASQSVSSYLA

SEQ ID NO: 48 - protein, 7 aa, Homo sapiens
GASSRAT

SEQ ID NO: 49 - protein, 10 aa, Homo sapiens
CQQYGRSPFT

SEQ ID NO: 50 - DNA, 1395 bp, Homo sapiens
atggagtttgggctgagctgggttttcctcgttgctcttttaagaggtgtccagtgtcaggtgcagctggtggagtctgggggaggcgtggtccagcctgggaggtccctgagactctcctgtacagcgtctggattcaccttcagtaactatggcatgcactgggtccgccaggctccaggcaaggggctggagtgggtggcagttatatggtatgatggaagtaataaacactatggagactccgtgaagggccgattcaccatctccagtgacaattccaagaacacgctgtatctgcaaatgaacagcctgagagccgaggacacggctgtgtattactgtgcgagaggagagagactggggtcctactttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 51 - protein, 464 aa, Homo sapiens
MEFGLSWVFLVALLRGVQCQVQLVESGGGVVQPGRSLRLSCTASGFTFSNYGMHWVRQAPGKGLEWVAVIWYDGSNKHYGDSVKGRFTISSDNSKNTLYLQMNSLRAEDTAVYYCARGERLGSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 52 - DNA, 702 bp, Homo sapiens
atggaaaccccagcgcagcttctcttcctcctgctactctggctcccagataccaccggagaaattgtgttgacgcagtctccaggcaccctgtctttgtctccaggggaaagagccaccctctcctgcaggaccagtgttagcagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtctattactgtcagcagtatggcatctcacccttcactttcggcggagggaccaaggtggagatcaagcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 53 - protein, 233 aa, Homo sapiens
METPAQLLFLLLLWLPDTTGEIVLTQSPGTLSLSPGERATLSCRTSVSSSYLAWYQQKPGQAPRLLIYGASSRATGIPDRFSGSGSGTDFTLTISRLEPEDFAVYYCQQYGISPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 54 - protein, 166 aa, Homo sapiens
GVVQPGRSLRLSCTASGFTFSNYGMHWVRQAPGKGLEWVAVIWYDGSNKHYGDSVKGRFTISSDNSKNTLYLQMNSLRAEDTAVYYCARGERLGSYFDYWGQGTLVTVSSASTKGPSVFPLAPCSRSTSESTAALGCLVKDYFPEPVTVSWNSGALTSGVHTFPAV

SEQ ID NO: 55 - protein, 141 aa, Homo sapiens
QSPGTLSLSPGERATLSCRTSVSSSYLAWYQQKPGQAPRLLIYGASSRATGIPDRFSGSGSGTDFTLTISRLEPEDFAVYYCQQYGISPFTFGGGTKVEIKRTVAAPSVFIFPPSDEQLKSGTASVVCLLNNFYPREAKVQ

SEQ ID NO: 56 - protein, 10 aa, Homo sapiens
GFTFSNYGMH

SEQ ID NO: 57 - protein, 15 aa, Homo sapiens
VIWYDGSNKHYGDSV

SEQ ID NO: 58 - protein, 10 aa, Homo sapiens
GERLGSYFDY

SEQ ID NO: 59 - protein, 10 aa, Homo sapiens
RTSVSSSYLA

SEQ ID NO: 60 - protein, 7 aa, Homo sapiens
GASSRAT

SEQ ID NO: 61 - protein, 10 aa, Homo sapiens
CQQYGISPFT

SEQ ID NO: 62 - DNA, 489 bp, Homo sapiens
cctgggaggtccctgagactctcctgtgcagcgtctggattcaccttcagtagtcatggcatccactgggtccgccaggctccaggcaaggggctggagtgggtggcagttatatggtatgatggaagaaataaagactatgcagactccgtgaagggccgattcaccatctccagagacaattccaagaagacgctgtatttgcaaatgaacagcctgagagccgaggacacggctgtgtattactgtgcgagagtggccccactggggccacttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacag

SEQ ID NO: 63 - protein, 163 aa, Homo sapiens
PGRSLRLSCAASGFTFSSHGIHWVRQAPGKGLEWVAVIWYDGRNKDYADSVKGRFTISRDNSKKTLYLQMNSLRAEDTAVYYCARVAPLGPLDYWGQGTLVTVSSASTKGPSVFPLAPCSRSTSESTAALGCLVKDYFPEPVTVSWNSGALTSGVHTFPAVLQ

SEQ ID NO: 64 - DNA, 417 bp, Homo sapiens
ggcaccctgtctttgtctccaggggaaagagccaccctctcctgcagggccagtcagagtgtcagcagctacttagcctggtaccagcagaaacctggccaggctcccagactcctcatctatggtgcatccagcagggccactggcatcccagacaggttcagtggcagtgggtctgggacagacttcactctcaccatcagcagactggagcctgaggattttgcagtgtattactgtcagcagtatggtaggtcaccattcactttcggccctgggaccaaagtggatatcaagcgaactgtggctgcaccatctgtcttcatcttcccgccatctgatgagcagttgaaatctggaactgcctctgttgtgtgcctgctgaataacttctatcccagagaggccaaagtacag

SEQ ID NO: 65 - protein, 139 aa, Homo sapiens
GTLSLSPGERATLSCRASQSVSSYLAWYQQKPGQAPRLLIYGASSRATGIPDRFSGSGSGTDFTLTISRLEPEDFAVYYCQQYGRSPFTFGPGTKVDIKRTVAAPSVFIFPPSDEQLKSGTASVVCLLNNFYPREAKVQ

SEQ ID NO: 66 - protein, 163 aa, Homo sapiens; identical to SEQ ID NO: 63

SEQ ID NO: 67 - protein, 139 aa, Homo sapiens; identical to SEQ ID NO: 65

SEQ ID NO: 68 - protein, 10 aa, Homo sapiens
GFTFSSHGIH

SEQ ID NO: 69 - protein, 15 aa, Homo sapiens
VIWYDGRNKDYADSV

SEQ ID NO: 70 - protein, 9 aa, Homo sapiens
VAPLGPLDY

SEQ ID NO: 71 - protein, 11 aa, Homo sapiens
RASQSVSSYLA

SEQ ID NO: 72 - protein, 7 aa, Homo sapiens
GASSRAT

SEQ ID NO: 73 - protein, 10 aa, Homo sapiens
CQQYGRSPFT

SEQ ID NO: 74 - DNA, 1392 bp, Homo sapiens
atggagtttgggctgagctgggttttcctcgttgctcttttaagaggtgtccagtgtcaggtgcagctggtggagtctgggggaggcgtggtcgagcctgggaggtccctgagactctcctgtacagcgtctggattcaccttcagtagttatggcatgcactgggtccgccaggctccaggcaaggggctggagtgggtggcagttatatggtatgatggaagcaataaacactatgcagactccgcgaagggccgattcaccatctccagagacaattccaagaacacgctgtatctgcaaatgaacagcctgagagccgaggacacggctgtgtattactgtgcgagagccggactgctgggttactttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 75 - protein, 463 aa, Homo sapiens
MEFGLSWVFLVALLRGVQCQVQLVESGGGVVEPGRSLRLSCTASGFTFSSYGMHWVRQAPGKGLEWVAVIWYDGSNKHYADSAKGRFTISRDNSKNTLYLQMNSLRAEDTAVYYCARAGLLGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 76 - DNA, 705 bp, Homo sapiens
atggaaaccccagcgcagcttctcttcctcctgctactctggctcccagataccaccggagaaattgtgttgacgcagtctccaggcaccctgtctttgtctccaggggaaagagccaccctctcctgtagggccagtcaaagtgttagcagctacttagcctggtaccaacagaaacctggccaggctcccaggcccctcatctatggtgtatccagcagggccactggcatcccagacaggttcagtggcagtgggtctgggacagacttcactctcaccatcagcagactggagcctgaagattttgcagtgtattactgtcagcagtatggtatctcaccattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 77 - protein, 234 aa, Homo sapiens
METPAQLLFLLLLWLPDTTGEIVLTQSPGTLSLSPGERATLSCRASQSVSSYLAWYQQKPGQAPRPLIYGVSSRATGIPDRFSGSGSGTDFTLTISRLEPEDFAVYYCQQYGISPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 138 aa, Homo sapiens
GGVVEPGRSLRLSCTASGFTFSSYGMHWVRQAPGKGLEWVAVIWYDGSNKHYADSAKGRFTISRDNSKNTLYLQMNSLRAEDTAVYYCARAGLLGYFDYWGQGTLVTVSSASTKGPSVFPLAPCSRSTSESTAALGCL

SEQ ID NO: 79 - protein, 142 aa, Homo sapiens
QSPGTLSLSPGERATLSCRASQSVSSYLAWYQQKPGQAPRPLIYGVSSRATGIPDRFSGSGSGTDFTLTISRLEPEDFAVYYCQQYGISPFTFGPGTKVDIKRTVAAPSVFIFPPSDEQLKSGTASVVCLLNNFYPREAKVQ

SEQ ID NO: 80 - protein, 10 aa, Homo sapiens
GFTFSSYGMH

SEQ ID NO: 81 - protein, 15 aa, Homo sapiens
VIWYDGSNKHYADSA

SEQ ID NO: 82 - protein, 9 aa, Homo sapiens
AGLLGYFDY

SEQ ID NO: 83 - protein, 11 aa, Homo sapiens
RASQSVSSYLA

SEQ ID NO: 84 - protein, 7 aa, Homo sapiens
GASSRAT

SEQ ID NO: 85 - protein, 10 aa, Homo sapiens
CQQYGISPFT

SEQ ID NO: 86 - DNA, 507 bp, Homo sapiens
ggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaggggcccgtataataaccccttgtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacag

SEQ ID NO: 87 - protein, 169 aa, Homo sapiens
GVVQPGRSLRLSCAASGFTFSSYGMHWVRQAPGKGLEWVAVIWYDGSNKYYADSVKGRFTISRDNSKNTLYLQMNSLRAEDTAVYYCARGARIITPCMDVWGQGTTVTVSSASTKGPSVFPLAPCSRSTSESTAALGCLVKDYFPEPVTVSWNSGALTSGVHTFPAVLQ

SEQ ID NO: 88 - DNA, 458 bp, Homo sapiens
cagtctccatcctccctgtctgcatctgtaggagacagagtcaccatcacttgccgggcaagtcagagcattaacacctatttaatttggtatcagcagaaaccagggaaagcccctaacttcctgatctctgctacatccattttgcaaagtggggtcccatcaaggttccgtggcagtggctctgggacaaatttcactctcaccatcaacagtcttcatcctgaagattttgcaacttactactgtcaacagagttacagtaccccattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaa

SEQ ID NO: 89 - protein, 152 aa, Homo sapiens
QSPSSLSASVGDRVTITCRASQSINTYLIWYQQKPGKAPNFLISATSILQSGVPSRFRGSGSGTNFTLTINSLHPEDFATYYCQQSYSTPFTFGPGTKVDIKRTVAAPSVFIFPPSDEQLKSGTASVVCLLNNFYPREAKVQWKVDNALQSG

SEQ ID NO: 90 - protein, 169 aa, Homo sapiens; identical to SEQ ID NO: 87

SEQ ID NO: 91 - protein, 152 aa, Homo sapiens; identical to SEQ ID NO: 89

SEQ ID NO: 92 - protein, 10 aa, Homo sapiens
GFTFSSYGMH

SEQ ID NO: 93 - protein, 15 aa, Homo sapiens
VIWYDGSNKYYADSV

SEQ ID NO: 94 - protein, 11 aa, Homo sapiens
GARIITPCMDV

SEQ ID NO: 95 - protein, 11 aa, Homo sapiens
RASQSINTYLI

SEQ ID NO: 96 - protein, 7 aa, Homo sapiens
ATSILQS

SEQ ID NO: 97 - protein, 9 aa, Homo sapiens
QQSYSTPFT

SEQ ID NO: 98 - DNA, 501 bp, Homo sapiens
ggcgtggtccagcctgggaggtccctgagactctcctgtgtagcgtctggattcatcttcagtagtcatggcatccactgggtccgccaggctccaggcaaggggctggagtgggtggcagttatatggtatgatggaagaaataaagactatgcagactccgtgaagggccgattcaccatctccagagacaattccaagaacacgctgtatttgcaaatgaacagcctgagagccgaggacacggctgtgtattactgtgcgagagtggccccactggggccacttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacag

SEQ ID NO: 99 - protein, 167 aa, Homo sapiens
GVVQPGRSLRLSCVASGFIFSSHGIHWVRQAPGKGLEWVAVIWYDGRNKDYADSVKGRFTISRDNSKNTLYLQMNSLRAEDTAVYYCARVAPLGPLDYWGQGTLVTVSSASTKGPSVFPLAPCSRSTSESTAALGCLVKDYFPEPVTVSWNSGALTSGVHTFPAVLQ

SEQ ID NO: 100 - DNA, 426 bp, Homo sapiens
tctccaggcaccctgtctttgtctccaggggaaagagccaccctctcctgcagggccagtcagagtattagcagcaatttcttagcctggtaccagcagaaacctggccaggctcccaggctcctcatctatcgtccatccagcagggccactggcatcccagacagtttcagtggcagtgggtctgggacagacttcactctcaccatcagcagactggagcctgaggattttgcattatattactgtcagcagtatggtacgtcaccattcactttcggccctgggaccaaagtggatatcaagcgaactgtggctgcaccatctgtcttcatcttcccgccatctgatgagcagttgaaatctggaactgcctctgttgtgtgcctgctgaataacttctatcccagagaggccaaagtacag

SEQ ID NO: 101 - protein, 142 aa, Homo sapiens
SPGTLSLSPGERATLSCRASQSISSNFLAWYQQKPGQAPRLLIYRPSSRATGIPDSFSGSGSGTDFTLTISRLEPEDFALYYCQQYGTSPFTFGPGTKVDIKRTVAAPSVFIFPPSDEQLKSGTASVVCLLNNFYPREAKVQ

SEQ ID NO: 102 - protein, 167 aa, Homo sapiens; identical to SEQ ID NO: 99

SEQ ID NO: 103 - protein, 142 aa, Homo sapiens; identical to SEQ ID NO: 101

SEQ ID NO: 104 - protein, 10 aa, Homo sapiens
GFIFSSHGIH

SEQ ID NO: 105 - protein, 15 aa, Homo sapiens
VIWYDGRNKDYADSV

SEQ ID NO: 106 - protein, 9 aa, Homo sapiens
VAPLGPLDY

SEQ ID NO: 107 - protein, 12 aa, Homo sapiens
RASQSISSNFLA

SEQ ID NO: 108 - protein, 7 aa, Homo sapiens
RPSSRAT

SEQ ID NO: 109 - protein, 10 aa, Homo sapiens
CQQYGTSPFT

SEQ ID NO: 110 - DNA, 516 bp, Homo sapiens
tcgggcccaggactggtgaagccttcacagatcctgtccctcacctgcactgtctctggtggctccatcagcagtggtggtcactactggagctggatccgccagcacccagggaagggcctggagtggattgggtacatctattacattgggaacacctactacaacccgtccctcaagagtcgagttaccatatcagtagacacgtctaagaaccagttctccctgaagctgagctctgtgactgccgcggacacggccgtgtattattgtgcgagagatagtggggactactacggtatagacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacaa

SEQ ID NO: 111 - protein, 172 aa, Homo sapiens
SGPGLVKPSQILSLTCTVSGGSISSGGHYWSWIRQHPGKGLEWIGYIYYIGNTYYNPSLKSRVTISVDTSKNQFSLKLSSVTAADTAVYYCARDSGDYYGIDVWGQGTTVTVSSASTKGPSVFPLAPCSRSTSESTAALGCLVKDYFPEPVTVSWNSGALTSGVHTFPAVLQ

SEQ ID NO: 112 - DNA, 465 bp, Homo sapiens
tctccagactttcagtctgtgactccaaaggagaaagtcaccatcacctgccgggccagtcagagcattggtagtagcttacattggtatcagcagaaaccagatcagtctccaaagctcctcatcaagtatgcttcccagtccttctctggggtcccctcgaggttcagtggcagtggatctgggacagatttcaccctcaccatcaatagcctggaagctgaagatgctgcaacgtattactgtcatcagagtagtagtttaccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggag

SEQ ID NO: 113 - protein, 155 aa, Homo sapiens
SPDFQSVTPKEKVTITCRASQSIGSSLHWYQQKPDQSPKLLIKYASQSFSGVPSRFSGSGSGTDFTLTINSLEAEDAATYYCHQSSSLPLTFGGGTKVEIKRTVAAPSVFIFPPSDEQLKSGTASVVCLLNNFYPREAKVQWKVDNALQSGNSQE

SEQ ID NO: 114 - protein, 172 aa, Homo sapiens; identical to SEQ ID NO: 111

SEQ ID NO: 115 - protein, 155 aa, Homo sapiens; identical to SEQ ID NO: 113

SEQ ID NO: 116 - protein, 8 aa, Homo sapiens
SSGGHYWS

SEQ ID NO: 117 - protein, 17 aa, Homo sapiens
GYIYYIGNTYYNPSLKS

SEQ ID NO: 118 - protein, 10 aa, Homo sapiens
DSGDYYGIDV

SEQ ID NO: 119 - protein, 12 aa, Homo sapiens
CRASQSIGSSLH

SEQ ID NO: 120 - protein, 7 aa, Homo sapiens
YASQSFS

SEQ ID NO: 121 - protein, 9 aa, Homo sapiens
HQSSSLPLT

SEQ ID NO: 122 - DNA, 451 bp, Homo sapiens
ggcgtggtccagcctgggaggtccctgagactctcctgtgcagcgtctggattcaccttcagtagctatggcatgcactgggtccgccaggctccaggcaaggggctggagtgggtggcagttatatggtatgatggaagtcataaatactatgcagactccgtgaagggccgattcaccatctccagagacaattccaagaacacgctgtatctgcaaatgaacagcctgagagccgaggacacggctgtgtattactgtgcgagaggcgctgtagtagtaccagctgctatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgt

SEQ ID NO: 123 - protein, 151 aa, Homo sapiens
GVVQPGRSLRLSCAASGFTFSSYGMHWVRQAPGKGLEWVAVIWYDGSHKYYADSVKGRFTISRDNSKNTLYLQMNSLRAEDTAVYYCARGAVVVPAAMDVWGQGTTVTVSSASTKGPSVFPLAPCSRSTSESTAALGCLVKDYFPEPVTVS

SEQ ID NO: 124 - DNA, 402 bp, Homo sapiens
  misc_feature (207)..(207): n is a, c, g, or t
acccagtctccatcctccctgtctgcatctgtaggagacagagtcaccatcacttgccgggcaagtcagaacattagcaggtatttaaattggtatcaacagaaaccagggaaagcccctaagttcctgatctatgttgcatctattttgcaaagtggggtcccatcagggttcagtgccagtggatctgggccagatttcactctnaccatcagcagtctgcaacctgaagattttgcaacttactactgtcaacagagttacagtaccccattcactttcggccctgggaccaaagtggatatcaaacgaactgtggctgcaccatctgtcttcatcttcccgccatctgatgagcagttgaaatctggaactgcctctgttgtgtgcctgctgaataac

SEQ ID NO: 125 - protein, 134 aa, Homo sapiens
TQSPSSLSASVGDRVTITCRASQNISRYLNWYQQKPGKAPKFLIYVASILQSGVPSGFSASGSGPDFTLTISSLQPEDFATYYCQQSYSTPFTFGPGTKVDIKRTVAAPSVFIFPPSDEQLKSGTASVVCLLNN

SEQ ID NO: 126 - protein, 150 aa, Homo sapiens
GVVQPGRSLRLSCAASGFTFSSYGMHWVRQAPGKGLEWVAVIWYDGSHKYYADSVKGRFTISRDNSKNTLYLQMNSLRAEDTAVYYCARGAVVVPAAMDVWGQGTTVTVSSASTKGPSVFPLAPCSRSTSESTAALGCLVKDYFPEPVTV

SEQ ID NO: 127 - protein, 134 aa, Homo sapiens; identical to SEQ ID NO: 125

SEQ ID NO: 128 - protein, 10 aa, Homo sapiens
GFTFSSYGMH

SEQ ID NO: 129 - protein, 15 aa, Homo sapiens
VIWYDGSHKYYADSV

SEQ ID NO: 130 - protein, 11 aa, Homo sapiens
GAVVVPAAMDV

SEQ ID NO: 131 - protein, 11 aa, Homo sapiens
RASQNISRYLN

SEQ ID NO: 132 - protein, 7 aa, Homo sapiens
VASILQS

SEQ ID NO: 133 - protein, 9 aa, Homo sapiens
QQSYSTPFT

SEQ ID NO: 134 - DNA, 438 bp, Homo sapiens
  misc_feature (64)..(64): n is a, c, g, or t
gtggtccagcctgggaggtccctgagactctcctgtgcagcgtctggattcaccttcagtagcngtggcatgcactgggtccgccaggctccaggcaaggggctggagtgggtggcagttatatggtctgatggaagtcataaatactatgcagactccgtgaagggccgattcaccatctccagagacaattccaagaacacgctgtatctgcaaatgaacagcctgagagccgaggacacggctgtgtattactgtgcgagaggaactatgatagtagtgggtacccttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccg

SEQ ID NO: 135 - protein, 145 aa, Homo sapiens
VVQPGRSLRLSCAASGFTFSSGMHWVRQAPGKGLEWVAVIWSDGSHKYYADSVKGRFTISRDNSKNTLYLQMNSLRAEDTAVYYCARGTMIVVGTLDYWGQGTLVTVSSASTKGPSVFPLAPCSRSTSESTAALGCLVKDYFPEP

SEQ ID NO: 136 - DNA, 451 bp, Homo sapiens
acccagtctccatcctccctgtctgcatctgtaggagacagagtcaccatcacttgccgggcaagtcagagcatttgcaactatttaaattggtatcagcagaaaccaggaaaagcccctagggtcctgatctatgctgcatccagtttgcaaggtggggtcccgtcaaggttcagtggcagtggatctgggacagattgcactctcaccatcagcagtctgcaacctgaagattttgcaacttactactgtcaacagagttacactaccccattcactttcggccctgggaccagagtggatatcgaacgaactgtggctgcaccatctgtcttcatcttcccgccatctgatgagcagttgaaatctggaactgcctctgttgtgtgcctgctgaataacttctatcccagagaggccaaagtacagtggaaggtggataacgcctatt

SEQ ID NO: 137 - protein, 150 aa, Homo sapiens
TQSPSSLSASVGDRVTITCRASQSICNYLNWYQQKPGKAPRVLIYAASSLQGGVPSRFSGSGSGIDCTLTISSLQPEDFATYYCQQSYITPFTFGPGTRVDIERTVAAPSVFIFPPSDEQLKSGTASVVCLLNNFYPREAKVQWKVDNAY

SEQ ID NO: 138 - protein, 146 aa, Homo sapiens
VVQPGRSLRLSCAASGFTFSSCGMHWVRQAPGKGLEWVAVIWSDGSHKYYADSVKGRFTISRDNSKNTLYLQMNSLRAEDTAVYYCARGTMIVVGTLDYWGQGTLVTVSSASTKGPSVFPLAPCSRSTSESTAALGCLVKDYFPEP

SEQ ID NO: 139 - protein, 150 aa, Homo sapiens; identical to SEQ ID NO: 137

SEQ ID NO: 140 - protein, 10 aa, Homo sapiens
GFTFSSCGMH

SEQ ID NO: 141 - protein, 15 aa, Homo sapiens
VIWSDGSHKYYADSV

SEQ ID NO: 142 - protein, 11 aa, Homo sapiens
GTMIVVGTLDY

SEQ ID NO: 143 - protein, 11 aa, Homo sapiens
RASQSICNYLN

SEQ ID NO: 144 - protein, 7 aa, Homo sapiens
AASSLQG

SEQ ID NO: 145 - protein, 9 aa, Homo sapiens
QQSYITPFT

SEQ ID NO: 146 - DNA, 562 bp, Homo sapiens
tcctgtgcagcgtctggattcaccttcagttactatggcgtctgggggaggcgtggtccagcctgggaggtccctgagactctcctgtgcagcgtctggattcaccttcagtagctatggcgtgcactgggtccgccaggctccaggcaaggggctggagtgggtggcagttatatggtatgatggaagtaataaatactatgcagactccgtgaagggccgattcaccatctccagagacaattccaagagcacgctgtatctgcaaatgaacagcctgagagccgaggacacggctgtgtattattgtgcgagagactcgtattacgatttttggagtggtcggggcggtatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtc

SEQ ID NO: 147 - protein, 174 aa, Homo sapiens
SGGGVVQPGRSLRLSCAASGFTFSSYGVHWVRQAPGKGLEWVAVIWYDGSNKYYADSVKGRFTISRDNSKSTLYLQMNSLRAEDTAVYYCARDSYYDFWSGRGGMDVWGQGTTVTVSSASTKGPSVFPLAPCSRSTSESTAALGCLVKDYFPEPVTVSWNSGALTSGVHTFPAV

SEQ ID NO: 148 - DNA, 419 bp, Homo sapiens
ccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggttcacactggcctccgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccac

SEQ ID NO: 149 - protein, 139 aa, Homo sapiens
PLSLPVTLGQPASISCRSSQSLVYSDGNTYLNWFQQRPGQSPRRLIYKVSNWDSGVPDRFSGSGSGTDFTLKISRVEAEDVGVYYCMQGSHWPPTFGQGTKVEIKRTVAAPSVFIFPPSDEQLKSGTASVVCLLNNFYP

SEQ ID NO: 150 - protein, 171 aa, Homo sapiens
GVVQPGRSLRLSCAASGFTFSSYGVHWVRQAPGKGLEWVAVIWYDGSNKYYADSVKGRFTISRDNSKSTLYLQMNSLRAEDTAVYYCARDSYYDFWSGRGGMDVWGQGTTVTVSSASTKGPSVFPLAPCSRSTSESTAALGCLVKDYFPEPVTVSWNSGALTSGVHTFPAV

SEQ ID NO: 151 - protein, 139 aa, Homo sapiens; identical to SEQ ID NO: 149

SEQ ID NO: 152 - protein, 10 aa, Homo sapiens
GFTFSSYGVH

SEQ ID NO: 153 - protein, 15 aa, Homo sapiens
VIWYDGSNKYYADSV

SEQ ID NO: 154 - protein, 15 aa, Homo sapiens
DSYYDFWSGRGGMDV

SEQ ID NO: 155 - protein, 16 aa, Homo sapiens
RSSQSLVYSDGNTYLN

SEQ ID NO: 156 - protein, 7 aa, Homo sapiens
KVSNWDS

SEQ ID NO: 157 - protein, 9 aa, Homo sapiens
MQGSHWPPT

SEQ ID NO: 158 - DNA, 490 bp, Homo sapiens
gtccagcctgggaggtccctgagactctcctgtgcagcgtctggattcaccttcagtaactatgccatgcactgggtccgccaggctccaggcaaggggctggagtgggtggtagttatttggcatgatggaaataataaatactatgcagagtccgtgaagggccgattcaccatctccagagacaattccaagaacacgctgtatctgcaaatgaacagcctgagagccgaggacacggctgtatattactgtgcgagagatcagggcactggctggtacggaggctttgacttctggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcc

SEQ ID NO: 159 - protein, 163 aa, Homo sapiens
VQPGRSLRLSCAASGFTFSNYAMHWVRQAPGKGLEWVVVIWHDGNNKYYAESVKGRFTISRDNSKNTLYLQMNSLRAEDTAVYYCARDQGTGWYGGFDFWGQGTLVTVSSASTKGPSVFPLAPCSRSTSESTAALGCLVKDYFPEPVTVSWNSGALTSGVHTF

SEQ ID NO: 160 - DNA, 419 bp, Homo sapiens
cctggagagccggcttccatctcttgcaggtctagtcagagcctcctgcatagtaatggatacaactatttggattggtacctgcagaagccaggacagtctccacagctcctgatctatttgggttctaatcgggcctccggggtccctgacaggttcagtggcagtggatcaggcacagattttacactgaaactcagcagagtggaggctgaggatgttggggtttattactgcatgcaagctctacaaactcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagaraggccaaagtacattccat

SEQ ID NO: 161 - protein, 133 aa, Homo sapiens
PGEPASISCRSSQSLLHSNGYNYLDWYLQKPGQSPQLLIYLGSNRASGVPDRFSGSGSGTDFTLKLSRVEAEDVGVYYCMQALQTPLTFGGGTKVEIKRTVAAPSVFIFPPSDEQLKSGTASVVCLLNNFYPR

SEQ ID NO: 162 - protein, 163 aa, Homo sapiens; identical to SEQ ID NO: 159

SEQ ID NO: 163 - protein, 133 aa, Homo sapiens; identical to SEQ ID NO: 161

SEQ ID NO: 164 - protein, 10 aa, Homo sapiens
GFTFSNYAMH

SEQ ID NO: 165 - protein, 15 aa, Homo sapiens
VIWHDGNNKYYAESV

SEQ ID NO: 166 - protein, 12 aa, Homo sapiens
DQGTGWYGGFDF

SEQ ID NO: 167 - protein, 16 aa, Homo sapiens
RSSQSLLHSNGYNYLD

SEQ ID NO: 168 - protein, 7 aa, Homo sapiens
LGSNRAS

SEQ ID NO: 169 - protein, 9 aa, Homo sapiens
MQALQTPLT

SEQ ID NO: 170 - DNA, 1612 bp, Mus musculus
tcaagcttttggaccctcgtacagaagctaatacgactcactatagggaaataagagagaaaagaagagtaagaagaaatataagagccaccatggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgcaaaaactacagcaccctctgtataccctctcgcacctgtgtgcggagacacaactggcagctcagtaaccctcgggtgcctggttaaggggtatttcccagagccagtgactctcacctggaattctggaagccttagttcaggagtacatactttccccgctgtgctacaatcagatctgtacaccctgagttcaagcgttaccgttacgagtagtacttggccttctcagtccataacctgtaacgtcgcccatcccgcctcttctaccaaggttgacaagaagattgaaccgagaggacccaccattaaaccctgccctccttgcaagtgtcctgctccaaacctcttgggaggcccgtccgtcttcatctttcccccaaagatcaaagacgtgctcatgatttcgctgtcaccaatcgtaacgtgcgttgtggtggacgtctccgaggacgacccagatgtccagatatcctggttcgtaaacaatgtggaggtccatacagcccagacgcagacccaccgcgaggactataattctaccctcagggttgtctctgccctgccaattcagcatcaggactggatgagcgggaaagagttcaagtgtaaagtgaataataaagatctgcctgcccccatcgagagaactatcagtaaacctaaaggatccgtgcgcgctccccaggtctacgtcctgccccccccagaagaggaaatgactaagaagcaggtcacacttacctgcatggtgacggattttatgccagaagacatttatgtggaatggacaaataatggaaagacagagctcaattataagaacacagagccagtgttagattcagatggcagttattttatgtacagcaaactgcgcgtagaaaaaaaaaattgggtcgagcgcaatagctactcctgcagcgtcgtgcatgaagggctacacaatcaccacaccacgaagagcttttcccggacacctgggaaatgataataggctggagcctcggtggccatgcttcttgccccttgggcctccccccagcccctcctccccttcctgcacccgtacccccgtggtctttgaataaagtctgagtgggcggc

SEQ ID NO: 171 - protein, 467 aa, Mus musculus
METDTLLLWVLLLWVPGSTGEAKLQESGPVLVKPGASVKMSCKASGYTFTDYYMNWVKQSHGKSLEWIGVINPYNGDTSYNQKFKGKATLTVDKSSSTAYMELNSLTSEDSAVYYCARYYGSWFAYWGQGTLITVSTAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 172 - DNA, 1401 bp, Mus musculus
atggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgcaaaaactacagcaccctctgtataccctctcgcacctgtgtgcggagacacaactggcagctcagtaaccctcgggtgcctggttaaggggtatttcccagagccagtgactctcacctggaattctggaagccttagttcaggagtacatactttccccgctgtgctacaatcagatctgtacaccctgagttcaagcgttaccgttacgagtagtacttggccttctcagtccataacctgtaacgtcgcccatcccgcctcttctaccaaggttgacaagaagattgaaccgagaggacccaccattaaaccctgccctccttgcaagtgtcctgctccaaacctcttgggaggcccgtccgtcttcatctttcccccaaagatcaaagacgtgctcatgatttcgctgtcaccaatcgtaacgtgcgttgtggtggacgtctccgaggacgacccagatgtccagatatcctggttcgtaaacaatgtggaggtccatacagcccagacgcagacccaccgcgaggactataattctaccctcagggttgtctctgccctgccaattcagcatcaggactggatgagcgggaaagagttcaagtgtaaagtgaataataaagatctgcctgcccccatcgagagaactatcagtaaacctaaaggatccgtgcgcgctccccaggtctacgtcctgccccccccagaagaggaaatgactaagaagcaggtcacacttacctgcatggtgacggattttatgccagaagacatttatgtggaatggacaaataatggaaagacagagctcaattataagaacacagagccagtgttagattcagatggcagttattttatgtacagcaaactgcgcgtagaaaaaaaaaattgggtcgagcgcaatagctactcctgcagcgtcgtgcatgaagggctacacaatcaccacaccacgaagagcttttcccggacacctgggaaa

SEQ ID NO: 173 - DNA, 1671 bp, Mus musculus
ggaaataagagagaaaagaagagtaagaagaaatataagagccaccatggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgcaaaaactacagcaccctctgtataccctctcgcacctgtgtgcggagacacaactggcagctcagtaaccctcgggtgcctggttaaggggtatttcccagagccagtgactctcacctggaattctggaagccttagttcaggagtacatactttccccgctgtgctacaatcagatctgtacaccctgagttcaagcgttaccgttacgagtagtacttggccttctcagtccataacctgtaacgtcgcccatcccgcctcttctaccaaggttgacaagaagattgaaccgagaggacccaccattaaaccctgccctccttgcaagtgtcctgctccaaacctcttgggaggcccgtccgtcttcatctttcccccaaagatcaaagacgtgctcatgatttcgctgtcaccaatcgtaacgtgcgttgtggtggacgtctccgaggacgacccagatgtccagatatcctggttcgtaaacaatgtggaggtccatacagcccagacgcagacccaccgcgaggactataattctaccctcagggttgtctctgccctgccaattcagcatcaggactggatgagcgggaaagagttcaagtgtaaagtgaataataaagatctgcctgcccccatcgagagaactatcagtaaacctaaaggatccgtgcgcgctccccaggtctacgtcctgccccccccagaagaggaaatgactaagaagcaggtcacacttacctgcatggtgacggattttatgccagaagacatttatgtggaatggacaaataatggaaagacagagctcaattataagaacacagagccagtgttagattcagatggcagttattttatgtacagcaaactgcgcgtagaaaaaaaaaattgggtcgagcgcaatagctactcctgcagcgtcgtgcatgaagggctacacaatcaccacaccacgaagagcttttcccggacacctgggaaatgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 174 - DNA, 1630 bp, Mus musculus
tcaagcttttggaccctcgtacagaagctaatacgactcactatagggaaataagagagaaaagaagagtaagaagaaatataagagccaccatggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgccaaaaccacaccgccttccgtgtaccctctagcgcccggttgtggtgacactacaggatcgtctgtgactttgggctgccttgtgaaaggatatttccctgaatctgttactgtgacctggaactctggctcgctgagtagttcagtgcacacattccccgccctgcttcagagcggtttgtacaccatgtcttcttcagttaccgtcccctcatcaacgtggccttcacagactgtcacgtgttctgttgcccacccagcaagctccaccaccgtggataaaaaactggagccaagcgggccgatctcaaccatcaatccgtgtcctccatgcaaggagtgccacaagtgtcctgccccaaatctggagggaggcccgtccgtctttatttttccacccaatattaaagacgtcctgatgataagcttgaccccaaaagtaacttgcgttgtggtggatgtctcggaggatgaccccgatgttcagatcagctggttcgtgaacaacgtcgaggtacatactgcgcagacccaaactcaccgagaagattataacagtactattcgagtggtgtctacccttcccatccagcaccaggactggatgtccggaaaggaatttaaatgcaaggtgaataataaagatctaccctcaccaattgaacgaacgataagtaagatcaaaggactggtgagggccccacaggtgtatattctcccacctcctgccgagcagctgtcccgcaaagacgtctccttaacatgtttagtcgtgggattcaaccctggagatattagcgtcgagtggaccagtaacggtcacacggaagagaactacaaagacacggcgcccgtgctcgacagtgacggcagttacttcatctactccaaacttaatatgaagaccagtaaatgggagaagacagactccttttcttgcaatgtgcgccacgagggcctgaagaactactacctgaaaaagacaatcagcagaagccctggcaagtgataataggctggagcctcggtggccatgcttcttgccccttgggcctccccccagcccctcctccccttcctgcacccgtacccccgtggtctttgaataaagtctgagtgggcggc

SEQ ID NO: 175 - protein, 473 aa, Mus musculus
METDTLLLWVLLLWVPGSTGEAKLQESGPVLVKPGASVKMSCKASGYTFTDYYMNWVKQSHGKSLEWIGVINPYNGDTSYNQKFKGKATLTVDKSSSTAYMELNSLTSEDSAVYYCARYYGSWFAYWGQGTLITVSTAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 176 - DNA, 1419 bp, Mus musculus
atggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgccaaaaccacaccgccttccgtgtaccctctagcgcccggttgtggtgacactacaggatcgtctgtgactttgggctgccttgtgaaaggatatttccctgaatctgttactgtgacctggaactctggctcgctgagtagttcagtgcacacattccccgccctgcttcagagcggtttgtacaccatgtcttcttcagttaccgtcccctcatcaacgtggccttcacagactgtcacgtgttctgttgcccacccagcaagctccaccaccgtggataaaaaactggagccaagcgggccgatctcaaccatcaatccgtgtcctccatgcaaggagtgccacaagtgtcctgccccaaatctggagggaggcccgtccgtctttatttttccacccaatattaaagacgtcctgatgataagcttgaccccaaaagtaacttgcgttgtggtggatgtctcggaggatgaccccgatgttcagatcagctggttcgtgaacaacgtcgaggtacatactgcgcagacccaaactcaccgagaagattataacagtactattcgagtggtgtctacccttcccatccagcaccaggactggatgtccggaaaggaatttaaatgcaaggtgaataataaagatctaccctcaccaattgaacgaacgataagtaagatcaaaggactggtgagggccccacaggtgtatattctcccacctcctgccgagcagctgtcccgcaaagacgtctccttaacatgtttagtcgtgggattcaaccctggagatattagcgtcgagtggaccagtaacggtcacacggaagagaactacaaagacacggcgcccgtgctcgacagtgacggcagttacttcatctactccaaacttaatatgaagaccagtaaatgggagaagacagactccttttcttgcaatgtgcgccacgagggcctgaagaactactacctgaaaaagacaatcagcagaagccctggcaag

SEQ ID NO: 177 - DNA, 1689 bp, Mus musculus
ggaaataagagagaaaagaagagtaagaagaaatataagagccaccatggaaacggacactctcctgctgtgggtactgttgctttgggtgccaggatctacgggcgaggcgaagctccaggaaagcgggccggtactggtcaaacccggcgctagcgtgaaaatgagttgcaaggccagcggttatactttcaccgactattacatgaattgggtaaagcagagccacgggaagtcattggaatggattggagtaatcaacccctacaacggggacaccagttataaccaaaagttcaagggaaaggcgacactcactgtggataaaagttcaagcacagcctacatggaacttaattccttgacatctgaggacagcgcagtatactattgtgctagatattacggtagttggttcgcctactgggggcaaggaacgctaatcactgtatcaaccgccaaaaccacaccgccttccgtgtaccctctagcgcccggttgtggtgacactacaggatcgtctgtgactttgggctgccttgtgaaaggatatttccctgaatctgttactgtgacctggaactctggctcgctgagtagttcagtgcacacattccccgccctgcttcagagcggtttgtacaccatgtcttcttcagttaccgtcccctcatcaacgtggccttcacagactgtcacgtgttctgttgcccacccagcaagctccaccaccgtggataaaaaactggagccaagcgggccgatctcaaccatcaatccgtgtcctccatgcaaggagtgccacaagtgtcctgccccaaatctggagggaggcccgtccgtctttatttttccacccaatattaaagacgtcctgatgataagcttgaccccaaaagtaacttgcgttgtggtggatgtctcggaggatgaccccgatgttcagatcagctggttcgtgaacaacgtcgaggtacatactgcgcagacccaaactcaccgagaagattataacagtactattcgagtggtgtctacccttcccatccagcaccaggactggatgtccggaaaggaatttaaatgcaaggtgaataataaagatctaccctcaccaattgaacgaacgataagtaagatcaaaggactggtgagggccccacaggtgtatattctcccacctcctgccgagcagctgtcccgcaaagacgtctccttaacatgtttagtcgtgggattcaaccctggagatattagcgtcgagtggaccagtaacggtcacacggaagagaactacaaagacacggcgcccgtgctcgacagtgacggcagttacttcatctactccaaacttaatatgaagaccagtaaatgggagaagacagactccttttcttgcaatgtgcgccacgagggcctgaagaactactacctgaaaaagacaatcagcagaagccctggcaagtgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 178 - DNA, 928 bp, Mus musculus
tcaagcttttggaccctcgtacagaagctaatacgactcactatagggaaataagagagaaaagaagagtaagaagaaatataagagccaccatggaaacggacactctcctgctgtgggtactgttgctttgggtgccaggatctacgggcgatattgtgatgactcaaaccacactgagcctcccggtgagcctgggggatcaagcctccattagttgccgaagctcccaaagtatcgtgcactccaacggcaacacctatctggagtggtatttacagaagcccggacagagcccaaagctgctcatctacaaagtgtccaatcgcttctcgggcgtgccagacagattctcaggtagtgggtctgggacagattttaccctgaagatatctcgagtggaggcggaggatttaggagtctactattgtttccagggtagtcatgtgccttacactttcggtggggggacaaaattagaaatcaaaagggccgacgcagccccaacggtctctattttccctccatcttccgagcagctgacgagtggcggggcctcagtggtctgcttcctgaataatttctaccccaaggacataaacgtgaaatggaaaattgatggatcagaaaggcagaatggcgttctgaactcctggaccgaccaggatagcaaggactccacctactcgatgtccagtacactcactctgactaaggacgaatatgaaagacataattcatacacctgtgaggctacacataaaacatccacttccccaatcgtcaaatccttcaatcgaaatgagtgctgataataggctggagcctcggtggccatgcttcttgccccttgggcctccccccagcccctcctccccttcctgcacccgtacccccgtggtctttgaataaagtctgagtgggcggc

SEQ ID NO: 179 - protein, 239 aa, Mus musculus
METDTLLLWVLLLWVPGSTGDIVMTQTTLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 180 - DNA, 717 bp, Mus musculus
atggaaacggacactctcctgctgtgggtactgttgctttgggtgccaggatctacgggcgatattgtgatgactcaaaccacactgagcctcccggtgagcctgggggatcaagcctccattagttgccgaagctcccaaagtatcgtgcactccaacggcaacacctatctggagtggtatttacagaagcccggacagagcccaaagctgctcatctacaaagtgtccaatcgcttctcgggcgtgccagacagattctcaggtagtgggtctgggacagattttaccctgaagatatctcgagtggaggcggaggatttaggagtctactattgtttccagggtagtcatgtgccttacactttcggtggggggacaaaattagaaatcaaaagggccgacgcagccccaacggtctctattttccctccatcttccgagcagctgacgagtggcggggcctcagtggtctgcttcctgaataatttctaccccaaggacataaacgtgaaatggaaaattgatggatcagaaaggcagaatggcgttctgaactcctggaccgaccaggatagcaaggactccacctactcgatgtccagtacactcactctgactaaggacgaatatgaaagacataattcatacacctgtgaggctacacataaaacatccacttccccaatcgtcaaatccttcaatcgaaatgagtgc

SEQ ID NO: 181 - DNA, 987 bp, Mus musculus
ggaaataagagagaaaagaagagtaagaagaaatataagagccaccatggaaacggacactctcctgctgtgggtactgttgctttgggtgccaggatctacgggcgatattgtgatgactcaaaccacactgagcctcccggtgagcctgggggatcaagcctccattagttgccgaagctcccaaagtatcgtgcactccaacggcaacacctatctggagtggtatttacagaagcccggacagagcccaaagctgctcatctacaaagtgtccaatcgcttctcgggcgtgccagacagattctcaggtagtgggtctgggacagattttaccctgaagatatctcgagtggaggcggaggatttaggagtctactattgtttccagggtagtcatgtgccttacactttcggtggggggacaaaattagaaatcaaaagggccgacgcagccccaacggtctctattttccctccatcttccgagcagctgacgagtggcggggcctcagtggtctgcttcctgaataatttctaccccaaggacataaacgtgaaatggaaaattgatggatcagaaaggcagaatggcgttctgaactcctggaccgaccaggatagcaaggactccacctactcgatgtccagtacactcactctgactaaggacgaatatgaaagacataattcatacacctgtgaggctacacataaaacatccacttccccaatcgtcaaatccttcaatcgaaatgagtgctgataataggctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 182 - DNA, 355 bp, Homo sapiens
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 183 - protein, 118 aa, Homo sapiens
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 184 - DNA, 325 bp, Homo sapiens
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 185 - protein, 108 aa, Homo sapiens
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 186 - protein, 5 aa, Homo sapiens
SYTMH

SEQ ID NO: 187 - protein, 17 aa, Homo sapiens
FISYDGNNKYYADSVKG

SEQ ID NO: 188 - protein, 9 aa, Homo sapiens
TGWLGPFDY

SEQ ID NO: 189 - protein, 12 aa, Homo sapiens
RASQSVGSSYLA

SEQ ID NO: 190 - protein, 7 aa, Homo sapiens
GAFSRAT

SEQ ID NO: 191 - protein, 9 aa, Homo sapiens
QQYGSSPWT

SEQ ID NO: 192 - RNA, 85 nt, Homo sapiens
ccuuagcagagcuguggagugugacaaugguguuugugucuaaacuaucaaacgccauuaucacacuaaauagcuacugcuaggc

SEQ ID NO: 193 - RNA, 22 nt, Homo sapiens
aacgccauuaucacacuaaaua

SEQ ID NO: 194 - RNA, 22 nt, Homo sapiens
uauuuagugugauaauggcguu

SEQ ID NO: 195 - RNA, 22 nt, Homo sapiens
uggagugugacaaugguguuug

SEQ ID NO: 196 - RNA, 22 nt, Homo sapiens
caaacaccauugucacacucca

SEQ ID NO: 197 - RNA, 47 nt, Homo sapiens
gggaaauaagagagaaaagaagaguaagaagaaauauaagagccacc

SEQ ID NO: 198 - RNA, 47 nt, Homo sapiens
gggagaucagagagaaaagaagaguaagaagaaauauaagagccacc

SEQ ID NO: 199 - RNA, 145 nt, Homo sapiens
ggaauaaaagucucaacacaacauauacaaaacaaacgaaucucaagcaaucaagcauucuacuucuauugcagcaauuuaaaucauuucuuuuaaagcaaaagcaauuuucugaaaauuuucaccauuuacgaacgauagcaac

SEQ ID NO: 200 - RNA, 42 nt, Homo sapiens
gggagacaagcuuggcauuccgguacuguugguaaagccacc

SEQ ID NO: 201 - RNA, 47 nt, Homo sapiens; identical to SEQ ID NO: 198

SEQ ID NO: 202 - RNA, 145 nt, Homo sapiens; identical to SEQ ID NO: 199

SEQ ID NO: 203 - RNA, 42 nt, Homo sapiens; identical to SEQ ID NO: 200

SEQ ID NO: 204 - RNA, 47 nt, Homo sapiens
gggaauuaacagagaaaagaagaguaagaagaaauauaagagccacc

SEQ ID NO: 205 - RNA, 47 nt, Homo sapiens
gggaaauuagacagaaaagaagaguaagaagaaauauaagagccacc

SEQ ID NO: 206 - RNA, 47 nt, Homo sapiens
gggaaauaagagaguaaagaacaguaagaagaaauauaagagccacc

SEQ ID NO: 207 - RNA, 47 nt, Homo sapiens
gggaaaaaagagagaaaagaagacuaagaagaaauauaagagccacc

SEQ ID NO: 208 - RNA, 47 nt, Homo sapiens
gggaaauaagagagaaaagaagaguaagaagauauauaagagccacc

SEQ ID NO: 209 - RNA, 47 nt, Homo sapiens
gggaaauaagagacaaaacaagaguaagaagaaauauaagagccacc

SEQ ID NO: 210 - RNA, 47 nt, Homo sapiens
gggaaauuagagaguaaagaacaguaaguagaauuaaaagagccacc

SEQ ID NO: 211 - RNA, 47 nt, Homo sapiens
gggaaauaagagagaauagaagaguaagaagaaauauaagagccacc

SEQ ID NO: 212 - RNA, 47 nt, Homo sapiens
gggaaauaagagagaaaagaagaguaagaagaaaauuaagagccacc

SEQ ID NO: 213 - RNA, 47 nt, Homo sapiens
gggaaauaagagagaaaagaagaguaagaagaaauuuaagagccacc

SEQ ID NO: 214 - RNA, 47 nt, Homo sapiens; identical to SEQ ID NO: 197

SEQ ID NO: 215 - RNA, 371 nt, Homo sapiens
gcgccugcccaccugccaccgacugcuggaacccagccagugggagggccuggcccaccagaguccugcucccucacuccucgccccgcccccugucccagagucccaccugggggcucucuccacccuucucagaguuccaguuucaaccagaguuccaaccaaugggcuccauccucuggauucuggccaaugaaauaucucccuggcaggguccucuucuuuucccagagcuccaccccaaccaggagcucuaguuaauggagagcucccagcacacucggagcuugugcuuugucuccacgcaaagcgauaaauaaaagcauugguggccuuuggucuuugaauaaagccugaguaggaagucuaga

SEQ ID NO: 216 - RNA, 568 nt, Homo sapiens
gccccugccgcucccacccccacccaucugggccccggguucaagagagagcggggucugaucucguguagccauauagaguuugcuucugagugucugcuuuguuuaguagaggugggcaggaggagcugaggggcuggggcugggguguugaaguuggcuuugcaugcccagcgaugcgccucccugugggaugucaucacccugggaaccgggaguggcccuuggcucacuguguucugcaugguuuggaucugaauuaauuguccuuucuucuaaaucccaaccgaacuucuuccaaccuccaaacuggcuguaaccccaaauccaagccauuaacuacaccugacaguagcaauugucugauuaaucacuggccccuugaagacagcagaaugucccuuugcaaugaggaggagaucugggcugggcgggccagcuggggaagcauuugacuaucuggaacuugugugugccuccucagguauggcagugacucaccugguuuuaauaaaacaaccugcaacaucucauggucuuugaauaaagccugaguaggaagucuaga

SEQ ID NO: 217 - RNA, 289 nt, Homo sapiens
acacacuccaccuccagcacgcgacuucucaggacgacgaaucuucucaaugggggggcggcugagcuccagccaccccgcagucacuuucuuuguaacaacuuccguugcugccaucguaaacugacacaguguuuauaacguguacauacauuaacuuauuaccucauuuuguuauuuuucgaaacaaagcccuguggaagaaaauggaaaacuugaagaagcauuaaagucauucuguuaagcugcguaaauggucuuugaauaaagccugaguaggaagucuaga

SEQ ID NO: 218 - RNA, 379 nt, Homo sapiens
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucuaauagagugguacagcacuguuauuuuucaaagauguguugcuauccugaaaauucuguagguucuguggaaguuccaguguucucucuuauuccacuucgguagaggauuucuaguuucuugugggcuaauuaaauaaaucauuaauacucuucuaauggucuuugaauaaagccugaguaggaagucuaga

SEQ ID NO: 219 - RNA, 118 nt, Homo sapiens
gcugccuucugcggggcuugccuucuggccaugcccuucuucucucccuugcaccuguaccucuuggucuuugaauaaagccugaguaggaaggcggccgcucgagcaugcaucuaga

SEQ ID NO: 220 - RNA, 908 nt, Homo sapiens
gccaagcccuccccaucccauguauuuaucucuauuuaauauuuaugucuauuuaagccucauauuuaaagacagggaagagcagaacggagccccaggccucuguguccuucccugcauuucugaguuucauucuccugccuguagcagugagaaaaagcuccuguccucccauccccuggacugggagguagauagguaaauaccaaguauuuauuacuaugacugcuccccagcccuggcucugcaaugggcacugggaugagccgcugugagccccugguccugaggguccccaccugggacccuugagaguaucaggucucccacgugggagacaagaaaucccuguuuaauauuuaaacagcaguguuccccaucuggguccuugcaccccucacucuggccucagccgacugcacagcggccccugcauccccuuggcugugaggccccuggacaagcagagguggccagagcugggaggcauggcccuggggucccacgaauuugcuggggaaucucguuuuucuucuuaagacuuuugggacaugguuugacucccgaacaucaccgacgcgucuccuguuuuucuggguggccucgggacaccugcccugcccccacgagggucaggacugugacucuuuuuagggccaggcaggugccuggacauuugccuugcuggacggggacuggggaugugggagggagcagacaggaggaaucaugucaggccugugugugaaaggaagcuccacugucacccuccaccucuucaccccccacucaccaguguccccuccacugucacauuguaacugaacuucaggauaauaaaguguuugccuccauggucuuugaauaaagccugaguaggaaggcggccgcucgagcaugcaucuaga

SEQ ID NO: 221 - RNA, 835 nt, Homo sapiens
acucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauau

SEQ ID NO: 222 - RNA, 297 nt, Homo sapiens
cgccgccgcccgggccccgcagucgagggucgugagcccaccccguccauggugcuaagcgggcccgggucccacacggccagcaccgcugcucacucggacgacgcccugggccugcaccucuccagcuccucccacgggguccccguagccccggcccccgcccagccccaggucuccccaggcccuccgcaggcugcccggccucccucccccugcagccaucccaaggcuccugaccuaccuggccccugagcucuggagcaagcccugacccaauaaaggcuuugaacccau

SEQ ID NO: 223 - RNA, 602 nt, Homo sapiens
ggggcuagagcccucuccgcacagcguggagacggggcaaggagggggguuauuaggauuggugguuuuguuuugcuuuguuuaaagccgugggaaaauggcacaacuuuaccucugugggagaugcaacacugagagccaaggggugggaguugggauaauuuuuauauaaaagaaguuuuuccacuuugaauugcuaaaaguggcauuuuuccuaugugcagucacuccucucauuucuaaaauagggacguggccaggcacgguggcucaugccuguaaucccagcacuuugggaggccgaggcaggcggcucacgaggucaggagaucgagacuauccuggcuaacacgguaaaacccugucucuacuaaaaguacaaaaaauuagcugggcgugguggugggcaccuguagucccagcuacucgggaggcugaggcaggagaaaggcaugaauccaagaggcagagcuugcagugagcugagaucacgccauugcacuccagccugggcaacaguguuaagacucugucucaaauauaaauaaauaaauaaauaaauaaauaaauaaauaaaaauaaagcgagauguugcccucaaa

SEQ ID NO: 224 - RNA, 785 nt, Homo sapiens
ggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauugu

SEQ ID NO: 225 - RNA, 3001 nt, Homo sapiens
auauuaaggaucaagcuguuagcuaauaaugccaccucugcaguuuugggaacaggcaaauaaaguaucaguauacauggugauguacaucuguagcaaagcucuuggagaaaaugaagacugaagaaagcaaagcaaaaacuguauagagagauuuuucaaaagcaguaaucccucaauuuuaaaaaaggauugaaaauucuaaaugucuuucugugcauauuuuuuguguuaggaaucaaaaguauuuuauaaaaggagaaagaacagccucauuuuagauguaguccuguuggauuuuuuaugccuccucaguaaccagaaauguuuuaaaaaacuaaguguuuaggauuucaagacaacauuauacauggcucugaaauaucugacacaauguaaacauugcaggcaccugcauuuuauguuuuuuuuuucaacaaaugugacuaauuugaaacuuuuaugaacuucugagcuguccccuugcaauucaaccgcaguuugaauuaaucauaucaaaucaguuuuaauuuuuuaaauuguacuucagagucuauauuucaagggcacauuuucucacuacuauuuuaauacauuaaaggacuaaauaaucuuucagagaugcuggaaacaaaucauuugcuuuauauguuucauuagaauaccaaugaaacauacaacuugaaaauuaguaauaguauuuuugaagaucccauuucuaauuggagaucucuuuaauuucgaucaacuuauaauguguaguacuauauuaagugcacuugaguggaauucaacauuugacuaauaaaaugaguucaucauguuggcaagugauguggcaauuaucucuggugacaaaagaguaaaaucaaauauuucugccuguuacaaauaucaaggaagaccugcuacuaugaaauagaugacauuaaucugucuucacuguuuauaauacggauggauuuuuuuucaaaucaguguguguuuugaggucuuauguaauugaugacauuugagagaaaugguggcuuuuuuuagcuaccucuuuguucauuuaagcaccaguaaagaucaugucuuuuuauagaaguguagauuuucuuugugacuuugcuaucgugccuaaagcucuaaauauaggugaaugugugaugaauacucagauuauuugucucucuauauaauuaguuugguacuaaguuucucaaaaaauuauuaacacaugaaagacaaucucuaaaccagaaaaagaaguaguacaaauuuuguuacuguaaugcucgcguuuagugaguuuaaaacacacaguaucuuuugguuuuauaaucaguuucuauuuugcugugccugagauuaagaucuguguaugugugugugugugugugugcguuuguguguuaaagcagaaaagacuuuuuuaaaaguuuuaagugauaaaugcaauuuguuaauugaucuuagaucacuaguaaacucagggcugaauuauaccauguauauucuauuagaagaaaguaaacaccaucuuuauuccugcccuuuuucuucucucaaaguaguuguaguuauaucuagaaagaagcaauuuugauuucuugaaaagguaguuccugcacucaguuuaaacuaaaaauaaucauacuuggauuuuauuuauuuuugucauaguaaaaauuuuaauuuauauauauuuuuauuuaguauuaucuuauucuuugcuauuugccaauccuuugucaucaauuguguuaaaugaauugaaaauucaugcccuguucauuuuauuuuacuuuauugguuaggauauuuaaaggauuuuuguauauauaauuucuuaaauuaauauuccaaaagguuaguggacuuagauuauaaauuauggcaaaaaucuaaaaacaacaaaaaugauuuuuauacauucuauuucauuauuccucuuuuuccaauaagucauacaauugguagauaugacuuauuuuauuuuuguauuauucacuauaucuuuaugauauuuaaguauaaauaauuaaaaaaauuuauuguaccuuauagucugucaccaaaaaaaaaaaauuaucuguagguagugaaaugcuaauguugauuugucuuuaagggcuuguuaacuauccuuuauuuucucauuugucuuaaauuaggaguuuguguuuaaauuacucaucuaagcaaaaaauguauauaaaucccauuacuggguauauacccaaaggauuauaaaucaugcugcuauaaagacacaugcacacguauguuuauugcagcacuauucacaauagcaaagacuuggaaccaacccaaauguccaucaaugauagacuugauuaagaaaaugugcacauauacaccauggaauacuaugcagccauaaaaaaggaugaguucauguccuuuguagggacauggauaaagcuggaaaccaucauucugagcaaacuauugcaaggacagaaaaccaaacacugcauguucucacucauaggugggaauugaacaaugagaacacuuggacacaagguggggaacaccacacaccagggccugucaugggguggggggaguggggagggauagcauuaggagauauaccuaauguaaaugaugaguuaaugggugcagcacaccaacauggcacauguauacauauguagcaaaccugcacguugugcacauguacccuagaacuuaaaguauaauuaaaaaaaaaaagaaaacagaagcuauuuauaaagaaguuauuugcugaaauaaaugugaucuuucccauuaaaaaaauaaagaaauuuugggguaaaaaaacacaauauauuguauucuugaaaaauucuaagagaguggaugugaaguguucucaccacaaaagugauaacuaauugagguaaugcacauauuaauuagaaagauuuugucauuccacaauguauauauacuuaaaaauauguuauacacaauaaauacauacauuaaaaaauaaguaaaugua

SEQ ID NO: 226 - RNA, 1037 nt, Homo sapiens
cccacccugcacgccggcaccaaacccuguccucccaccccuccccacucaucacuaaacagaguaaaaugugaugcgaauuuucccgaccaaccugauucgcuagauuuuuuuuaaggaaaagcuuggaaagccaggacacaacgcugcugccugcuuugugcaggguccuccggggcucagcccugaguuggcaucaccugcgcagggcccucuggggcucagcccugagcuagugucaccugcacagggcccucugaggcucagcccugagcuggcgucaccugugcagggcccucuggggcucagcccugagcuggccucaccuggguuccccaccccgggcucuccugcccugcccuccugcccgcccucccuccugccugcgcagcuccuucccuaggcaccucugugcugcaucccaccagccugagcaagacgcccucucggggccugugccgcacuagccucccucuccucuguccccauagcugguuuuucccaccaauccucaccuaacaguuacuuuacaauuaaacucaaagcaagcucuucuccucagcuuggggcagccauuggccucugucucguuuugggaaaccaaggucaggaggccguugcagacauaaaucucggcgacucggccccgucuccugaggguccugcuggugaccggccuggaccuuggcccuacagcccuggaggccgcugcugaccagcacugaccccgaccucagagaguacucgcaggggcgcuggcugcacucaagacccucgagauuaacggugcuaaccccgucugcuccucccucccgcagagacuggggccuggacuggacaugagagccccuuggugccacagagggcugugucuuacuagaaacaacgcaaaccucuccuuccucagaauagugauguguucgacguuuuaucaaaggcccccuuucuauguucauguuaguuuugcuccuucuguguuuuuuucugaaccauauccauguugcugacuuuuccaaauaaagguuuucacuccucuc

SEQ ID NO: 227 - RNA, 577 nt, Homo sapiens
agaggccugccuccagggcuggacugaggccugagcgcuccugccgcagagcuggccgcgccaaauaaugucucugugagacucgagaacuuucauuuuuuuccaggcugguucggauuugggguggauuuugguuuuguuccccuccuccacucucccccacccccuccccgcccuuuuuuuuuuuuuuuuuuaaacugguauuuuaucuuugauucuccuucagcccucaccccugguucucaucuuucuugaucaacaucuuuucuugccucuguccccuucucucaucucuuagcuccccuccaaccuggggggcagugguguggagaagccacaggccugagauuucaucugcucuccuuccuggagcccagaggagggcagcagaaggggguggugucuccaaccccccagcacugaggaagaacggggcucuucucauuucaccccucccuuucuccccugcccccaggacugggccacuucuggguggggcagugggucccagauuggcucacacugagaauguaagaacuacaaacaaaauuucuauuaaauuaaauuuugugucucc

SEQ ID NO: 228 - RNA, 2212 nt, Homo sapiens
cucccuccaucccaaccuggcucccucccacccaaccaacuuuccccccaacccggaaacagacaagcaacccaaacugaacccccucaaaagccaaaaaaugggagacaauuucacauggacuuuggaaaauauuuuuuuccuuugcauucaucucucaaacuuaguuuuuaucuuugaccaaccgaacaugaccaaaaaccaaaagugcauucaaccuuaccaaaaaaaaaaaaaaaaaaagaauaaauaaauaacuuuuuaaaaaaggaagcuugguccacuugcuugaagacccaugcggggguaagucccuuucugcccguugggcuuaugaaaccccaaugcugcccuuucugcuccuuucuccacaccccccuuggggccuccccuccacuccuucccaaaucugucuccccagaagacacaggaaacaauguauugucugcccagcaaucaaaggcaaugcucaaacacccaaguggcccccacccucagcccgcuccugcccgcccagcacccccaggcccugggggaccugggguucucagacugccaaagaagccuugccaucuggcgcucccauggcucuugcaacaucuccccuucguuuuugagggggucaugccgggggagccaccagccccucacuggguucggaggagagucaggaagggccacgacaaagcagaaacaucggauuuggggaacgcgugucaaucccuugugccgcagggcugggcgggagagacuguucuguuccuuguguaacuguguugcugaaagacuaccucguucuugucuugaugugucaccggggcaacugccugggggcggggaugggggcaggguggaagcggcuccccauuuuauaccaaaggugcuacaucuaugugaugggugggguggggagggaaucacuggugcuauagaaauugagaugcccccccaggccagcaaauguuccuuuuuguucaaagucuauuuuuauuccuugauauuuuucuuuuuuuuuuuuuuuuuuuguggauggggacuugugaauuuuucuaaaggugcuauuuaacaugggaggagagcgugugcggcuccagcccagcccgcugcucacuuuccacccucucuccaccugccucuggcuucucaggccucugcucuccgaccucucuccucugaaacccuccuccacagcugcagcccauccucccggcucccuccuagucuguccugcguccucuguccccggguuucagagacaacuucccaaagcacaaagcaguuuuucccccuaggggugggaggaagcaaaagacucuguaccuauuuuguauguguauaauaauuugagauguuuuuaauuauuuugauugcuggaauaaagcauguggaaaugacccaaacauaauccgcaguggccuccuaauuuccuucuuuggaguugggggagggguagacauggggaaggggcuuuggggugaugggcuugccuuccauuccugcccuuucccuccccacuauucucuucuagaucccuccauaaccccacuccccuuucucucacccuucuuauaccgcaaaccuuucuacuuccucuuucauuuucuauucuugcaauuuccuugcaccuuuuccaaauccucuucuccccugcaauaccauacaggcaauccacgugcacaacacacacacacacucuucacaucugggguuguccaaaccucauacccacuccccuucaagcccauccacucuccacccccuggaugcccugcacuugguggcggugggaugcucauggauacugggagggugaggggaguggaacccgugaggaggaccugggggccucuccuugaacugacaugaagggucaucuggccucugcucccuucucacccacgcugaccuccugccgaaggagcaacgcaacaggagaggggucugcugagccuggcgagggucugggagggaccaggaggaaggcgugcucccugcucgcuguccuggcccugggggagugagggagacagacaccugggagagcuguggggaaggcacucgcaccgugcucuugggaaggaaggagaccuggcccugcucaccacggacugggugccucgaccuccugaauccccagaacacaaccccccugggcugggguggucuggggaaccaucgugcccccgccucccgccuacuccuuuuuaagcuu

SEQ ID NO: 229 - RNA, 729 nt, Homo sapiens
uuggccaggccugacccucuuggaccuuucuucuuugccgacaaccacugcccagcagccucugggaccucggggucccagggaacccaguccagccuccuggcuguugacuucccauugcucuuggagccaccaaucaaagagauucaaagagauuccugcaggccagaggcggaacacaccuuuauggcuggggcucuccgugguguucuggacccagccccuggagacaccauucacuuuuacugcuuuguagugacucgugcucuccaaccugucuuccugaaaaaccaaggcccccuucccccaccucuuccauggggugagacuugagcagaacaggggcuuccccaaguugcccagaaagacugucugggugagaagccauggccagagcuucucccaggcacagguguugcaccagggacuucugcuucaaguuuugggguaaagacaccuggaucagacuccaagggcugcccugagucugggacuucugccuccauggcuggucaugagagcaaaccguaguccccuggagacagcgacuccagagaaccucuugggagacagaagaggcaucugugcacagcucgaucuucuacuugccuguggggaggggagugacagguccacacaccacacugggucacccuguccuggaugccucugaagagagggacagaccgucagaaacuggagaguuucuauuaaaggucauuuaaacca

SEQ ID NO: 230 - RNA, 847 nt, Homo sapiens
uccuccgggaccccagcccucaggauuccugaugcuccaaggcgacugaugggcgcuggaugaaguggcacagucagcuucccugggggcuggugucauguugggcuccuggggcgggggcacggccuggcauuucacgcauugcugccaccccagguccaccugucuccacuuucacagccuccaagucuguggcucuucccuucuguccuccgaggggcuugccuucucucguguccagugaggugcucagugaucggcuuaacuuagagaagcccgcccccuccccuucuccgucugucccaagagggucugcucugagccugcguuccuagguggcucggccucagcugccuggguuguggccgcccuagcauccuguaugcccacagcuacuggaauccccgcugcugcuccgggccaagcuucugguugauuaaugagggcaugggguggucccucaagaccuuccccuaccuuuuguggaaccagugaugccucaaagacaguguccccuccacagcugggugccaggggcaggggauccucaguauagccggugaacccugauaccaggagccugggccucccugaaccccuggcuuccagccaucucaucgccagccuccuccuggaccucuuggcccccagccccuuccccacacagccccagaagggucccagagcugaccccacuccaggaccuaggcccagccccucagccucaucuggagccccugaagaccagucccacccaccuuucuggccucaucugacacugcuccgcauccugcuguguguccuguuccauguuccgguuccauccaaauacacuuucuggaacaaa

SEQ ID NO: 231 - RNA, 110 nt, Homo sapiens
gcuggagccucgguggccaugcuucuugccccuugggccuccccccagccccuccuccccuuccugcacccguacccccguggucuuugaauaaagucugagugggcggc

SEQ ID NO: 232 - RNA, 116 nt, Homo sapiens
uaauaggcuggagccucgguggccaugcuucuugccccuugggccuccccccagccccuccuccccuuccugcacccguacccccguggucuuugaauaaagucugagugggcggc

SEQ ID NO: 233 - DNA, 18 bp, Homo sapiens
attgggcacccgtaaggg

SEQ ID NO: 234 - protein, 20 aa, Homo sapiens
METPAQLLFLLLLWLPDTTG

SEQ ID NO: 235 - protein, 471 aa, Homo sapiens
METPAQLLFLLLLWLPDTTGQVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 236 - protein, 234 aa, Homo sapiens
METPAQLLFLLLLWLPDTTGDIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 237 - DNA, 325 bp, Homo sapiens
gaaattgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 238 - protein, 108 aa, Homo sapiens
EIVLTQSPGTLSLSPGERATLSCRASQSVSSSFLAWYQQKPGQAPRLLIYGASSRATGIPDRFSGSGSGTDFTLTISRLEPEDFAVYYCQQYGSSPWTFGQGTKVEIK

SEQ ID NO: 239 - DNA, 355 bp, Homo sapiens
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaagcaataaacactacgcagactccgtgaagggccgattcaccgtctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 240 - protein, 118 aa, Homo sapiens
QVQLVESGGGVVQPGRSLRLSCAASGFTFSSYTMHWVRQAPGKGLEWVTFISYDGSNKHYADSVKGRFTVSRDNSKNTLYLQMNSLRAEDTAIYYCARTGWLGPFDYWGQGTLVTVSS

SEQ ID NO: 241 - DNA, 322 bp, Homo sapiens
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctccgacgttcggccaagggaccaaggtggaaatcaaac

SEQ ID NO: 242 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIK

SEQ ID NO: 243 - DNA, 358 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgttttactgtgcgagagctcccaattatattggtgcttttgatgtctggggccaagggacaatggtcaccgtctcttcag

SEQ ID NO: 244 - protein, 119 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVFYCARAPNYIGAFDVWGQGTMVTVSS

SEQ ID NO: 245 - protein, 12 aa, Homo sapiens
RASQSVSSSFLA

SEQ ID NO: 246 - protein, 7 aa, Homo sapiens
GASSRAT

SEQ ID NO: 247 - protein, 9 aa, Homo sapiens
QQYGSSPWT

SEQ ID NO: 248 - protein, 5 aa, Homo sapiens
SYTMH

SEQ ID NO: 249 - protein, 17 aa, Homo sapiens
FISYDGSNKHYADSVKG

SEQ ID NO: 250 - protein, 9 aa, Homo sapiens
TGWLGPFDY

SEQ ID NO: 251 - DNA, 1637 bp, Homo sapiens
tcaagcttttggaccctcgtacagaagctaatacgactcactatagggaaataagagagaaaagaagagtaagaagaaatataagagccaccatggagacccccgcccagctgctgtttctgctgctgctgtggctgcccgacaccaccggccaggtgcagctggtggagagcggcggcggcgtggtgcagcccggcagaagcctgagactgagctgcgccgccagcggctttaccttcagcagctacaccatgcactgggtgcggcaggcccctggcaagggactggagtgggtgaccttcataagctacgacggcaataacaagtattacgccgacagcgtgaagggcagattcaccatcagcagagacaacagcaagaataccctgtacctgcagatgaatagcctgagagccgaggacaccgccatctactactgcgccagaacaggctggctgggcccattcgactactggggccagggcacactggtgacagtctccagcgctagcactaagggtcccagcgtgttccccctggccccgagcagcaaaagcaccagcggcggcaccgccgccctgggctgcctggtcaaggactacttccccgagcccgtgaccgtgtcttggaactccggggccctgaccagcggggtacacaccttccccgccgtgctgcagagcagcggcctgtattccctgagctccgtggtgaccgtccctagctccagcctgggcacccagacctacatctgcaacgtgaaccacaagccctccaacaccaaagtggacaagcgcgtggagcccaagagttgcgacaaaacccacacctgtcctccctgcccggctcctgagctgttgggcggacccagcgtcttcctgttccccccaaagcccaaggacaccctgatgatcagccggacccccgaggtgacttgcgtggtggtcgacgtgagccacgaggacccagaggtgaagttcaactggtacgtggacggcgtcgaggtgcacaacgccaagaccaagcctagagaggagcagtacaacagcacctacagggtggtgagcgtgctgaccgtgctgcatcaggactggctgaacggcaaagagtacaagtgcaaggtgtcaaataaggccctgcccgcacccattgagaagactatcagcaaggccaagggccagcccagagagccacaggtgtacaccctgccccccagcagagaggagatgaccaagaaccaggtgagcctcacctgcctggtcaagggcttttaccccagcgacatcgccgttgagtgggagagcaatggccagcccgagaacaactacaagaccacccccccggtgctggactccgacggcagctttttcctgtacagcaagctgaccgtggacaagagcagatggcagcagggcaacgtgttcagctgcagcgtgatgcacgaggccctgcacaaccactacacccagaagtctctgagcctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 252 - protein, 468 aa, Homo sapiens
METPAQLLFLLLLWLPDTTGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - DNA, 1404 bp, Homo sapiens
atggagacccccgcccagctgctgtttctgctgctgctgtggctgcccgacaccaccggccaggtgcagctggtggagagcggcggcggcgtggtgcagcccggcagaagcctgagactgagctgcgccgccagcggctttaccttcagcagctacaccatgcactgggtgcggcaggcccctggcaagggactggagtgggtgaccttcataagctacgacggcaataacaagtattacgccgacagcgtgaagggcagattcaccatcagcagagacaacagcaagaataccctgtacctgcagatgaatagcctgagagccgaggacaccgccatctactactgcgccagaacaggctggctgggcccattcgactactggggccagggcacactggtgacagtctccagcgctagcactaagggtcccagcgtgttccccctggccccgagcagcaaaagcaccagcggcggcaccgccgccctgggctgcctggtcaaggactacttccccgagcccgtgaccgtgtcttggaactccggggccctgaccagcggggtacacaccttccccgccgtgctgcagagcagcggcctgtattccctgagctccgtggtgaccgtccctagctccagcctgggcacccagacctacatctgcaacgtgaaccacaagccctccaacaccaaagtggacaagcgcgtggagcccaagagttgcgacaaaacccacacctgtcctccctgcccggctcctgagctgttgggcggacccagcgtcttcctgttccccccaaagcccaaggacaccctgatgatcagccggacccccgaggtgacttgcgtggtggtcgacgtgagccacgaggacccagaggtgaagttcaactggtacgtggacggcgtcgaggtgcacaacgccaagaccaagcctagagaggagcagtacaacagcacctacagggtggtgagcgtgctgaccgtgctgcatcaggactggctgaacggcaaagagtacaagtgcaaggtgtcaaataaggccctgcccgcacccattgagaagactatcagcaaggccaagggccagcccagagagccacaggtgtacaccctgccccccagcagagaggagatgaccaagaaccaggtgagcctcacctgcctggtcaagggcttttaccccagcgacatcgccgttgagtgggagagcaatggccagcccgagaacaactacaagaccacccccccggtgctggactccgacggcagctttttcctgtacagcaagctgaccgtggacaagagcagatggcagcagggcaacgtgttcagctgcagcgtgatgcacgaggccctgcacaaccactacacccagaagtctctgagcctgagccccggcaag

SEQ ID NO: 254 - DNA, 1696 bp, Homo sapiens
ggaaataagagagaaaagaagagtaagaagaaatataagagccaccatggagacccccgcccagctgctgtttctgctgctgctgtggctgcccgacaccaccggccaggtgcagctggtggagagcggcggcggcgtggtgcagcccggcagaagcctgagactgagctgcgccgccagcggctttaccttcagcagctacaccatgcactgggtgcggcaggcccctggcaagggactggagtgggtgaccttcataagctacgacggcaataacaagtattacgccgacagcgtgaagggcagattcaccatcagcagagacaacagcaagaataccctgtacctgcagatgaatagcctgagagccgaggacaccgccatctactactgcgccagaacaggctggctgggcccattcgactactggggccagggcacactggtgacagtctccagcgctagcactaagggtcccagcgtgttccccctggccccgagcagcaaaagcaccagcggcggcaccgccgccctgggctgcctggtcaaggactacttccccgagcccgtgaccgtgtcttggaactccggggccctgaccagcggggtacacaccttccccgccgtgctgcagagcagcggcctgtattccctgagctccgtggtgaccgtccctagctccagcctgggcacccagacctacatctgcaacgtgaaccacaagccctccaacaccaaagtggacaagcgcgtggagcccaagagttgcgacaaaacccacacctgtcctccctgcccggctcctgagctgttgggcggacccagcgtcttcctgttccccccaaagcccaaggacaccctgatgatcagccggacccccgaggtgacttgcgtggtggtcgacgtgagccacgaggacccagaggtgaagttcaactggtacgtggacggcgtcgaggtgcacaacgccaagaccaagcctagagaggagcagtacaacagcacctacagggtggtgagcgtgctgaccgtgctgcatcaggactggctgaacggcaaagagtacaagtgcaaggtgtcaaataaggccctgcccgcacccattgagaagactatcagcaaggccaagggccagcccagagagccacaggtgtacaccctgccccccagcagagaggagatgaccaagaaccaggtgagcctcacctgcctggtcaagggcttttaccccagcgacatcgccgttgagtgggagagcaatggccagcccgagaacaactacaagaccacccccccggtgctggactccgacggcagctttttcctgtacagcaagctgaccgtggacaagagcagatggcagcagggcaacgtgttcagctgcagcgtgatgcacgaggccctgcacaaccactacacccagaagtctctgagcctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 255 - protein, 448 aa, Homo sapiens
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - DNA, 1637 bp, Homo sapiens
tcaagcttttggaccctcgtacagaagctaatacgactcactatagggaaataagagagaaaagaagagtaagaagaaatataagagccaccatggagacccccgcacagctgctcttcctgctgctgctgtggctgcccgacaccaccggacaggtgcagctggtagagagcggcggcggcgtagtgcagcccggcagaagcctgaggctgtcctgcgccgccagtggctttaccttcagcagctacaccatgcactgggtgagacaggctccaggcaaaggcctggagtgggtgactttcatcagctatgacggaaacaacaagtactacgccgacagcgtgaagggcaggttcaccatctccagagacaactcgaaaaacaccctgtacctgcagatgaacagcctgagagccgaggataccgccatctactactgcgcccgcacaggctggctgggcccttttgactactggggccaaggcacactggttacagtgagcagcgcctcaaccaagggccccagtgtgttccccctggcaccctcgagcaagagcacctccggcggcaccgccgccctgggctgtctcgtgaaggactacttccccgagcccgtcaccgtgagctggaacagcggcgccctgacctcaggcgtgcacaccttccccgccgtgctccagtctagcggcctgtactccctgtcaagcgttgtgacagtgcccagcagcagcctgggcacccagacatacatctgcaatgtgaaccacaaaccctccaacaccaaggtggacaagagggtggagccaaagtcttgcgacaagacccacacctgccctccctgccccgcccccgagctgctgggcggccccagcgtgttcctgtttccccccaagcctaaggacacactgatgatcagcagaacccctgaggtgacctgtgtggtggtggacgtgagccacgaggaccccgaggtgaagtttaactggtacgtggacggcgtggaggtgcacaacgccaagaccaagcccagagaagagcagtacaacagcacctacagagtggtaagcgtgctgaccgtgctgcaccaggactggctgaacggcaaggagtacaagtgcaaggtgtccaataaggcccttcccgcccccatcgagaagaccatctccaaggccaagggccagcctagagagccccaagtgtacaccctgccccccagcagggaggagatgaccaagaatcaggtgagcctgacctgcctggtgaagggattttaccccagcgacatcgccgtggagtgggagagcaacggccagcccgagaacaactacaagaccaccccccccgtgctggacagcgacggctctttcttcctgtacagcaagctgaccgtggacaagtccaggtggcagcagggcaacgtgttcagctgcagcgtgatgcacgaggccctgcacaaccactacacccagaagagcttgtccctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 257 - protein, 468 aa, Homo sapiens; identical to SEQ ID NO: 252

SEQ ID NO: 258 - DNA, 1404 bp, Homo sapiens
atggagacccccgcacagctgctcttcctgctgctgctgtggctgcccgacaccaccggacaggtgcagctggtagagagcggcggcggcgtagtgcagcccggcagaagcctgaggctgtcctgcgccgccagtggctttaccttcagcagctacaccatgcactgggtgagacaggctccaggcaaaggcctggagtgggtgactttcatcagctatgacggaaacaacaagtactacgccgacagcgtgaagggcaggttcaccatctccagagacaactcgaaaaacaccctgtacctgcagatgaacagcctgagagccgaggataccgccatctactactgcgcccgcacaggctggctgggcccttttgactactggggccaaggcacactggttacagtgagcagcgcctcaaccaagggccccagtgtgttccccctggcaccctcgagcaagagcacctccggcggcaccgccgccctgggctgtctcgtgaaggactacttccccgagcccgtcaccgtgagctggaacagcggcgccctgacctcaggcgtgcacaccttccccgccgtgctccagtctagcggcctgtactccctgtcaagcgttgtgacagtgcccagcagcagcctgggcacccagacatacatctgcaatgtgaaccacaaaccctccaacaccaaggtggacaagagggtggagccaaagtcttgcgacaagacccacacctgccctccctgccccgcccccgagctgctgggcggccccagcgtgttcctgtttccccccaagcctaaggacacactgatgatcagcagaacccctgaggtgacctgtgtggtggtggacgtgagccacgaggaccccgaggtgaagtttaactggtacgtggacggcgtggaggtgcacaacgccaagaccaagcccagagaagagcagtacaacagcacctacagagtggtaagcgtgctgaccgtgctgcaccaggactggctgaacggcaaggagtacaagtgcaaggtgtccaataaggcccttcccgcccccatcgagaagaccatctccaaggccaagggccagcctagagagccccaagtgtacaccctgccccccagcagggaggagatgaccaagaatcaggtgagcctgacctgcctggtgaagggattttaccccagcgacatcgccgtggagtgggagagcaacggccagcccgagaacaactacaagaccaccccccccgtgctggacagcgacggctctttcttcctgtacagcaagctgaccgtggacaagtccaggtggcagcagggcaacgtgttcagctgcagcgtgatgcacgaggccctgcacaaccactacacccagaagagcttgtccctgagccccggcaag

SEQ ID NO: 259 - DNA, 1696 bp, Homo sapiens
ggaaataagagagaaaagaagagtaagaagaaatataagagccaccatggagacccccgcacagctgctcttcctgctgctgctgtggctgcccgacaccaccggacaggtgcagctggtagagagcggcggcggcgtagtgcagcccggcagaagcctgaggctgtcctgcgccgccagtggctttaccttcagcagctacaccatgcactgggtgagacaggctccaggcaaaggcctggagtgggtgactttcatcagctatgacggaaacaacaagtactacgccgacagcgtgaagggcaggttcaccatctccagagacaactcgaaaaacaccctgtacctgcagatgaacagcctgagagccgaggataccgccatctactactgcgcccgcacaggctggctgggcccttttgactactggggccaaggcacactggttacagtgagcagcgcctcaaccaagggccccagtgtgttccccctggcaccctcgagcaagagcacctccggcggcaccgccgccctgggctgtctcgtgaaggactacttccccgagcccgtcaccgtgagctggaacagcggcgccctgacctcaggcgtgcacaccttccccgccgtgctccagtctagcggcctgtactccctgtcaagcgttgtgacagtgcccagcagcagcctgggcacccagacatacatctgcaatgtgaaccacaaaccctccaacaccaaggtggacaagagggtggagccaaagtcttgcgacaagacccacacctgccctccctgccccgcccccgagctgctgggcggccccagcgtgttcctgtttccccccaagcctaaggacacactgatgatcagcagaacccctgaggtgacctgtgtggtggtggacgtgagccacgaggaccccgaggtgaagtttaactggtacgtggacggcgtggaggtgcacaacgccaagaccaagcccagagaagagcagtacaacagcacctacagagtggtaagcgtgctgaccgtgctgcaccaggactggctgaacggcaaggagtacaagtgcaaggtgtccaataaggcccttcccgcccccatcgagaagaccatctccaaggccaagggccagcctagagagccccaagtgtacaccctgccccccagcagggaggagatgaccaagaatcaggtgagcctgacctgcctggtgaagggattttaccccagcgacatcgccgtggagtgggagagcaacggccagcccgagaacaactacaagaccaccccccccgtgctggacagcgacggctctttcttcctgtacagcaagctgaccgtggacaagtccaggtggcagcagggcaacgtgttcagctgcagcgtgatgcacgaggccctgcacaaccactacacccagaagagcttgtccctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 260 - protein, 448 aa, Homo sapiens; identical to SEQ ID NO: 255

SEQ ID NO: 261 - DNA, 1637 bp, Homo sapiens
tcaagcttttggaccctcgtacagaagctaatacgactcactatagggaaataagagagaaaagaagagtaagaagaaatataagagccaccatggagacacccgcccagctgctcttcctgctgctgttgtggctgcccgacaccaccggacaggttcagctggtggaaagcggcggcggcgtggtgcagccaggcaggagcctgagactgtcctgcgccgcaagcggcttcaccttctccagctataccatgcactgggtgaggcaggcccccggcaaaggcctggagtgggtgacgttcatctcctacgacggtaacaataagtactacgccgacagcgtgaaaggcaggttcaccatcagcagagacaacagcaagaacactctgtacctgcagatgaactccctccgtgccgaggacaccgccatctactactgcgccaggaccggctggctgggccccttcgactactgggggcagggcaccctggtcaccgtgagtagcgccagcaccaagggacctagcgtgttccccctggcccccagcagcaagtccaccagcggcggcaccgccgccctggggtgcctggtgaaggactacttccccgaacccgtgaccgtgtcttggaacagcggggccctgacctccggcgtgcacaccttccccgccgtgctgcagagcagcggcctgtacagcctgagcagcgtggtgaccgtgcctagctctagcctcggcacccagacttacatctgcaacgtgaaccataagcccagcaacacaaaggtcgataagcgagtggagcccaagagctgcgacaagacccacacctgccccccctgccccgcccccgagctgctgggcggacccagcgtgttcctgttcccccctaaacccaaagacaccctgatgatcagcagaacccccgaggtgacctgtgtggtggtggacgtcagccacgaggaccccgaggtgaagttcaactggtacgtggacggcgttgaggtgcacaacgccaagaccaaacccagggaggagcagtacaatagcacctatagagtggtgagcgtgctgaccgtgctgcaccaggactggctgaatggcaaggagtacaagtgcaaggtgagcaacaaggccttacccgcccccatcgagaagaccatctccaaggccaagggccagcccagagagccccaggtgtacaccctgcctcccagcagagaggagatgactaagaaccaggtcagccttacctgcctggtgaagggcttttacccctcagacatcgccgtggaatgggagagcaacggccagcccgaaaataactacaagacaacccctcccgtgctggacagcgacgggagcttcttcttgtacagcaagctcaccgtggacaagagcagatggcagcagggcaacgtgttcagctgcagcgtgatgcatgaggccctgcacaaccactatacacagaagagcctgagcctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 262 - protein, 468 aa, Homo sapiens; identical to SEQ ID NO: 252

SEQ ID NO: 263 - DNA, 1404 bp, Homo sapiens
atggagacacccgcccagctgctcttcctgctgctgttgtggctgcccgacaccaccggacaggttcagctggtggaaagcggcggcggcgtggtgcagccaggcaggagcctgagactgtcctgcgccgcaagcggcttcaccttctccagctataccatgcactgggtgaggcaggcccccggcaaaggcctggagtgggtgacgttcatctcctacgacggtaacaataagtactacgccgacagcgtgaaaggcaggttcaccatcagcagagacaacagcaagaacactctgtacctgcagatgaactccctccgtgccgaggacaccgccatctactactgcgccaggaccggctggctgggccccttcgactactgggggcagggcaccctggtcaccgtgagtagcgccagcaccaagggacctagcgtgttccccctggcccccagcagcaagtccaccagcggcggcaccgccgccctggggtgcctggtgaaggactacttccccgaacccgtgaccgtgtcttggaacagcggggccctgacctccggcgtgcacaccttccccgccgtgctgcagagcagcggcctgtacagcctgagcagcgtggtgaccgtgcctagctctagcctcggcacccagacttacatctgcaacgtgaaccataagcccagcaacacaaaggtcgataagcgagtggagcccaagagctgcgacaagacccacacctgccccccctgccccgcccccgagctgctgggcggacccagcgtgttcctgttcccccctaaacccaaagacaccctgatgatcagcagaacccccgaggtgacctgtgtggtggtggacgtcagccacgaggaccccgaggtgaagttcaactggtacgtggacggcgttgaggtgcacaacgccaagaccaaacccagggaggagcagtacaatagcacctatagagtggtgagcgtgctgaccgtgctgcaccaggactggctgaatggcaaggagtacaagtgcaaggtgagcaacaaggccttacccgcccccatcgagaagaccatctccaaggccaagggccagcccagagagccccaggtgtacaccctgcctcccagcagagaggagatgactaagaaccaggtcagccttacctgcctggtgaagggcttttacccctcagacatcgccgtggaatgggagagcaacggccagcccgaaaataactacaagacaacccctcccgtgctggacagcgacgggagcttcttcttgtacagcaagctcaccgtggacaagagcagatggcagcagggcaacgtgttcagctgcagcgtgatgcatgaggccctgcacaaccactatacacagaagagcctgagcctgagccccggcaag

SEQ ID NO: 264 - DNA, 1696 bp, Homo sapiens
ggaaataagagagaaaagaagagtaagaagaaatataagagccaccatggagacacccgcccagctgctcttcctgctgctgttgtggctgcccgacaccaccggacaggttcagctggtggaaagcggcggcggcgtggtgcagccaggcaggagcctgagactgtcctgcgccgcaagcggcttcaccttctccagctataccatgcactgggtgaggcaggcccccggcaaaggcctggagtgggtgacgttcatctcctacgacggtaacaataagtactacgccgacagcgtgaaaggcaggttcaccatcagcagagacaacagcaagaacactctgtacctgcagatgaactccctccgtgccgaggacaccgccatctactactgcgccaggaccggctggctgggccccttcgactactgggggcagggcaccctggtcaccgtgagtagcgccagcaccaagggacctagcgtgttccccctggcccccagcagcaagtccaccagcggcggcaccgccgccctggggtgcctggtgaaggactacttccccgaacccgtgaccgtgtcttggaacagcggggccctgacctccggcgtgcacaccttccccgccgtgctgcagagcagcggcctgtacagcctgagcagcgtggtgaccgtgcctagctctagcctcggcacccagacttacatctgcaacgtgaaccataagcccagcaacacaaaggtcgataagcgagtggagcccaagagctgcgacaagacccacacctgccccccctgccccgcccccgagctgctgggcggacccagcgtgttcctgttcccccctaaacccaaagacaccctgatgatcagcagaacccccgaggtgacctgtgtggtggtggacgtcagccacgaggaccccgaggtgaagttcaactggtacgtggacggcgttgaggtgcacaacgccaagaccaaacccagggaggagcagtacaatagcacctatagagtggtgagcgtgctgaccgtgctgcaccaggactggctgaatggcaaggagtacaagtgcaaggtgagcaacaaggccttacccgcccccatcgagaagaccatctccaaggccaagggccagcccagagagccccaggtgtacaccctgcctcccagcagagaggagatgactaagaaccaggtcagccttacctgcctggtgaagggcttttacccctcagacatcgccgtggaatgggagagcaacggccagcccgaaaataactacaagacaacccctcccgtgctggacagcgacgggagcttcttcttgtacagcaagctcaccgtggacaagagcagatggcagcagggcaacgtgttcagctgcagcgtgatgcatgaggccctgcacaaccactatacacagaagagcctgagcctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 265 - protein, 448 aa, Homo sapiens; identical to SEQ ID NO: 255

SEQ ID NO: 266 - DNA, 938 bp, Homo sapiens
tcaagcttttggaccctcgtacagaagctaatacgactcactatagggaaataagagagaaaagaagagtaagaagaaatataagagccaccatggagacccccgcccagctgctgttcctgctgctgctgtggctgcccgacaccactggcgagatcgtgctgacccagtctcccggcacactgtctctgtctcccggcgagcgcgcaactctgagctgcagggcgagccagagcgtgggcagcagctacctggcctggtaccagcagaagccaggccaggcccctaggctgctgatctacggcgccttctcccgggcgaccgggatccccgacagattcagcggcagcggctccggcaccgacttcaccctgacaatcagcagactggagcccgaggacttcgccgtgtactactgccagcagtacggcagcagcccctggacatttggccagggcactaaggtggagatcaagagaaccgtggccgcccccagcgtgttcatcttcccccccagcgatgagcagctgaagagcggcaccgcctccgtggtctgcctgctgaacaacttctaccccagagaggccaaggttcagtggaaggtggacaacgccctgcagagcggcaacagccaggagtctgtgactgaacaggacagcaaggacagcacatacagcctgagcagcaccctcaccctgtccaaggccgattacgagaagcacaaggtgtacgcctgcgaggtgacccaccaaggcctgagcagccccgtgaccaagagcttcaacagaggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 267 - protein, 235 aa, Homo sapiens
METPAQLLFLLLLWLPDTTGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - DNA, 705 bp, Homo sapiens
atggagacccccgcccagctgctgttcctgctgctgctgtggctgcccgacaccactggcgagatcgtgctgacccagtctcccggcacactgtctctgtctcccggcgagcgcgcaactctgagctgcagggcgagccagagcgtgggcagcagctacctggcctggtaccagcagaagccaggccaggcccctaggctgctgatctacggcgccttctcccgggcgaccgggatccccgacagattcagcggcagcggctccggcaccgacttcaccctgacaatcagcagactggagcccgaggacttcgccgtgtactactgccagcagtacggcagcagcccctggacatttggccagggcactaaggtggagatcaagagaaccgtggccgcccccagcgtgttcatcttcccccccagcgatgagcagctgaagagcggcaccgcctccgtggtctgcctgctgaacaacttctaccccagagaggccaaggttcagtggaaggtggacaacgccctgcagagcggcaacagccaggagtctgtgactgaacaggacagcaaggacagcacatacagcctgagcagcaccctcaccctgtccaaggccgattacgagaagcacaaggtgtacgcctgcgaggtgacccaccaaggcctgagcagccccgtgaccaagagcttcaacagaggcgagtgc

SEQ ID NO: 269 - DNA, 997 bp, Homo sapiens
ggaaataagagagaaaagaagagtaagaagaaatataagagccaccatggagacccccgcccagctgctgttcctgctgctgctgtggctgcccgacaccactggcgagatcgtgctgacccagtctcccggcacactgtctctgtctcccggcgagcgcgcaactctgagctgcagggcgagccagagcgtgggcagcagctacctggcctggtaccagcagaagccaggccaggcccctaggctgctgatctacggcgccttctcccgggcgaccgggatccccgacagattcagcggcagcggctccggcaccgacttcaccctgacaatcagcagactggagcccgaggacttcgccgtgtactactgccagcagtacggcagcagcccctggacatttggccagggcactaaggtggagatcaagagaaccgtggccgcccccagcgtgttcatcttcccccccagcgatgagcagctgaagagcggcaccgcctccgtggtctgcctgctgaacaacttctaccccagagaggccaaggttcagtggaaggtggacaacgccctgcagagcggcaacagccaggagtctgtgactgaacaggacagcaaggacagcacatacagcctgagcagcaccctcaccctgtccaaggccgattacgagaagcacaaggtgtacgcctgcgaggtgacccaccaaggcctgagcagccccgtgaccaagagcttcaacagaggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 270 - protein, 215 aa, Homo sapiens
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - DNA, 938 bp, Homo sapiens
tcaagcttttggaccctcgtacagaagctaatacgactcactatagggaaataagagagaaaagaagagtaagaagaaatataagagccaccatggagacccccgcccagctgctcttcctgctgctgctgtggctgcctgacaccaccggcgagatcgtgctgacccaaagccccggtaccctgtccctgagccccggggagagagccaccctgagctgccgggccagccagagcgtgggctctagctatctggcctggtaccagcagaaacctggccaggcccccagactgctgatctatggcgcctttagcagagccaccggcattcccgacagattcagcggaagcggcagcggcaccgacttcaccctgacgatcagcagactggaacccgaggatttcgccgtgtactactgccagcagtacggcagcagcccctggaccttcgggcagggcaccaaggtggagattaagagaaccgtggccgcccccagcgtgttcatctttcccccctctgacgagcagctgaagagcggcaccgccagcgtggtgtgcctcctgaacaacttctacccccgggaggctaaggtgcagtggaaggtggacaacgccctgcagagcggcaactcacaggagagcgtgacagagcaggactcaaaggacagcacctacagcctgtccagcaccctgaccctgtcaaaggccgactacgagaagcacaaggtgtacgcctgcgaggtcacccaccagggactgagctcacccgttaccaagagcttcaaccgcggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 272 - protein, 235 aa, Homo sapiens; identical to SEQ ID NO: 267

SEQ ID NO: 273 - DNA, 705 bp, Homo sapiens
atggagacccccgcccagctgctcttcctgctgctgctgtggctgcctgacaccaccggcgagatcgtgctgacccaaagccccggtaccctgtccctgagccccggggagagagccaccctgagctgccgggccagccagagcgtgggctctagctatctggcctggtaccagcagaaacctggccaggcccccagactgctgatctatggcgcctttagcagagccaccggcattcccgacagattcagcggaagcggcagcggcaccgacttcaccctgacgatcagcagactggaacccgaggatttcgccgtgtactactgccagcagtacggcagcagcccctggaccttcgggcagggcaccaaggtggagattaagagaaccgtggccgcccccagcgtgttcatctttcccccctctgacgagcagctgaagagcggcaccgccagcgtggtgtgcctcctgaacaacttctacccccgggaggctaaggtgcagtggaaggtggacaacgccctgcagagcggcaactcacaggagagcgtgacagagcaggactcaaaggacagcacctacagcctgtccagcaccctgaccctgtcaaaggccgactacgagaagcacaaggtgtacgcctgcgaggtcacccaccagggactgagctcacccgttaccaagagcttcaaccgcggcgagtgc

SEQ ID NO: 274 - DNA, 997 bp, Homo sapiens
ggaaataagagagaaaagaagagtaagaagaaatataagagccaccatggagacccccgcccagctgctcttcctgctgctgctgtggctgcctgacaccaccggcgagatcgtgctgacccaaagccccggtaccctgtccctgagccccggggagagagccaccctgagctgccgggccagccagagcgtgggctctagctatctggcctggtaccagcagaaacctggccaggcccccagactgctgatctatggcgcctttagcagagccaccggcattcccgacagattcagcggaagcggcagcggcaccgacttcaccctgacgatcagcagactggaacccgaggatttcgccgtgtactactgccagcagtacggcagcagcccctggaccttcgggcagggcaccaaggtggagattaagagaaccgtggccgcccccagcgtgttcatctttcccccctctgacgagcagctgaagagcggcaccgccagcgtggtgtgcctcctgaacaacttctacccccgggaggctaaggtgcagtggaaggtggacaacgccctgcagagcggcaactcacaggagagcgtgacagagcaggactcaaaggacagcacctacagcctgtccagcaccctgaccctgtcaaaggccgactacgagaagcacaaggtgtacgcctgcgaggtcacccaccagggactgagctcacccgttaccaagagcttcaaccgcggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 275 - protein, 215 aa, Homo sapiens; identical to SEQ ID NO: 270

SEQ ID NO: 276 - DNA, 938 bp, Homo sapiens
tcaagcttttggaccctcgtacagaagctaatacgactcactatagggaaataagagagaaaagaagagtaagaagaaatataagagccaccatggagacacccgcccagttactgttcctcctgctgctgtggctgcctgacaccaccggcgagatcgtgctgacccagagccccggcaccctgagcctgtcccccggcgagagagccaccctgagctgccgcgcctcacagagcgtgggcagctcatacctggcctggtaccagcagaagcccggacaggctcccagactgctgatctacggcgccttttccagagccaccggcatccccgaccggttcagcggctctggaagcggcaccgacttcaccctgaccatcagccggttggagcccgaggatttcgctgtgtactactgtcagcaatacggaagcagcccctggaccttcggccagggcaccaaggtggagatcaagagaaccgtggccgcccccagcgtgttcatctttccccccagcgacgaacagctgaagagcggcaccgcctcagtggtctgcctgctcaataacttctacccccgggaggccaaagtgcagtggaaggtggacaacgccctgcagagcggcaacagccaggagagcgtgaccgagcaggacagcaaagactcaacatacagcctgagcagtaccctgactctgagcaaggccgactacgagaagcataaggtgtatgcctgcgaggtgacccaccagggcctgagcagccccgtgaccaagtcattcaaccgaggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 277 - protein, 235 aa, Homo sapiens; identical to SEQ ID NO: 267

SEQ ID NO: 278 - DNA, 705 bp, Homo sapiens
atggagacacccgcccagttactgttcctcctgctgctgtggctgcctgacaccaccggcgagatcgtgctgacccagagccccggcaccctgagcctgtcccccggcgagagagccaccctgagctgccgcgcctcacagagcgtgggcagctcatacctggcctggtaccagcagaagcccggacaggctcccagactgctgatctacggcgccttttccagagccaccggcatccccgaccggttcagcggctctggaagcggcaccgacttcaccctgaccatcagccggttggagcccgaggatttcgctgtgtactactgtcagcaatacggaagcagcccctggaccttcggccagggcaccaaggtggagatcaagagaaccgtggccgcccccagcgtgttcatctttccccccagcgacgaacagctgaagagcggcaccgcctcagtggtctgcctgctcaataacttctacccccgggaggccaaagtgcagtggaaggtggacaacgccctgcagagcggcaacagccaggagagcgtgaccgagcaggacagcaaagactcaacatacagcctgagcagtaccctgactctgagcaaggccgactacgagaagcataaggtgtatgcctgcgaggtgacccaccagggcctgagcagccccgtgaccaagtcattcaaccgaggcgagtgc

SEQ ID NO: 279 - DNA, 997 bp, Homo sapiens
ggaaataagagagaaaagaagagtaagaagaaatataagagccaccatggagacacccgcccagttactgttcctcctgctgctgtggctgcctgacaccaccggcgagatcgtgctgacccagagccccggcaccctgagcctgtcccccggcgagagagccaccctgagctgccgcgcctcacagagcgtgggcagctcatacctggcctggtaccagcagaagcccggacaggctcccagactgctgatctacggcgccttttccagagccaccggcatccccgaccggttcagcggctctggaagcggcaccgacttcaccctgaccatcagccggttggagcccgaggatttcgctgtgtactactgtcagcaatacggaagcagcccctggaccttcggccagggcaccaaggtggagatcaagagaaccgtggccgcccccagcgtgttcatctttccccccagcgacgaacagctgaagagcggcaccgcctcagtggtctgcctgctcaataacttctacccccgggaggccaaagtgcagtggaaggtggacaacgccctgcagagcggcaacagccaggagagcgtgaccgagcaggacagcaaagactcaacatacagcctgagcagtaccctgactctgagcaaggccgactacgagaagcataaggtgtatgcctgcgaggtgacccaccagggcctgagcagccccgtgaccaagtcattcaaccgaggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 280 - protein, 215 aa, Homo sapiens; identical to SEQ ID NO: 270

SEQ ID NO: 281 - DNA, 1658 bp, Homo sapiens
tcaagcttttggaccctcgtacagaagctaatacgactcactatagggaaataagagagaaaagaagagtaagaagaaatataagagccaccatggagacgcccgctcagctgctgttcctgctgctgctgtggctgcccgatacaactgggcaggtgcagttggtggaaagcggcggcggagtggtgcagccaggacggagcctgagactgagctgcgccgcctccggcttcactttctccagctatggcatgcattgggtgcggcaggcacccggcaagggcctggagtgggtggccgtcatctggtacgacggcagcaataagtactacgccgactccgtgaagggcaggttcaccatctccagggataacagcaagaatacactgtacctgcagatgaatagcctgagggctgaggacaccgccgtgtactactgtgcccgggaccccaggggcgccaccctgtactactactactacggaatggacgtgtggggccagggcaccacagtcacagtctctagcgcctccaccaagggccctagcgtgttccctctggcccccagcagcaagtctaccagcggcggcaccgccgccctgggctgcctggtgaaggactactttcccgagcccgtgaccgtcagctggaacagcggcgccctgaccagcggcgtccacaccttccccgccgtgctgcagagcagcggcctgtacagtctgagctccgtggtgacagttccctcaagcagcctgggcacacagacctatatctgcaacgtgaaccacaagcccagcaacacaaaggtggacaagagagtggagcccaagagctgcgacaagacccacacctgtcccccctgccccgccccggagctgctgggggggcccagcgtgttcctgttcccccccaaacccaaggacaccctgatgattagcaggactccagaagtcacctgcgtggtggtggacgtgtcgcacgaggaccccgaggtgaagttcaactggtatgtggacggcgtggaggtacacaatgccaagaccaagcctagggaggagcagtacaactccacctacagagtggtgagcgtgctgaccgtgctgcaccaggactggctgaacggcaaggagtacaagtgcaaagtgagcaataaggcactgcccgctcccatcgagaagaccatcagcaaggcaaaggggcagccccgcgagccccaggtgtacaccctgcccccctccagggaagagatgactaaaaatcaggtgagcctgacatgcctggtgaagggcttctacccaagcgatatcgccgtggagtgggagagcaacggccaacccgaaaacaactacaaaacgaccccaccggtcctggattcggatggcagcttcttcctgtatagcaagctgacagtggacaagtccagatggcagcagggaaacgtgttcagctgcagcgtcatgcacgaggccctgcacaaccactacacccagaagagcctcagcctgtcccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 282 - protein, 475 aa, Homo sapiens
METPAQLLFLLLLWLPDTTGQVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - DNA, 1425 bp, Homo sapiens
atggagacgcccgctcagctgctgttcctgctgctgctgtggctgcccgatacaactgggcaggtgcagttggtggaaagcggcggcggagtggtgcagccaggacggagcctgagactgagctgcgccgcctccggcttcactttctccagctatggcatgcattgggtgcggcaggcacccggcaagggcctggagtgggtggccgtcatctggtacgacggcagcaataagtactacgccgactccgtgaagggcaggttcaccatctccagggataacagcaagaatacactgtacctgcagatgaatagcctgagggctgaggacaccgccgtgtactactgtgcccgggaccccaggggcgccaccctgtactactactactacggaatggacgtgtggggccagggcaccacagtcacagtctctagcgcctccaccaagggccctagcgtgttccctctggcccccagcagcaagtctaccagcggcggcaccgccgccctgggctgcctggtgaaggactactttcccgagcccgtgaccgtcagctggaacagcggcgccctgaccagcggcgtccacaccttccccgccgtgctgcagagcagcggcctgtacagtctgagctccgtggtgacagttccctcaagcagcctgggcacacagacctatatctgcaacgtgaaccacaagcccagcaacacaaaggtggacaagagagtggagcccaagagctgcgacaagacccacacctgtcccccctgccccgccccggagctgctgggggggcccagcgtgttcctgttcccccccaaacccaaggacaccctgatgattagcaggactccagaagtcacctgcgtggtggtggacgtgtcgcacgaggaccccgaggtgaagttcaactggtatgtggacggcgtggaggtacacaatgccaagaccaagcctagggaggagcagtacaactccacctacagagtggtgagcgtgctgaccgtgctgcaccaggactggctgaacggcaaggagtacaagtgcaaagtgagcaataaggcactgcccgctcccatcgagaagaccatcagcaaggcaaaggggcagccccgcgagccccaggtgtacaccctgcccccctccagggaagagatgactaaaaatcaggtgagcctgacatgcctggtgaagggcttctacccaagcgatatcgccgtggagtgggagagcaacggccaacccgaaaacaactacaaaacgaccccaccggtcctggattcggatggcagcttcttcctgtatagcaagctgacagtggacaagtccagatggcagcagggaaacgtgttcagctgcagcgtcatgcacgaggccctgcacaaccactacacccagaagagcctcagcctgtcccccggcaag

SEQ ID NO: 284 - DNA, 1717 bp, Homo sapiens
ggaaataagagagaaaagaagagtaagaagaaatataagagccaccatggagacgcccgctcagctgctgttcctgctgctgctgtggctgcccgatacaactgggcaggtgcagttggtggaaagcggcggcggagtggtgcagccaggacggagcctgagactgagctgcgccgcctccggcttcactttctccagctatggcatgcattgggtgcggcaggcacccggcaagggcctggagtgggtggccgtcatctggtacgacggcagcaataagtactacgccgactccgtgaagggcaggttcaccatctccagggataacagcaagaatacactgtacctgcagatgaatagcctgagggctgaggacaccgccgtgtactactgtgcccgggaccccaggggcgccaccctgtactactactactacggaatggacgtgtggggccagggcaccacagtcacagtctctagcgcctccaccaagggccctagcgtgttccctctggcccccagcagcaagtctaccagcggcggcaccgccgccctgggctgcctggtgaaggactactttcccgagcccgtgaccgtcagctggaacagcggcgccctgaccagcggcgtccacaccttccccgccgtgctgcagagcagcggcctgtacagtctgagctccgtggtgacagttccctcaagcagcctgggcacacagacctatatctgcaacgtgaaccacaagcccagcaacacaaaggtggacaagagagtggagcccaagagctgcgacaagacccacacctgtcccccctgccccgccccggagctgctgggggggcccagcgtgttcctgttcccccccaaacccaaggacaccctgatgattagcaggactccagaagtcacctgcgtggtggtggacgtgtcgcacgaggaccccgaggtgaagttcaactggtatgtggacggcgtggaggtacacaatgccaagaccaagcctagggaggagcagtacaactccacctacagagtggtgagcgtgctgaccgtgctgcaccaggactggctgaacggcaaggagtacaagtgcaaagtgagcaataaggcactgcccgctcccatcgagaagaccatcagcaaggcaaaggggcagccccgcgagccccaggtgtacaccctgcccccctccagggaagagatgactaaaaatcaggtgagcctgacatgcctggtgaagggcttctacccaagcgatatcgccgtggagtgggagagcaacggccaacccgaaaacaactacaaaacgaccccaccggtcctggattcggatggcagcttcttcctgtatagcaagctgacagtggacaagtccagatggcagcagggaaacgtgttcagctgcagcgtcatgcacgaggccctgcacaaccactacacccagaagagcctcagcctgtcccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 285 - protein, 455 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - DNA, 1658 bp, Homo sapiens
tcaagcttttggaccctcgtacagaagctaatacgactcactatagggaaataagagagaaaagaagagtaagaagaaatataagagccaccatggaaaccccagcccagctcctgttcctgctgctgctgtggctgcccgacaccaccggccaggtgcagctggtggagtcaggcggcggcgtggtgcaaccaggccgcagcctgaggctcagctgcgccgcctccggcttcaccttcagttcctacggcatgcactgggtgagacaggcccccggcaagggcctggagtgggtggccgtgatctggtacgacggcagcaacaaatactatgctgacagcgtgaagggccggttcaccatctccagggacaatagcaaaaacaccctgtacctgcaaatgaatagcctgagggccgaggacaccgctgtgtactactgcgccagggaccctaggggcgccaccctttactactactactacggcatggacgtgtggggccagggcactaccgtcaccgtgtccagcgccagcaccaagggccccagcgtgttcccactggcacccagctctaagagcaccagcggcggcaccgccgccctgggctgcctggtgaaggactacttccccgagcccgtgaccgtgagctggaacagcggcgccctgacttccggcgtccacacattccccgccgtgctgcagagcagcgggctgtacagcctgtcatccgtggtgaccgtgcctagcagcagtctgggcactcagacctatatttgcaacgtgaaccacaagccctccaacaccaaagtggataagagagtggagcctaagagctgtgataagacccacacctgccctccttgcccagctccggagctgctgggcggccccagcgtgttcctgttccccccgaagcccaaggacacactgatgatcagcagaacccccgaagttacttgcgtggtggtggacgtcagccacgaagaccccgaggtcaagttcaattggtatgtggacggcgtggaggtgcacaacgccaagacaaagccgagagaggagcagtacaattccacctatagagtggtgagcgtgctgacagtcctccaccaggactggctgaacggcaaggagtacaagtgcaaggtcagcaacaaagccctgcctgctcccatcgagaagaccatctccaaggctaaaggccagcctagagagccccaggtgtacaccctgcccccctccagagaggagatgaccaagaaccaggtgagcctgacatgcctggtgaagggcttctaccccagcgacatcgctgtggagtgggagagcaatggccagcccgagaataactacaagaccaccccccccgtgctcgacagcgacggcagcttcttcctgtacagcaagctgaccgtggataagagcagatggcaacagggtaatgtgtttagctgctccgtgatgcacgaggccctccacaaccattacacccagaaaagcctgtccctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 287 - protein, 475 aa, Homo sapiens; identical to SEQ ID NO: 282

SEQ ID NO: 288 - DNA, 1425 bp, Homo sapiens
atggaaaccccagcccagctcctgttcctgctgctgctgtggctgcccgacaccaccggccaggtgcagctggtggagtcaggcggcggcgtggtgcaaccaggccgcagcctgaggctcagctgcgccgcctccggcttcaccttcagttcctacggcatgcactgggtgagacaggcccccggcaagggcctggagtgggtggccgtgatctggtacgacggcagcaacaaatactatgctgacagcgtgaagggccggttcaccatctccagggacaatagcaaaaacaccctgtacctgcaaatgaatagcctgagggccgaggacaccgctgtgtactactgcgccagggaccctaggggcgccaccctttactactactactacggcatggacgtgtggggccagggcactaccgtcaccgtgtccagcgccagcaccaagggccccagcgtgttcccactggcacccagctctaagagcaccagcggcggcaccgccgccctgggctgcctggtgaaggactacttccccgagcccgtgaccgtgagctggaacagcggcgccctgacttccggcgtccacacattccccgccgtgctgcagagcagcgggctgtacagcctgtcatccgtggtgaccgtgcctagcagcagtctgggcactcagacctatatttgcaacgtgaaccacaagccctccaacaccaaagtggataagagagtggagcctaagagctgtgataagacccacacctgccctccttgcccagctccggagctgctgggcggccccagcgtgttcctgttccccccgaagcccaaggacacactgatgatcagcagaacccccgaagttacttgcgtggtggtggacgtcagccacgaagaccccgaggtcaagttcaattggtatgtggacggcgtggaggtgcacaacgccaagacaaagccgagagaggagcagtacaattccacctatagagtggtgagcgtgctgacagtcctccaccaggactggctgaacggcaaggagtacaagtgcaaggtcagcaacaaagccctgcctgctcccatcgagaagaccatctccaaggctaaaggccagcctagagagccccaggtgtacaccctgcccccctccagagaggagatgaccaagaaccaggtgagcctgacatgcctggtgaagggcttctaccccagcgacatcgctgtggagtgggagagcaatggccagcccgagaataactacaagaccaccccccccgtgctcgacagcgacggcagcttcttcctgtacagcaagctgaccgtggataagagcagatggcaacagggtaatgtgtttagctgctccgtgatgcacgaggccctccacaaccattacacccagaaaagcctgtccctgagccccggcaag

SEQ ID NO: 289 - DNA, 1717 bp, Homo sapiens
ggaaataagagagaaaagaagagtaagaagaaatataagagccaccatggaaaccccagcccagctcctgttcctgctgctgctgtggctgcccgacaccaccggccaggtgcagctggtggagtcaggcggcggcgtggtgcaaccaggccgcagcctgaggctcagctgcgccgcctccggcttcaccttcagttcctacggcatgcactgggtgagacaggcccccggcaagggcctggagtgggtggccgtgatctggtacgacggcagcaacaaatactatgctgacagcgtgaagggccggttcaccatctccagggacaatagcaaaaacaccctgtacctgcaaatgaatagcctgagggccgaggacaccgctgtgtactactgcgccagggaccctaggggcgccaccctttactactactactacggcatggacgtgtggggccagggcactaccgtcaccgtgtccagcgccagcaccaagggccccagcgtgttcccactggcacccagctctaagagcaccagcggcggcaccgccgccctgggctgcctggtgaaggactacttccccgagcccgtgaccgtgagctggaacagcggcgccctgacttccggcgtccacacattccccgccgtgctgcagagcagcgggctgtacagcctgtcatccgtggtgaccgtgcctagcagcagtctgggcactcagacctatatttgcaacgtgaaccacaagccctccaacaccaaagtggataagagagtggagcctaagagctgtgataagacccacacctgccctccttgcccagctccggagctgctgggcggccccagcgtgttcctgttccccccgaagcccaaggacacactgatgatcagcagaacccccgaagttacttgcgtggtggtggacgtcagccacgaagaccccgaggtcaagttcaattggtatgtggacggcgtggaggtgcacaacgccaagacaaagccgagagaggagcagtacaattccacctatagagtggtgagcgtgctgacagtcctccaccaggactggctgaacggcaaggagtacaagtgcaaggtcagcaacaaagccctgcctgctcccatcgagaagaccatctccaaggctaaaggccagcctagagagccccaggtgtacaccctgcccccctccagagaggagatgaccaagaaccaggtgagcctgacatgcctggtgaagggcttctaccccagcgacatcgctgtggagtgggagagcaatggccagcccgagaataactacaagaccaccccccccgtgctcgacagcgacggcagcttcttcctgtacagcaagctgaccgtggataagagcagatggcaacagggtaatgtgtttagctgctccgtgatgcacgaggccctccacaaccattacacccagaaaagcctgtccctgagccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 290 - protein, 455 aa, Homo sapiens; identical to SEQ ID NO: 285

SEQ ID NO: 291 - DNA, 1658 bp, Homo sapiens
tcaagcttttggaccctcgtacagaagctaatacgactcactatagggaaataagagagaaaagaagagtaagaagaaatataagagccaccatggaaacccccgctcagctgctgtttctgcttctgctgtggctccctgacactaccggacaggtgcagctcgtggagagcggcggcggcgtggtgcagcccggcaggagcctgagactgagctgcgccgcctctggcttcacattcagcagctacggcatgcactgggtgcggcaggcccccggcaagggactggagtgggtggccgtgatctggtacgacggatcaaacaagtactacgccgactcggtgaagggcaggttcaccatcagccgcgacaacagcaagaacaccctgtacctgcagatgaacagcctgagagccgaggacaccgcggtgtactactgcgcccgggatcccaggggcgccaccctgtactactactactacggcatggacgtgtggggccagggcaccacagtgacagtgagcagcgccagcaccaagggccctagcgtgtttcctctggccccaagctcaaagagcaccagtggcggaaccgccgccctgggctgcctggtgaaggactactttcccgagcccgtgaccgtgtcctggaacagcggcgccctgacaagcggagtgcacaccttcccagcggttctgcagtcatcagggctgtacagcctgagctccgtggtgaccgtgcccagctccagcctgggtacccagacctacatctgcaatgtgaaccacaagcccagcaacaccaaggtggacaagcgcgtcgagcctaaaagctgcgacaagacccacacctgccccccctgccccgcccccgagctgctggggggccccagcgtcttcctattcccccctaagcccaaggacaccctcatgatcagcagaacccccgaggtgacctgcgtggtggtggacgtgagccatgaggaccccgaggtgaagttcaattggtacgtggacggggtggaagtgcataacgccaagaccaagccaagagaggagcagtacaacagcacctaccgcgtggtgtccgtgctgaccgtgttgcatcaggattggcttaacggcaaggagtataagtgtaaagtgtctaacaaggctctccccgcccccattgagaagaccatctccaaggccaagggccagcccagagagccccaggtgtatacactgccccccagcagagaggagatgaccaagaaccaggtgagcctgacctgtctggtgaagggcttctaccctagcgacattgccgtggagtgggagtccaacggccagcccgaaaataactacaagaccactcctcccgtgcttgacagcgacgggagcttcttcctgtacagcaagctgaccgtggacaagagcaggtggcagcagggcaacgtgttctcttgcagcgtgatgcacgaggcgctccacaatcactacacccagaagagcctgtccctgtctcccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 292 - protein, 475 aa, Homo sapiens; identical to SEQ ID NO: 282

SEQ ID NO: 293 - DNA, 1425 bp, Homo sapiens
atggaaacccccgctcagctgctgtttctgcttctgctgtggctccctgacactaccggacaggtgcagctcgtggagagcggcggcggcgtggtgcagcccggcaggagcctgagactgagctgcgccgcctctggcttcacattcagcagctacggcatgcactgggtgcggcaggcccccggcaagggactggagtgggtggccgtgatctggtacgacggatcaaacaagtactacgccgactcggtgaagggcaggttcaccatcagccgcgacaacagcaagaacaccctgtacctgcagatgaacagcctgagagccgaggacaccgcggtgtactactgcgcccgggatcccaggggcgccaccctgtactactactactacggcatggacgtgtggggccagggcaccacagtgacagtgagcagcgccagcaccaagggccctagcgtgtttcctctggccccaagctcaaagagcaccagtggcggaaccgccgccctgggctgcctggtgaaggactactttcccgagcccgtgaccgtgtcctggaacagcggcgccctgacaagcggagtgcacaccttcccagcggttctgcagtcatcagggctgtacagcctgagctccgtggtgaccgtgcccagctccagcctgggtacccagacctacatctgcaatgtgaaccacaagcccagcaacaccaaggtggacaagcgcgtcgagcctaaaagctgcgacaagacccacacctgccccccctgccccgcccccgagctgctggggggccccagcgtcttcctattcccccctaagcccaaggacaccctcatgatcagcagaacccccgaggtgacctgcgtggtggtggacgtgagccatgaggaccccgaggtgaagttcaattggtacgtggacggggtggaagtgcataacgccaagaccaagccaagagaggagcagtacaacagcacctaccgcgtggtgtccgtgctgaccgtgttgcatcaggattggcttaacggcaaggagtataagtgtaaagtgtctaacaaggctctccccgcccccattgagaagaccatctccaaggccaagggccagcccagagagccccaggtgtatacactgccccccagcagagaggagatgaccaagaaccaggtgagcctgacctgtctggtgaagggcttctaccctagcgacattgccgtggagtgggagtccaacggccagcccgaaaataactacaagaccactcctcccgtgcttgacagcgacgggagcttcttcctgtacagcaagctgaccgtggacaagagcaggtggcagcagggcaacgtgttctcttgcagcgtgatgcacgaggcgctccacaatcactacacccagaagagcctgtccctgtctcccggcaag

SEQ ID NO: 294 - DNA, 1717 bp, Homo sapiens
ggaaataagagagaaaagaagagtaagaagaaatataagagccaccatggaaacccccgctcagctgctgtttctgcttctgctgtggctccctgacactaccggacaggtgcagctcgtggagagcggcggcggcgtggtgcagcccggcaggagcctgagactgagctgcgccgcctctggcttcacattcagcagctacggcatgcactgggtgcggcaggcccccggcaagggactggagtgggtggccgtgatctggtacgacggatcaaacaagtactacgccgactcggtgaagggcaggttcaccatcagccgcgacaacagcaagaacaccctgtacctgcagatgaacagcctgagagccgaggacaccgcggtgtactactgcgcccgggatcccaggggcgccaccctgtactactactactacggcatggacgtgtggggccagggcaccacagtgacagtgagcagcgccagcaccaagggccctagcgtgtttcctctggccccaagctcaaagagcaccagtggcggaaccgccgccctgggctgcctggtgaaggactactttcccgagcccgtgaccgtgtcctggaacagcggcgccctgacaagcggagtgcacaccttcccagcggttctgcagtcatcagggctgtacagcctgagctccgtggtgaccgtgcccagctccagcctgggtacccagacctacatctgcaatgtgaaccacaagcccagcaacaccaaggtggacaagcgcgtcgagcctaaaagctgcgacaagacccacacctgccccccctgccccgcccccgagctgctggggggccccagcgtcttcctattcccccctaagcccaaggacaccctcatgatcagcagaacccccgaggtgacctgcgtggtggtggacgtgagccatgaggaccccgaggtgaagttcaattggtacgtggacggggtggaagtgcataacgccaagaccaagccaagagaggagcagtacaacagcacctaccgcgtggtgtccgtgctgaccgtgttgcatcaggattggcttaacggcaaggagtataagtgtaaagtgtctaacaaggctctccccgcccccattgagaagaccatctccaaggccaagggccagcccagagagccccaggtgtatacactgccccccagcagagaggagatgaccaagaaccaggtgagcctgacctgtctggtgaagggcttctaccctagcgacattgccgtggagtgggagtccaacggccagcccgaaaataactacaagaccactcctcccgtgcttgacagcgacgggagcttcttcctgtacagcaagctgaccgtggacaagagcaggtggcagcagggcaacgtgttctcttgcagcgtgatgcacgaggcgctccacaatcactacacccagaagagcctgtccctgtctcccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 295 - protein, 455 aa, Homo sapiens; identical to SEQ ID NO: 285

SEQ ID NO: 296 - DNA, 1646 bp, Homo sapiens
tcaagcttttggaccctcgtacagaagctaatacgactcactatagggaaataagagagaaaagaagagtaagaagaaatataagagccaccatggagacccccgcccagctgctgttcctgctgctgctgtggctgcccgataccaccggccaggtccagctcgtggagagcggcggcggcgtggttcagcccggcagaagcctgagactgagctgcgccgccagcggcttcaccttctcaagctacggcatgcactgggtgagacaggccccgggcaagggcctcgaatgggtggccgtgatctggtacgacggaagcaacaagtactacgccgatagtgtgaagggcaggttcactatcagccgagataacagcaaaaacaccctgtatctgcagatgaactcactgcgtgccgaggataccgctgtgtactattgcgccagggaccctagaggagccacgctgtactactactactacggcatggacgtttggggccagggaaccaccgtcaccgtgagcagcgcctccaccaaaggccccagcgtgttccccctggccccttgctccaggagtaccagcgagagcaccgccgccctgggctgcctggtgaaggactatttccccgagcccgtgaccgtgtcctggaactctggcgccctgaccagcggggtgcacaccttccccgccgtcctgcagagtagcggactgtacagcctgagcagcgtagtgactgtgccctccagcaacttcggcactcagacctatacttgtaacgtcgaccacaagccttccaacacaaaggtggacaaaaccgtggagaggaagtgttgcgttgagtgccccccctgtccggccccgcccgtggcggggcctagcgtgttcctcttccctcccaagccaaaggacaccctgatgatcagcaggacccccgaggtgacctgcgtggtggtggatgtgagccatgaggaccccgaggtgcagtttaactggtacgtggacggagtggaggtgcataacgccaagaccaagcctagggaggagcagttcaacagcaccttcagagtggttagcgtgctgaccgtggtgcaccaggattggctgaacgggaaggagtacaagtgcaaggtgagcaacaagggcctgcccgccccaatcgagaagaccatctcaaagaccaaggggcagcctagagagccccaggtgtacaccctgccccctagcagagaggagatgaccaagaaccaggtgagcctcacctgcctcgtgaagggcttctaccccagcgacatcgctgtggagtgggagtccaacggccagcccgagaacaactacaaaaccacacccccaatgctggactccgacggcagcttcttcctgtacagcaagctgacagtggacaaaagcagatggcagcagggcaacgtgttcagctgctctgtgatgcacgaggccctgcacaatcattatactcagaagagcctgagcctgtcccccggaaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 297 - protein, 471 aa, Homo sapiens; identical to SEQ ID NO: 235

SEQ ID NO: 298 - DNA, 1413 bp, Homo sapiens
atggagacccccgcccagctgctgttcctgctgctgctgtggctgcccgataccaccggccaggtccagctcgtggagagcggcggcggcgtggttcagcccggcagaagcctgagactgagctgcgccgccagcggcttcaccttctcaagctacggcatgcactgggtgagacaggccccgggcaagggcctcgaatgggtggccgtgatctggtacgacggaagcaacaagtactacgccgatagtgtgaagggcaggttcactatcagccgagataacagcaaaaacaccctgtatctgcagatgaactcactgcgtgccgaggataccgctgtgtactattgcgccagggaccctagaggagccacgctgtactactactactacggcatggacgtttggggccagggaaccaccgtcaccgtgagcagcgcctccaccaaaggccccagcgtgttccccctggccccttgctccaggagtaccagcgagagcaccgccgccctgggctgcctggtgaaggactatttccccgagcccgtgaccgtgtcctggaactctggcgccctgaccagcggggtgcacaccttccccgccgtcctgcagagtagcggactgtacagcctgagcagcgtagtgactgtgccctccagcaacttcggcactcagacctatacttgtaacgtcgaccacaagccttccaacacaaaggtggacaaaaccgtggagaggaagtgttgcgttgagtgccccccctgtccggccccgcccgtggcggggcctagcgtgttcctcttccctcccaagccaaaggacaccctgatgatcagcaggacccccgaggtgacctgcgtggtggtggatgtgagccatgaggaccccgaggtgcagtttaactggtacgtggacggagtggaggtgcataacgccaagaccaagcctagggaggagcagttcaacagcaccttcagagtggttagcgtgctgaccgtggtgcaccaggattggctgaacgggaaggagtacaagtgcaaggtgagcaacaagggcctgcccgccccaatcgagaagaccatctcaaagaccaaggggcagcctagagagccccaggtgtacaccctgccccctagcagagaggagatgaccaagaaccaggtgagcctcacctgcctcgtgaagggcttctaccccagcgacatcgctgtggagtgggagtccaacggccagcccgagaacaactacaaaaccacacccccaatgctggactccgacggcagcttcttcctgtacagcaagctgacagtggacaaaagcagatggcagcagggcaacgtgttcagctgctctgtgatgcacgaggccctgcacaatcattatactcagaagagcctgagcctgtcccccggaaag

SEQ ID NO: 299 - DNA, 1705 bp, Homo sapiens
ggaaataagagagaaaagaagagtaagaagaaatataagagccaccatggagacccccgcccagctgctgttcctgctgctgctgtggctgcccgataccaccggccaggtccagctcgtggagagcggcggcggcgtggttcagcccggcagaagcctgagactgagctgcgccgccagcggcttcaccttctcaagctacggcatgcactgggtgagacaggccccgggcaagggcctcgaatgggtggccgtgatctggtacgacggaagcaacaagtactacgccgatagtgtgaagggcaggttcactatcagccgagataacagcaaaaacaccctgtatctgcagatgaactcactgcgtgccgaggataccgctgtgtactattgcgccagggaccctagaggagccacgctgtactactactactacggcatggacgtttggggccagggaaccaccgtcaccgtgagcagcgcctccaccaaaggccccagcgtgttccccctggccccttgctccaggagtaccagcgagagcaccgccgccctgggctgcctggtgaaggactatttccccgagcccgtgaccgtgtcctggaactctggcgccctgaccagcggggtgcacaccttccccgccgtcctgcagagtagcggactgtacagcctgagcagcgtagtgactgtgccctccagcaacttcggcactcagacctatacttgtaacgtcgaccacaagccttccaacacaaaggtggacaaaaccgtggagaggaagtgttgcgttgagtgccccccctgtccggccccgcccgtggcggggcctagcgtgttcctcttccctcccaagccaaaggacaccctgatgatcagcaggacccccgaggtgacctgcgtggtggtggatgtgagccatgaggaccccgaggtgcagtttaactggtacgtggacggagtggaggtgcataacgccaagaccaagcctagggaggagcagttcaacagcaccttcagagtggttagcgtgctgaccgtggtgcaccaggattggctgaacgggaaggagtacaagtgcaaggtgagcaacaagggcctgcccgccccaatcgagaagaccatctcaaagaccaaggggcagcctagagagccccaggtgtacaccctgccccctagcagagaggagatgaccaagaaccaggtgagcctcacctgcctcgtgaagggcttctaccccagcgacatcgctgtggagtgggagtccaacggccagcccgagaacaactacaaaaccacacccccaatgctggactccgacggcagcttcttcctgtacagcaagctgacagtggacaaaagcagatggcagcagggcaacgtgttcagctgctctgtgatgcacgaggccctgcacaatcattatactcagaagagcctgagcctgtcccccggaaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 300 - protein, 451 aa, Homo sapiens; identical to SEQ ID NO: 21

SEQ ID NO: 301 - DNA, 1646 bp, Homo sapiens
tcaagcttttggaccctcgtacagaagctaatacgactcactatagggaaataagagagaaaagaagagtaagaagaaatataagagccaccatggagaccccagcccagctgctgttcctgcttctgctgtggctgccagataccaccggccaggtgcagctggttgagtcaggcggcggcgtggtgcagcccggcagaagcctgcggctgagctgcgccgccagcggcttcaccttcagcagctacggcatgcactgggtgagacaggcccctggcaaggggctggagtgggtggccgtgatctggtatgacggaagtaacaagtactacgccgacagcgtgaagggcagattcacgatcagcagagacaactccaagaacacgctgtacttgcagatgaacagcctgagagccgaggacacagccgtgtattactgcgccagagaccccagaggcgccaccctgtactactactactacggcatggacgtgtggggccagggcaccaccgtgaccgtgagcagtgccagcaccaagggccccagcgtgttccccctggccccctgcagtcggagcaccagcgaaagcaccgccgccctgggctgcctggtgaaagactatttccccgagcctgtgacagtgagctggaacagcggggccctcacctctggcgtgcacacgttcccagccgtgctgcagagcagcgggctgtacagcctgtcctctgtggtgaccgtgcccagcagcaatttcggcacccagacctacacgtgcaatgtggatcacaagcccagcaacacaaaagtggacaaaaccgtggagagaaagtgttgcgtggagtgccccccttgccccgccccccccgtggctggcccgtcagtgttcctgttccctcctaagcccaaggacaccctcatgatcagcagaacccccgaggtgacctgcgtggtcgtggacgtgagtcacgaggaccccgaggtccagttcaactggtacgtggatggagtggaggtgcacaacgccaagaccaagccccgggaggagcagtttaatagcacctttagggtggtgagcgtgctgaccgttgtacaccaggactggctgaacggcaaagagtacaaatgcaaggtttcaaataagggcctgcccgccccaattgagaagacaatcagcaagactaagggccagcctagggaaccccaggtctacactctgcccccctctcgggaggagatgaccaagaaccaggtgagcctgacctgcctggtgaagggcttctacccttctgacatcgctgtggagtgggagagcaatggacaacccgagaacaactacaagaccacccccccaatgctggactctgatggcagcttctttctgtacagcaagctgacagtggataaaagcaggtggcagcagggtaatgtgttcagctgcagcgtgatgcacgaggcactgcacaatcactacacccagaagagcctgtccctgtcccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 302 - protein, 471 aa, Homo sapiens; identical to SEQ ID NO: 235

SEQ ID NO: 303 - DNA, 1413 bp, Homo sapiens
atggagaccccagcccagctgctgttcctgcttctgctgtggctgccagataccaccggccaggtgcagctggttgagtcaggcggcggcgtggtgcagcccggcagaagcctgcggctgagctgcgccgccagcggcttcaccttcagcagctacggcatgcactgggtgagacaggcccctggcaaggggctggagtgggtggccgtgatctggtatgacggaagtaacaagtactacgccgacagcgtgaagggcagattcacgatcagcagagacaactccaagaacacgctgtacttgcagatgaacagcctgagagccgaggacacagccgtgtattactgcgccagagaccccagaggcgccaccctgtactactactactacggcatggacgtgtggggccagggcaccaccgtgaccgtgagcagtgccagcaccaagggccccagcgtgttccccctggccccctgcagtcggagcaccagcgaaagcaccgccgccctgggctgcctggtgaaagactatttccccgagcctgtgacagtgagctggaacagcggggccctcacctctggcgtgcacacgttcccagccgtgctgcagagcagcgggctgtacagcctgtcctctgtggtgaccgtgcccagcagcaatttcggcacccagacctacacgtgcaatgtggatcacaagcccagcaacacaaaagtggacaaaaccgtggagagaaagtgttgcgtggagtgccccccttgccccgccccccccgtggctggcccgtcagtgttcctgttccctcctaagcccaaggacaccctcatgatcagcagaacccccgaggtgacctgcgtggtcgtggacgtgagtcacgaggaccccgaggtccagttcaactggtacgtggatggagtggaggtgcacaacgccaagaccaagccccgggaggagcagtttaatagcacctttagggtggtgagcgtgctgaccgttgtacaccaggactggctgaacggcaaagagtacaaatgcaaggtttcaaataagggcctgcccgccccaattgagaagacaatcagcaagactaagggccagcctagggaaccccaggtctacactctgcccccctctcgggaggagatgaccaagaaccaggtgagcctgacctgcctggtgaagggcttctacccttctgacatcgctgtggagtgggagagcaatggacaacccgagaacaactacaagaccacccccccaatgctggactctgatggcagcttctttctgtacagcaagctgacagtggataaaagcaggtggcagcagggtaatgtgttcagctgcagcgtgatgcacgaggcactgcacaatcactacacccagaagagcctgtccctgtcccccggcaag

SEQ ID NO: 304 - DNA, 1705 bp, Homo sapiens
ggaaataagagagaaaagaagagtaagaagaaatataagagccaccatggagaccccagcccagctgctgttcctgcttctgctgtggctgccagataccaccggccaggtgcagctggttgagtcaggcggcggcgtggtgcagcccggcagaagcctgcggctgagctgcgccgccagcggcttcaccttcagcagctacggcatgcactgggtgagacaggcccctggcaaggggctggagtgggtggccgtgatctggtatgacggaagtaacaagtactacgccgacagcgtgaagggcagattcacgatcagcagagacaactccaagaacacgctgtacttgcagatgaacagcctgagagccgaggacacagccgtgtattactgcgccagagaccccagaggcgccaccctgtactactactactacggcatggacgtgtggggccagggcaccaccgtgaccgtgagcagtgccagcaccaagggccccagcgtgttccccctggccccctgcagtcggagcaccagcgaaagcaccgccgccctgggctgcctggtgaaagactatttccccgagcctgtgacagtgagctggaacagcggggccctcacctctggcgtgcacacgttcccagccgtgctgcagagcagcgggctgtacagcctgtcctctgtggtgaccgtgcccagcagcaatttcggcacccagacctacacgtgcaatgtggatcacaagcccagcaacacaaaagtggacaaaaccgtggagagaaagtgttgcgtggagtgccccccttgccccgccccccccgtggctggcccgtcagtgttcctgttccctcctaagcccaaggacaccctcatgatcagcagaacccccgaggtgacctgcgtggtcgtggacgtgagtcacgaggaccccgaggtccagttcaactggtacgtggatggagtggaggtgcacaacgccaagaccaagccccgggaggagcagtttaatagcacctttagggtggtgagcgtgctgaccgttgtacaccaggactggctgaacggcaaagagtacaaatgcaaggtttcaaataagggcctgcccgccccaattgagaagacaatcagcaagactaagggccagcctagggaaccccaggtctacactctgcccccctctcgggaggagatgaccaagaaccaggtgagcctgacctgcctggtgaagggcttctacccttctgacatcgctgtggagtgggagagcaatggacaacccgagaacaactacaagaccacccccccaatgctggactctgatggcagcttctttctgtacagcaagctgacagtggataaaagcaggtggcagcagggtaatgtgttcagctgcagcgtgatgcacgaggcactgcacaatcactacacccagaagagcctgtccctgtcccccggcaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 305 - protein, 451 aa, Homo sapiens; identical to SEQ ID NO: 21

SEQ ID NO: 306 - DNA, 1646 bp, Homo sapiens
tcaagcttttggaccctcgtacagaagctaatacgactcactatagggaaataagagagaaaagaagagtaagaagaaatataagagccaccatggaaacccccgctcagctgctgttcctgttgctgctgtggctgcccgacactaccgggcaagtgcagctggtggagagcggcggcggcgtggtgcagcccggcagaagccttaggctgagctgcgccgccagtggcttcaccttcagcagctacggcatgcactgggtgagacaggcccccggcaagggcctggagtgggtggctgtgatctggtacgacggcagcaacaagtactacgcagacagcgtgaagggaagattcaccatcagccgcgacaacagcaagaacaccctgtacctgcagatgaacagcctgagagctgaggacaccgcagtgtactactgcgccagagaccccaggggcgccaccctgtactactattattacggcatggatgtgtggggccagggcaccaccgtgaccgtgtccagcgccagcaccaagggcccaagcgtgttcccacttgccccatgcagcagaagcaccagcgagtcaaccgccgccctggggtgcttggtgaaagactacttccccgagcccgtgaccgtgagctggaacagcggagcactgaccagcggtgtgcacaccttccccgccgtgctgcagagcagcggactgtactccctgtccagcgtggtcaccgtgcccagcagcaacttcgggactcaaacttacacttgcaacgtggaccacaaaccctccaataccaaggtggataaaaccgtggagcggaagtgttgcgtggagtgccctccctgccccgcgcctcccgtggccggccccagcgtgttcctgttcccacccaagcctaaggatacactgatgatcagcagaacccccgaggtcacttgcgtggtggtggacgtgagccacgaggacccggaggtgcagtttaactggtacgttgacggggtggaggtgcacaacgctaagaccaagcccagagaagaacagttcaacagcaccttcagggtagtgagcgtgcttaccgtggtgcaccaggactggctgaacggcaaggagtacaagtgcaaggtgagcaacaagggattgcccgccccgatcgagaagacaatctctaagacgaagggccagcccagagagccccaggtgtacaccctgccccccagcagagaggagatgaccaagaatcaggtgagcctgacatgcttggtgaagggcttctaccccagcgacatcgccgtcgagtgggagagcaacggacagcccgagaacaactacaaaaccaccccacctatgctggacagcgacggcagcttcttcctgtactccaaactgaccgtggataagagcagatggcagcagggcaacgtgtttagctgcagcgtgatgcacgaggccctgcacaaccactacacccagaagagcctgtctttgagccccgggaagtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 307 - protein, 471 aa, Homo sapiens; identical to SEQ ID NO: 235

SEQ ID NO: 308 - DNA, 1413 bp, Homo sapiens
atggaaacccccgctcagctgctgttcctgttgctgctgtggctgcccgacactaccgggcaagtgcagctggtggagagcggcggcggcgtggtgcagcccggcagaagccttaggctgagctgcgccgccagtggcttcaccttcagcagctacggcatgcactgggtgagacaggcccccggcaagggcctggagtgggtggctgtgatctggtacgacggcagcaacaagtactacgcagacagcgtgaagggaagattcaccatcagccgcgacaacagcaagaacaccctgtacctgcagatgaacagcctgagagctgaggacaccgcagtgtactactgcgccagagaccccaggggcgccaccctgtactactattattacggcatggatgtgtggggccagggcaccaccgtgaccgtgtccagcgccagcaccaagggcccaagcgtgttcccacttgccccatgcagcagaagcaccagcgagtcaaccgccgccctggggtgcttggtgaaagactacttccccgagcccgtgaccgtgagctggaacagcggagcactgaccagcggtgtgcacaccttccccgccgtgctgcagagcagcggactgtactccctgtccagcgtggtcaccgtgcccagcagcaacttcgggactcaaacttacacttgcaacgtggaccacaaaccctccaataccaaggtggataaaaccgtggagcggaagtgttgcgtggagtgccctccctgccccgcgcctcccgtggccggccccagcgtgttcctgttcccacccaagcctaaggatacactgatgatcagcagaacccccgaggtcacttgcgtggtggtggacgtgagccacgaggacccggaggtgcagtttaactggtacgttgacggggtggaggtgcacaacgctaagaccaagcccagagaagaacagttcaacagcaccttcagggtagtgagcgtgcttaccgtggtgcaccaggactggctgaacggcaaggagtacaagtgcaaggtgagcaacaagggattgcccgccccgatcgagaagacaatctctaagacgaagggccagcccagagagccccaggtgtacaccctgccccccagcagagaggagatgaccaagaatcaggtgagcctgacatgcttggtgaagggcttctaccccagcgacatcgccgtcgagtgggagagcaacggacagcccgagaacaactacaaaaccaccccacctatgctggacagcgacggcagcttcttcctgtactccaaactgaccgtggataagagcagatggcagcagggcaacgtgtttagctgcagcgtgatgcacgaggccctgcacaaccactacacccagaagagcctgtctttgagccccgggaag

SEQ ID NO: 309 - DNA, 1705 bp, Homo sapiens
ggaaataagagagaaaagaagagtaagaagaaatataagagccaccatggaaacccccgctcagctgctgttcctgttgctgctgtggctgcccgacactaccgggcaagtgcagctggtggagagcggcggcggcgtggtgcagcccggcagaagccttaggctgagctgcgccgccagtggcttcaccttcagcagctacggcatgcactgggtgagacaggcccccggcaagggcctggagtgggtggctgtgatctggtacgacggcagcaacaagtactacgcagacagcgtgaagggaagattcaccatcagccgcgacaacagcaagaacaccctgtacctgcagatgaacagcctgagagctgaggacaccgcagtgtactactgcgccagagaccccaggggcgccaccctgtactactattattacggcatggatgtgtggggccagggcaccaccgtgaccgtgtccagcgccagcaccaagggcccaagcgtgttcccacttgccccatgcagcagaagcaccagcgagtcaaccgccgccctggggtgcttggtgaaagactacttccccgagcccgtgaccgtgagctggaacagcggagcactgaccagcggtgtgcacaccttccccgccgtgctgcagagcagcggactgtactccctgtccagcgtggtcaccgtgcccagcagcaacttcgggactcaaacttacacttgcaacgtggaccacaaaccctccaataccaaggtggataaaaccgtggagcggaagtgttgcgtggagtgccctccctgccccgcgcctcccgtggccggccccagcgtgttcctgttcccacccaagcctaaggatacactgatgatcagcagaacccccgaggtcacttgcgtggtggtggacgtgagccacgaggacccggaggtgcagtttaactggtacgttgacggggtggaggtgcacaacgctaagaccaagcccagagaagaacagttcaacagcaccttcagggtagtgagcgtgcttaccgtggtgcaccaggactggctgaacggcaaggagtacaagtgcaaggtgagcaacaagggattgcccgccccgatcgagaagacaatctctaagacgaagggccagcccagagagccccaggtgtacaccctgccccccagcagagaggagatgaccaagaatcaggtgagcctgacatgcttggtgaagggcttctaccccagcgacatcgccgtcgagtgggagagcaacggacagcccgagaacaactacaaaaccaccccacctatgctggacagcgacggcagcttcttcctgtactccaaactgaccgtggataagagcagatggcagcagggcaacgtgtttagctgcagcgtgatgcacgaggccctgcacaaccactacacccagaagagcctgtctttgagccccgggaagtgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 310 - protein, 451 aa, Homo sapiens; identical to SEQ ID NO: 21

SEQ ID NO: 311 - DNA, 935 bp, Homo sapiens
tcaagcttttggaccctcgtacagaagctaatacgactcactatagggaaataagagagaaaagaagagtaagaagaaatataagagccaccatggagacccctgcacagctgctgttcctgctgctgctgtggctgcccgacaccaccggcgacatccagatgacccagagccccagctccctgagcgccagcgtgggcgacagagtgaccatcacctgtagggccagccagagcatcaatagctacctggactggtaccagcagaagcctggcaaggcccccaagctgctgatctacgccgccagcagcctgcaaagcggcgtgcccagcagattcagcgggagcggcagcggcacagactttacactgaccatcagcagcctgcagcccgaggacttcgccacctactactgccaacagtattactccaccccctttaccttcggccccggaaccaaggtggagatcaagagaaccgtggccgcccccagcgtgttcatcttccccccctctgatgagcagctgaagagcggcaccgccagcgtggtgtgcctgctgaacaacttctatcccagagaggccaaggtgcagtggaaggtggacaacgccctgcagagcggcaacagccaggagagcgtgactgagcaggacagcaaggacagcacctacagcctgagcagcaccctgacactgtcaaaggccgattacgagaagcacaaagtgtacgcctgcgaggtgacccaccagggcctgagcagccccgtcaccaagagcttcaacaggggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 312 - protein, 234 aa, Homo sapiens; identical to SEQ ID NO: 236

SEQ ID NO: 313 - DNA, 702 bp, Homo sapiens
atggagacccctgcacagctgctgttcctgctgctgctgtggctgcccgacaccaccggcgacatccagatgacccagagccccagctccctgagcgccagcgtgggcgacagagtgaccatcacctgtagggccagccagagcatcaatagctacctggactggtaccagcagaagcctggcaaggcccccaagctgctgatctacgccgccagcagcctgcaaagcggcgtgcccagcagattcagcgggagcggcagcggcacagactttacactgaccatcagcagcctgcagcccgaggacttcgccacctactactgccaacagtattactccaccccctttaccttcggccccggaaccaaggtggagatcaagagaaccgtggccgcccccagcgtgttcatcttccccccctctgatgagcagctgaagagcggcaccgccagcgtggtgtgcctgctgaacaacttctatcccagagaggccaaggtgcagtggaaggtggacaacgccctgcagagcggcaacagccaggagagcgtgactgagcaggacagcaaggacagcacctacagcctgagcagcaccctgacactgtcaaaggccgattacgagaagcacaaagtgtacgcctgcgaggtgacccaccagggcctgagcagccccgtcaccaagagcttcaacaggggcgagtgc

SEQ ID NO: 314 - DNA, 994 bp, Homo sapiens
ggaaataagagagaaaagaagagtaagaagaaatataagagccaccatggagacccctgcacagctgctgttcctgctgctgctgtggctgcccgacaccaccggcgacatccagatgacccagagccccagctccctgagcgccagcgtgggcgacagagtgaccatcacctgtagggccagccagagcatcaatagctacctggactggtaccagcagaagcctggcaaggcccccaagctgctgatctacgccgccagcagcctgcaaagcggcgtgcccagcagattcagcgggagcggcagcggcacagactttacactgaccatcagcagcctgcagcccgaggacttcgccacctactactgccaacagtattactccaccccctttaccttcggccccggaaccaaggtggagatcaagagaaccgtggccgcccccagcgtgttcatcttccccccctctgatgagcagctgaagagcggcaccgccagcgtggtgtgcctgctgaacaacttctatcccagagaggccaaggtgcagtggaaggtggacaacgccctgcagagcggcaacagccaggagagcgtgactgagcaggacagcaaggacagcacctacagcctgagcagcaccctgacactgtcaaaggccgattacgagaagcacaaagtgtacgcctgcgaggtgacccaccagggcctgagcagccccgtcaccaagagcttcaacaggggcgagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 315 - protein, 214 aa, Homo sapiens; identical to SEQ ID NO: 23

SEQ ID NO: 316 - DNA, 935 bp, Homo sapiens
tcaagcttttggaccctcgtacagaagctaatacgactcactatagggaaataagagagaaaagaagagtaagaagaaatataagagccaccatggagacccccgcccagctgctgttcctgctgctgctgtggctgcccgacacaaccggcgacatccagatgacccagagccctagcagcctgagcgccagcgtgggcgacagagtgaccatcacctgcagagccagccagtccatcaacagctacctggactggtaccagcagaagcccggcaaggcccccaaactgctgatctatgctgccagctcactgcagagcggcgtgcctagcagattcagcggctctggcagcggaaccgacttcactctgaccatcagcagcctgcagcccgaggacttcgccacctactactgccagcagtactacagcacccccttcaccttcgggcccggcactaaggtggagatcaagagaaccgtggccgccccaagcgtgttcatcttccccccctccgacgagcagctgaagagcggcaccgccagcgtggtgtgcctgctcaacaacttctaccccagagaggccaaggtgcagtggaaggtggacaacgccctgcagtcgggcaacagccaggagagcgtgaccgagcaggacagcaaggacagcacctacagcctgagcagcactctgaccctgagcaaggctgattacgagaagcacaaggtctacgcctgcgaggtgacccaccagggcctcagcagcccagtgaccaagagcttcaacagaggagagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 317 - protein, 234 aa, Homo sapiens; identical to SEQ ID NO: 236

SEQ ID NO: 318 - DNA, 702 bp, Homo sapiens
atggagacccccgcccagctgctgttcctgctgctgctgtggctgcccgacacaaccggcgacatccagatgacccagagccctagcagcctgagcgccagcgtgggcgacagagtgaccatcacctgcagagccagccagtccatcaacagctacctggactggtaccagcagaagcccggcaaggcccccaaactgctgatctatgctgccagctcactgcagagcggcgtgcctagcagattcagcggctctggcagcggaaccgacttcactctgaccatcagcagcctgcagcccgaggacttcgccacctactactgccagcagtactacagcacccccttcaccttcgggcccggcactaaggtggagatcaagagaaccgtggccgccccaagcgtgttcatcttccccccctccgacgagcagctgaagagcggcaccgccagcgtggtgtgcctgctcaacaacttctaccccagagaggccaaggtgcagtggaaggtggacaacgccctgcagtcgggcaacagccaggagagcgtgaccgagcaggacagcaaggacagcacctacagcctgagcagcactctgaccctgagcaaggctgattacgagaagcacaaggtctacgcctgcgaggtgacccaccagggcctcagcagcccagtgaccaagagcttcaacagaggagagtgc

SEQ ID NO: 319 - DNA, 994 bp, Homo sapiens
ggaaataagagagaaaagaagagtaagaagaaatataagagccaccatggagacccccgcccagctgctgttcctgctgctgctgtggctgcccgacacaaccggcgacatccagatgacccagagccctagcagcctgagcgccagcgtgggcgacagagtgaccatcacctgcagagccagccagtccatcaacagctacctggactggtaccagcagaagcccggcaaggcccccaaactgctgatctatgctgccagctcactgcagagcggcgtgcctagcagattcagcggctctggcagcggaaccgacttcactctgaccatcagcagcctgcagcccgaggacttcgccacctactactgccagcagtactacagcacccccttcaccttcgggcccggcactaaggtggagatcaagagaaccgtggccgccccaagcgtgttcatcttccccccctccgacgagcagctgaagagcggcaccgccagcgtggtgtgcctgctcaacaacttctaccccagagaggccaaggtgcagtggaaggtggacaacgccctgcagtcgggcaacagccaggagagcgtgaccgagcaggacagcaaggacagcacctacagcctgagcagcactctgaccctgagcaaggctgattacgagaagcacaaggtctacgcctgcgaggtgacccaccagggcctcagcagcccagtgaccaagagcttcaacagaggagagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 320 - protein, 214 aa, Homo sapiens; identical to SEQ ID NO: 23

SEQ ID NO: 321 - DNA, 935 bp, Homo sapiens
tcaagcttttggaccctcgtacagaagctaatacgactcactatagggaaataagagagaaaagaagagtaagaagaaatataagagccaccatggagactcccgcccagctgctgttcctgttgctgctgtggctgcccgacaccacaggggacatccagatgactcagagtcccagcagcctgagcgccagcgtcggcgacagagttaccatcacctgccgggccagccagagcattaacagctacctggactggtaccagcagaagcctggaaaggcccccaagctgctgatctacgccgccagcagcctgcagagcggcgtgcctagcagattcagcggcagcggaagcggcaccgacttcaccctaaccatcagcagtctgcagccagaggacttcgcgacctactactgccagcagtactactcaacacccttcaccttcggccccggcaccaaggtggagatcaagagaaccgtggccgccccctctgtgttcatcttcccccccagcgacgagcagctgaagtccggcaccgcaagcgtggtgtgcctgctgaacaacttctaccccagagaggccaaggtgcagtggaaggtggacaacgccctgcagtccggcaacagccaggagagcgtgaccgagcaggacagcaaggactccacctacagcctcagcagcacactgaccctgagcaaggccgactacgagaagcacaaggtgtacgcctgcgaggtgacccaccagggcctgagcagccccgtgaccaagagcttcaacagaggagagtgctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 322 - protein, 234 aa, Homo sapiens; identical to SEQ ID NO: 236

SEQ ID NO: 323 - DNA, 702 bp, Homo sapiens
atggagactcccgcccagctgctgttcctgttgctgctgtggctgcccgacaccacaggggacatccagatgactcagagtcccagcagcctgagcgccagcgtcggcgacagagttaccatcacctgccgggccagccagagcattaacagctacctggactggtaccagcagaagcctggaaaggcccccaagctgctgatctacgccgccagcagcctgcagagcggcgtgcctagcagattcagcggcagcggaagcggcaccgacttcaccctaaccatcagcagtctgcagccagaggacttcgcgacctactactgccagcagtactactcaacacccttcaccttcggccccggcaccaaggtggagatcaagagaaccgtggccgccccctctgtgttcatcttcccccccagcgacgagcagctgaagtccggcaccgcaagcgtggtgtgcctgctgaacaacttctaccccagagaggccaaggtgcagtggaaggtggacaacgccctgcagtccggcaacagccaggagagcgtgaccgagcaggacagcaaggactccacctacagcctcagcagcacactgaccctgagcaaggccgactacgagaagcacaaggtgtacgcctgcgaggtgacccaccagggcctgagcagccccgtgaccaagagcttcaacagaggagagtgc

SEQ ID NO: 324 - DNA, 994 bp, Homo sapiens
ggaaataagagagaaaagaagagtaagaagaaatataagagccaccatggagactcccgcccagctgctgttcctgttgctgctgtggctgcccgacaccacaggggacatccagatgactcagagtcccagcagcctgagcgccagcgtcggcgacagagttaccatcacctgccgggccagccagagcattaacagctacctggactggtaccagcagaagcctggaaaggcccccaagctgctgatctacgccgccagcagcctgcagagcggcgtgcctagcagattcagcggcagcggaagcggcaccgacttcaccctaaccatcagcagtctgcagccagaggacttcgcgacctactactgccagcagtactactcaacacccttcaccttcggccccggcaccaaggtggagatcaagagaaccgtggccgccccctctgtgttcatcttcccccccagcgacgagcagctgaagtccggcaccgcaagcgtggtgtgcctgctgaacaacttctaccccagagaggccaaggtgcagtggaaggtggacaacgccctgcagtccggcaacagccaggagagcgtgaccgagcaggacagcaaggactccacctacagcctcagcagcacactgaccctgagcaaggccgactacgagaagcacaaggtgtacgcctgcgaggtgacccaccagggcctgagcagccccgtgaccaagagcttcaacagaggagagtgctgataataggctggagcctcggtggccatgcttcttgccccttgggcctccccccagcccctcctccccttcctgcacccgtaccccccaaacaccattgtcacactccagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 325 - protein, 214 aa, Homo sapiens; identical to SEQ ID NO: 23

SEQ ID NO: 326 - protein, 234 aa, Homo sapiens; identical to SEQ ID NO: 236

SEQ ID NO: 327 - protein, 20 aa, Homo sapiens
METPAQLLFLLLLWLPDTTG

SEQ ID NO: 328 - protein, 107 aa, Homo sapiens
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 329 - protein, 107 aa, Homo sapiens [sequence omitted]

SEQ ID NO: 330 - DNA, 702 bp, Artificial Sequence
  Treme_LC-CO01
atggagacgcccgcgcagctcctcttcctcctcctcctctggctccccgacaccaccggggatatccagatgacccagtccccgagctcactctccgccagcgttggggaccgggttaccattacctgccgggcgagccagagcatcaacagctacctcgactggtaccaacagaagcccggcaaggcccccaagctccttatttacgccgccagctccttacagagcggggtgccctccaggttcagcggctccggctccggcaccgacttcaccctaaccatcagcagcctccagcccgaagacttcgccacgtactactgccagcagtactacagcacccccttcaccttcgggcccggcaccaaggtggagatcaagaggaccgtggccgcccccagcgtgtttatcttcccgcccagcgacgagcagttaaagtccggcaccgcgagcgtggtgtgtctgctgaacaatttctacccccgggaggccaaggtgcagtggaaggtggataacgccctgcagagcggcaatagccaggagtccgtgaccgagcaggacagcaaggacagcacctactccctcagcagtaccctgactctgagcaaggccgattacgagaagcataaggtgtacgcctgcgaggtgacgcaccaagggctgagctcacccgtaaccaagagcttcaacaggggggagtgc

SEQ ID NO: 331 - DNA, 702 bp, Artificial Sequence
  Treme_LC-CO02
atggagacacccgcccagcttctcttcctcttgctcctttggctccccgacaccacgggggacatccagatgacccagtcgcccagcagcctcagcgccagcgttggcgacagggtcaccataacctgtagggccagccagagcatcaacagctacctcgactggtaccagcagaagccgggcaaggcgcccaagctcctcatatacgccgcctccagcctccagtccggcgtccccagccgcttctcgggctcgggcagcggcaccgacttcacgctcaccatctcctcgctccagcccgaggactttgccacctactactgtcagcagtactattcgacccccttcaccttcgggccggggaccaaggtggagatcaaacggaccgtggccgcccccagcgtctttatcttccctcccagcgacgagcagttgaaaagcgggaccgcctccgtggtgtgcctgctgaacaacttttatcccagggaggccaaagtgcagtggaaggtggacaatgccctgcagagtggcaactcccaggagagcgtgaccgagcaagactccaaggattccacctatagcctgtccagcaccctcaccctgtccaaggccgactatgagaagcataaggtctacgcctgcgaggtcacccaccaggggctgtccagccccgtgaccaagagcttcaacaggggcgagtgc

SEQ ID NO: 332 - DNA, 702 bp, Artificial Sequence
  Treme_LC-CO03
atggagacacccgcccagctcctcttcctcctccttctctggctccccgacaccaccggggatatccagatgacccagagccccagctccctatcggcctccgtaggcgaccgcgtcaccatcacgtgccgagcctcccaatccattaatagctatttggactggtaccaacagaagccgggcaaggcaccgaagctcttgatctacgccgccagctcgctccaaagcggcgtaccgagccgcttcagcggcagcggctccgggaccgatttcaccctcaccatcagcagcctccagcccgaggacttcgccacctactattgccagcagtattacagcacccccttcaccttcgggcccggaaccaaggtggagatcaagcgcaccgtggccgcccccagcgtgtttatctttcccccgagcgatgagcagctgaaaagcggcactgccagcgtggtgtgcctgctgaacaacttctacccgcgcgaggcgaaggtccaatggaaagtggacaatgccctgcagagcgggaatagccaggagtccgtgaccgagcaggacagcaaggacagcacctacagcctgtccagcaccctgacgctgtccaaagccgactacgagaagcacaaggtctacgcctgcgaggtgacccaccagggcctgagcagccccgtgaccaagagcttcaataggggggagtgc

SEQ ID NO: 333 - DNA, 702 bp, Artificial Sequence
  Treme_LC-CO04
atggagacgcccgcccagctcctcttcctcctcctcctctggctccccgacaccaccggggatatccagatgacccagtcccccagcagcctcagcgcctccgtcggggacagggtcaccatcacctgccgggcctcccagtccatcaattcctacctcgactggtaccagcagaagcccggcaaggcccccaagctcctcatctacgccgccagcagcttgcagagcggcgtcccttcccgtttcagcggcagcgggagcggcacggacttcaccctcaccatctcgagcctccaacccgaggatttcgccacctactactgccagcagtattacagcacccccttcacctttggcccagggaccaaggtggagataaagcggacggtggccgcccccagcgtgttcatcttcccgcccagcgacgaacagctgaaaagcgggaccgccagcgtggtgtgcctgctgaacaacttctaccccagggaggccaaggtacagtggaaggtggacaatgccctgcaaagcgggaacagccaggagagcgtgaccgagcaggactccaaagattccacctacagcctgtccagcaccctgactctatccaaggccgactacgaaaaacacaaggtgtacgcctgcgaagtcacccaccagggtctgagcagccccgtgaccaagagctttaacaggggggagtgc

SEQ ID NO: 334 - DNA, 702 bp, Artificial Sequence
  Treme_LC-CO05
atggaaacccccgcccagctcctcttcctcttactcctctggctccccgataccacaggggacatccagatgacccagagccccagctccctctccgccagcgtcggcgaccgggtcaccatcacgtgcagggccagccagagcatcaactcgtacctcgactggtatcagcagaagcccgggaaggcccccaagctcctcatctacgccgcctcctccctccagagcggcgtcccgtcgaggttcagcgggtcggggtcgggcaccgacttcaccctaaccatctccagcctacagccggaggactttgccacctactactgccagcaatactactccacgcccttcaccttcggccccggcaccaaggtggaaatcaagaggaccgtggccgccccctccgtgtttatcttcccgcccagcgacgagcagctcaagagcgggaccgccagcgtggtgtgcctgctcaataacttctacccccgggaggccaaagtgcagtggaaggtggacaacgcgctgcagagcggtaacagccaggagtccgtgacggagcaggactccaaggattcgacctactccctgagctcgacgctgaccctgagcaaggccgactacgagaagcacaaggtgtacgcctgcgaggtgacccaccaagggctgtccagccccgtgaccaaatccttcaacagaggggagtgc

SEQ ID NO: 335 - DNA, 702 bp, Artificial Sequence
  Treme_LC-CO06
atggagacgcccgcccagctcctctttcttttgctcctctggctcccggacacaaccggcgatatccagatgacccaatcccccagcagcctcagcgccagcgtcggggacagggtcaccatcacctgccgggccagccagagcatcaacagctatctcgactggtaccagcagaagcccggcaaggcccccaagcttctaatatacgccgccagctccctccaaagcggcgtaccgagccggttctccggcagcggcagcgggaccgacttcaccctcacgatcagcagcctccagcccgaagacttcgcgacctattactgccaacagtattacagcaccccgttcaccttcgggcccgggaccaaggtagagatcaagcgcaccgtggccgcaccctccgtgtttatcttccccccgagcgatgagcagctgaaaagcgggaccgccagcgtggtgtgcctgctgaataatttttaccccagggaagccaaggtgcagtggaaggtggacaacgccctgcagtccggcaactcccaggagtccgtgacggagcaggacagcaaggacagcacctacagcctgtccagcaccctcaccctgagcaaggccgactacgaaaagcacaaggtctacgcctgtgaggtgacgcaccaggggctgagctcccccgtcaccaagagcttcaatcgcggggagtgt

SEQ ID NO: 336 - DNA, 702 bp, Artificial Sequence
  Treme_LC-CO07
atggagactcccgcccagctccttttcctccttctcctctggttgcccgataccacgggcgacatccagatgacgcagagcccctccagcctcagcgcctccgttggcgatagggtcaccatcacgtgtcgagccagccagagcatcaactcctaccttgactggtaccagcagaagcccggaaaggcgcccaagctcctaatctacgccgccagcagcctccaaagcggcgtccccagccgcttcagcgggtccgggtccggcaccgacttcaccctcaccatatcgagcctacagcccgaggattttgcaacgtactattgccagcaatattatagcacccccttcaccttcggccccggcaccaaggtcgagattaagcggaccgtggcggcccccagcgtgttcatcttccctccgagcgatgagcagctgaaaagcgggaccgccagcgtggtctgcctgctgaacaacttctaccccagggaggccaaggtccagtggaaggtcgacaacgccctccagtctggcaacagccaggagtccgtgaccgagcaggacagcaaggactccacgtactccctgtcgagcaccctgaccctgagcaaggccgactacgagaagcacaaggtctacgcctgtgaggtgacccatcagggcctgtccagccccgtgaccaagagctttaacaggggagagtgc

SEQ ID NO: 337 - DNA, 702 bp, Artificial Sequence
  Treme_LC-CO08
atggagacacccgcccagctcctcttcctcctcctcctatggcttccagacaccaccggagacatccagatgacccagagccccagctccctctccgccagcgtcggcgaccgagtcaccatcacctgcagggcgagccagagcataaacagctacctcgactggtatcagcagaagccgggcaaagccccgaagctgctcatttacgccgccagcagtctccagagcggcgtacccagcaggttcagcggcagcggctccggcaccgacttcaccctcacgataagcagcctccagcccgaggacttcgcgacctactactgccagcagtattactccacgcccttcacctttggccccgggaccaaggtggagatcaagcgcaccgtggccgccccgagcgtgttcatcttcccacccagcgatgagcagctgaaaagcggcacggccagcgtcgtctgcctgctgaataatttctacccccgggaggccaaggtgcagtggaaagtggacaatgccctccagagcggcaacagccaggagagcgtgaccgagcaggactccaaggacagcacctacagcctgtcctcgacgctgaccctgtccaaggccgactacgagaaacacaaagtgtatgcctgcgaggtcacccaccagggactgagcagcccggtcacgaagtccttcaaccggggcgagtgc

SEQ ID NO: 338 - DNA, 702 bp, Artificial Sequence
  Treme_LC-CO09
atggagacgcccgcgcagctcctcttcctcctcctcctctggctccccgacaccaccggcgacatccagatgacccagtctccgagctccctctccgcgagcgtcggcgaccgggtcaccataacctgcagggccagccagagcatcaacagctatctcgactggtaccagcagaagcccggcaaggcccccaaactcctcatctacgccgcctccagcctccagagcggcgttcccagccggttcagcgggtccggcagcggcacggactttaccctcaccatcagcagcctccaaccggaggacttcgccacctactactgccagcagtattacagcacccccttcacctttgggcccggcactaaggtggagatcaagcgcaccgtggccgcccccagcgtgttcatcttcccgcccagcgacgaacagctgaagtccggcacagccagcgtggtgtgcctgctgaacaatttctaccccagggaagccaaggtgcagtggaaggtggacaacgccctgcagtccggcaacagccaggagtccgtgacggaacaggactccaaggactccacctacagcctatcctccactctcaccctgtccaaggccgactacgagaagcacaaggtgtacgcctgcgaggtgacccaccagggcctctccagccccgttaccaaaagcttcaaccggggagagtgc

SEQ ID NO: 339 - DNA, 702 bp, Artificial Sequence
  Treme_LC-CO10
atggagacgcccgcccagcttctcttcctcctcctcctctggcttccggacaccaccggcgacatccagatgacgcagtcgcccagcagcctcagcgcctccgtcggggacagggtcaccatcacctgcagggcctcccagtccatcaactcctacctcgactggtaccagcagaagccggggaaagcccccaagctcttaatctacgccgcgagcagcctccagagcggggtaccctcgaggttcagcggcagcggcagcggcacggacttcacccttaccatcagcagcctccagcccgaggatttcgccacctactactgtcagcagtactacagcacccccttcaccttcggccccggtaccaaggtggagatcaagaggaccgtggccgcccccagcgtcttcatcttcccgcccagcgatgagcagctgaaatccggcaccgccagcgtggtttgcctgctgaacaacttctaccctcgggaggccaaggtgcaatggaaggtggacaacgcgctgcagtcgggcaacagccaggaaagcgtgaccgagcaggactccaaggacagcacctatagcctgagctccacgctgaccctgtccaaggcggattacgagaagcacaaggtgtacgcctgcgaggtcacgcaccagggcctgtcaagtccggtgaccaaaagcttcaacaggggcgagtgc

SEQ ID NO: 340 - DNA, 702 bp, Artificial Sequence
  Treme_LC-CO11
atggagactcccgcccagctccttttcctcctcctcctctggctcccggacaccaccggcgatatccagatgacccagagcccgtcctccctaagcgccagcgtaggcgacagggtcacaatcacctgcagggccagccagagcatcaacagctatttggactggtaccagcagaagcccggcaaagccccaaagctcctaatctacgccgccagctcccttcagagcggcgtcccctcccggttttccggtagcggatccgggaccgactttaccttgaccatcagcagcctccagccggaagatttcgccacctattactgccagcagtactacagcacccccttcaccttcggccccggcaccaaggtggaaatcaaaaggaccgtggccgcccccagcgtgttcattttccctcccagcgatgagcagctgaagtcggggaccgcctccgtggtctgcctgctgaacaacttttatcccagggaggccaaggtgcaatggaaagtggacaacgccctgcaaagcgggaacagccaggagagcgtgaccgagcaggacagcaaggactccacctacagcctgtcctccaccctgaccctcagcaaggcggactacgaaaagcataaggtgtatgcctgcgaggtgacccaccaggggctgtccagcccggtgacgaagtccttcaacaggggggagtgc

SEQ ID NO: 341 - DNA, 702 bp, Artificial Sequence
  Treme_LC-CO12
atggaaacgcccgcccaactacttttcctcctcctcctctggctccccgacaccacgggcgacatccagatgacccaatcccccagcagcctcagcgccagcgtaggggatagggtcaccataacctgccgcgccagccagagcatcaatagctatctcgactggtaccagcagaagccggggaaggccccgaagctcctcatctacgccgcctcctcactccagagcggggtcccctctcgcttcagcggaagcgggagcggcaccgacttcacgctcaccatctcctccctccagcccgaggactttgctacctactactgccagcagtactatagcacccccttcaccttcgggcccggcaccaaggtggagatcaagaggacggtggccgccccctccgtgttcatattccccccgagcgacgagcagctgaaaagcggcaccgccagcgtggtgtgcctgctgaataacttctaccccagggaagccaaggtgcagtggaaggtggacaacgccctgcagagcggcaacagccaggagtccgtcaccgaacaggactcgaaggacagcacgtacagcctcagcagcaccctgaccctgagtaaggccgactacgagaagcataaggtgtacgcatgcgaagtcacccaccagggcctgagcagccccgtgacaaagtccttcaaccggggggagtgt

SEQ ID NO: 342 - DNA, 702 bp, Artificial Sequence
  Treme_LC-CO13
atggaaacccccgcccagctcctcttcctcctcctcctctggctccccgacaccacgggggacatccagatgacccagagccccagctccctctccgccagcgtcggagatcgggtcacgatcacctgccgggccagccagtccatcaacagctacctcgactggtaccagcagaagcccggcaaggcccccaagctccttatatacgccgcctccagccttcagagcggggtcccgagccgattcagcggctccgggtccggcacagatttcaccctcaccatcagctccctacagccggaagacttcgccacctactactgccagcagtactactcaaccccgttcacgtttggccccggtacaaaggtggagatcaaaaggaccgtcgccgcccccagcgtgttcattttcccgcccagcgacgagcagctgaaaagcggcactgccagcgtggtgtgcctgctcaacaacttttaccccagggaggccaaggtgcagtggaaagtggacaacgccctccagagcgggaacagccaggagagcgtcaccgagcaggacagcaaagacagcacgtactctctgtccagcaccctgaccctcagcaaggcggactatgagaaacacaaggtgtacgcctgcgaagtgacccaccagggcctgagcagcccggtgaccaagtccttcaacaggggcgagtgc

SEQ ID NO: 343 - DNA, 702 bp, Artificial Sequence
  Treme_LC-CO14
atggagactcccgcccagctcctctttcttctcctcctatggctccccgacaccacaggcgacatccagatgacccagagcccctccagcctcagcgcctcggtcggcgacagggtcaccatcacctgcagggccagccagtccatcaatagctacctcgactggtaccagcagaagcccggcaaggcccccaagctccttatctacgccgccagcagcctccagagcggggtcccgagccgtttcagcggcagcggtagcggcacggacttcaccctcaccatcagcagcctccagcccgaggattttgccacctactactgccagcagtattactccacccccttcaccttcggacccgggacgaaggtagagatcaagaggacggtggcggccccctcggtgttcatcttcccgcccagcgatgagcagctaaagtccggcaccgccagcgtggtgtgcctgctgaacaacttttacccgagggaggccaaggttcagtggaaggtggacaacgccctgcagagcgggaactcccaggagtccgtgacggagcaggacagcaaggacagcacctacagcctgagcagcaccctgaccctgagcaaggccgattacgagaagcacaaggtgtacgcctgcgaggtgacccatcagggcctgagctccccggtcaccaagagcttcaacaggggcgagtgc

SEQ ID NO: 344 - DNA, 702 bp, Artificial Sequence
  Treme_LC-CO15
atggaaacgcccgcccagctcctctttctcctcctcctctggctccccgacaccacgggcgacatccagatgacccagtcccccagcagcctctccgccagcgtcggcgatagggtcaccatcacctgccgggcgtcccaaagcatcaactcctacctggactggtaccagcagaagcccggcaaggcgcccaagctccttatctacgccgccagcagcctccagagcggcgtccccagcaggttctccgggagcgggtccggcaccgacttcaccctcacgatctccagcctccagcccgaggacttcgccacgtactattgtcagcagtactactccaccccgttcaccttcggcccgggcaccaaggtggagatcaagaggacggtggccgcgcccagcgtgttcatcttccctccctccgatgagcagctgaagtccggcaccgcctccgtggtctgtctgctgaacaacttctacccccgggaggccaaggtgcagtggaaggtggataatgccctgcagagcggcaacagccaggagagcgtgaccgagcaggactccaaggacagcacctacagcctcagctccaccctgaccctgagcaaggccgactacgagaagcacaaggtgtatgcctgtgaggtcacccatcaagggctgtcctcccccgtgaccaagagcttcaaccgtggcgagtgt

SEQ ID NO: 345 - DNA, 702 bp, Artificial Sequence
  Treme_LC-CO16
atggagacgcccgcccaattgctgttcttgctcctcctctggctccccgacacgacgggcgacatccagatgacccagagccccagctccctatccgccagcgtcggcgacagggtcaccatcacctgccgcgcctcccagagcatcaatagctacctcgactggtaccagcagaagcccggcaaggcccccaaactcctaatctacgccgcctcctcgctccaatccggagtccccagccggttcagcgggagcggcagcggaacggatttcaccctcacgatcagctccctccagccggaggactttgccacctactactgtcagcagtactactccacgccctttacctttgggcccggcaccaaggttgagatcaagcggacggtggccgcgcccagcgtgttcatcttcccgccctccgacgagcagctcaagagcgggaccgccagcgtggtctgtctgctgaacaacttctacccgagggaggccaaggtgcagtggaaggtggacaacgccctgcagagcggcaactcccaggagagcgtcaccgagcaagactcgaaggacagcacctactcactgtccagcaccctgaccctgtcgaaggccgactatgagaagcacaaggtctacgcctgcgaggtgacccaccagggccttagcagcccggtgaccaagagcttcaacaggggcgagtgc

SEQ ID NO: 346 - DNA, 702 bp, Artificial Sequence
  Treme_LC-CO17
atggagacacccgcccagcttctcttcctcctcctcctctggctccccgacaccaccggcgacatccagatgacccaaagccccagcagcctctccgccagcgtcggcgacagggtcaccataacttgccgggcctcccagtccatcaatagctacctagactggtatcagcagaagcccggcaaggcccccaaattactcatctacgccgccagctccctccagtccggcgtccccagccggttcagcgggagcggctcgggcaccgacttcacgctcaccatttccagcctccagccggaggacttcgcgacatactactgccagcagtactacagcacccccttcacgttcgggcccggcaccaaggtggagatcaagcggaccgtggccgccccgagcgtgttcatcttcccgccctccgatgagcagctgaagtccggcaccgcttccgtggtgtgtctcctgaacaacttttacccaagggaggccaaggtgcagtggaaagttgacaacgctctgcagagcggcaacagccaggagagcgtgaccgagcaggacagcaaagactccacctacagccttagcagcacactgaccctgtccaaggccgactacgagaagcacaaggtgtacgcctgtgaggtgacccaccaggggctgtccagccccgtgaccaagagcttcaataggggggagtgc

SEQ ID NO: 347 - DNA, 702 bp, Artificial Sequence
  Treme_LC-CO18
atggagacgccggcccagctcctctttctcctcctcctctggctcccggacacgacgggggatatccagatgacccagagccccagctccctcagcgccagcgtcggcgatcgagtcacgatcacctgccgggcgtcccagagcatcaacagttacctcgactggtaccagcagaagcccggcaaggcccccaagctcttaatctacgccgccagcagcctccagagcggcgttccgtccaggttcagcggctccggctcggggaccgacttcaccttgaccatcagcagcctccagcccgaggacttcgccacctactactgtcagcagtactattccaccccattcaccttcggccccggcaccaaggtcgagatcaagcgaaccgtggccgcccccagcgtgtttatcttcccgcccagcgacgagcagctgaaaagcggcaccgccagcgtggtgtgcctgctgaacaacttctacccgagggaggccaaggtgcagtggaaggtggacaatgccctgcagagcggcaactcccaggagagcgtgacggagcaggacagcaaggactccacctacagcttgtcaagcaccctgacgcttagcaaggctgactatgagaagcacaaggtttacgcctgcgaagtgacccatcaagggctgagctcacccgtgacgaaaagcttcaataggggtgagtgc

SEQ ID NO: 348 - DNA, 702 bp, Artificial Sequence
  Treme_LC-CO19
atggagacgcccgcccagctcctcttcctcctcctcctctggctccccgataccaccggcgacatccagatgacccagtcaccctccagcctcagcgcgagcgtcggggatcgagtaactatcacctgccgggccagccagagcatcaacagctacctcgattggtaccagcaaaagcccggcaaggcccccaaattactcatatacgcggccagctccctccagtccggagtcccgtcccggttcagcggcagcgggagcgggaccgacttcaccctcacaatctcaagcctccagcccgaggacttcgccacgtactattgccagcagtactacagcacccccttcaccttcggccccggcaccaaggtggagatcaagaggacggtggccgcgcccagcgtcttcatctttcccccctccgacgaacagctgaaaagcgggaccgcctcggtggtgtgcctgctgaacaacttttacccaagggaggccaaggtgcagtggaaggtggacaacgccctccagtccgggaactcccaggagtccgtgaccgagcaggactctaaggacagcacctactccctgtccagcacgctgacgctcagcaaggcggactacgagaagcacaaggtgtacgcctgtgaggtgacccaccagggcctgtcgagccccgtcaccaagagcttcaacaggggcgagtgt

SEQ ID NO: 349 - DNA, 702 bp, Artificial Sequence
  Treme_LC-CO20
atggagactcccgcccagctcctctttctcctcctcctctggctccccgacacgaccggggacatccaaatgacccagagccccagcagcctcagcgcaagcgtaggcgatcgggtcaccatcacctgcagggccagccagtccatcaactcgtacctcgactggtaccagcagaagcccggcaaagctcccaagctcctcatatacgccgctagctccctccagagcggggtccctagtaggttcagcgggtccgggagcggcaccgacttcacgctcaccatctccagcttgcagcccgaggacttcgccacttactactgccagcagtactacagcaccccctttacgtttggccccggcaccaaggtggagatcaagaggaccgtggccgcccccagcgtgttcatcttcccgcccagcgacgagcagctgaagtcgggcaccgcttcagttgtctgtctgctgaacaacttttacccccgcgaggccaaggtgcagtggaaggtggacaacgccctccagagcgggaacagccaggagagcgtgacggagcaggactccaaggatagcacctacagcctgagttcgaccctcacgctgagcaaggccgactacgagaaacacaaggtgtatgcctgcgaggtgacccaccaggggctttcctcccccgtcaccaagagcttcaataggggggagtgc

SEQ ID NO: 350 - DNA, 702 bp, Artificial Sequence
  Treme_LC-CO21
atggagacgcccgcgcaacttctcttcctactcctcctctggctccccgacaccaccggggacatccagatgacccagtccccctcgagcctctcagcctccgtaggggaccgggtcaccatcacttgcagggccagccaaagcatcaacagctacctcgactggtaccagcagaagcccgggaaggccccgaagctcctcatctacgccgccagcagcctccagtccggcgtacccagcaggttctccggctccgggagcggaaccgacttcacactcaccatctcgtccctccagcccgaggattttgccacctactactgtcagcagtactacagcaccccctttacctttggccccggcaccaaagtggagatcaaacggaccgtggccgccccctcggtgttcatattcccgccaagcgacgagcagctgaaaagcggcacggcctccgtggtgtgcctgctgaacaacttctatccccgcgaagccaaggtgcagtggaaggtcgataacgccctgcaatcagggaacagccaggagtcggtgaccgagcaggacagcaaagatagcacctactccctgagcagcaccctgaccctgtccaaggcggactacgagaaacataaggtgtacgcgtgcgaggtgacccatcagggactgagcagccccgtgacgaagtccttcaaccggggcgagtgc

SEQ ID NO: 351 - DNA, 702 bp, Artificial Sequence
  Treme_LC-CO22
atggagacacccgcccagctcctcttcctcctcttgctctggctccccgacacgaccggggacatccagatgacgcagagcccttcttcgttgtccgcctccgtcggcgaccgggtcaccatcacctgcagagcctcccagagcatcaatagctacctcgactggtaccagcagaagccgggcaaggcccccaagctcctcatctacgccgccagcagcttacagagcggggtacccagccggttctcggggagcgggagcggcaccgacttcaccctcaccatcagcagcctccagcccgaggacttcgccacctattactgccagcagtactatagcacccccttcacctttgggccgggcacgaaggtggaaattaagcggaccgtggccgcccccagcgtgttcatcttcccaccctccgacgagcagctcaagagcggaaccgccagcgtggtgtgtctgctgaataacttctacccgcgcgaggccaaggtccagtggaaggtggacaacgccctgcagagcgggaacagccaggagtccgtgaccgagcaggacagcaaggacagcacgtacagcctgtccagcaccctgaccctgtccaaggccgactatgagaagcacaaggtgtatgcctgcgaggtgacccaccaagggctgtccagccccgtgaccaagtccttcaacaggggtgagtgc

SEQ ID NO: 352 - DNA, 702 bp, Artificial Sequence
  Treme_LC-CO23
atggagacgcccgcgcaactcctcttcctcctcctcctctggttacccgacaccacgggcgatatccagatgacccagtcgcccagcagcttgtccgccagcgtaggggacagggtcaccatcacctgccgggcatctcagagcatcaactcctacctcgactggtaccagcagaagcccggcaaggcccccaagctcttgatctacgccgccagcagcctccagagcggcgtcccctcgcggttcagcgggagcggcagcgggacggacttcaccctcaccataagctctctccagccagaggatttcgccacgtactactgtcagcagtattacagcaccccgttcacgttcggccccggcacgaaggtggagatcaagcggaccgtggccgccccctcggtgttcatctttcccccctccgacgaacagctgaagtcgggcaccgccagcgtggtgtgcctgctgaacaacttctacccgcgcgaagccaaggtgcagtggaaggtagacaatgcactgcagtccggcaacagccaagagtccgtaaccgagcaggactccaaggacagcacatacagcctgagcagtaccctcacgctcagcaaggcagactacgagaagcacaaggtctatgcctgcgaggtgacccaccagggcctgagctcccccgtgaccaagagctttaacaggggcgagtgc

SEQ ID NO: 353 - DNA, 702 bp, Artificial Sequence
  Treme_LC-CO24
atggagacgcccgcccagctcctctttctcctcctcctctggctccccgacaccacgggggacatccagatgacccagagcccctccagcctcagcgcctcggtaggcgacagggttaccatcacctgccgggcctcccagtcgatcaattcctacctcgactggtaccagcagaagccgggcaaggcccccaagctcctcatttacgccgcgagctccctccagtccggcgtccccagccggttttccggctcgggcagcggcaccgattttaccctcacgatctccagcttgcagcccgaggacttcgccacctactactgtcagcagtattactccaccccgttcacctttggccccgggaccaaagtggagatcaagcgtacggtcgccgcccccagcgtgttcattttcccacccagcgacgagcaactcaagtccggcaccgccagcgtggtgtgcctcctgaacaacttttatccccgcgaggccaaggtgcagtggaaggtggacaacgccctgcaaagcggcaacagccaggaaagcgtgacggagcaggactccaaagactccacgtacagcctctccagcaccctgaccctgagcaaagcagactacgagaaacacaaggtgtacgcctgcgaggtgacccaccaggggctcagcagccccgtgaccaagagctttaaccggggtgagtgc

SEQ ID NO: 354 - DNA, 702 bp, Artificial Sequence
  Treme_LC-CO25
atggaaacgcccgcccagcttctcttcctcctactcctctggctccccgacaccaccggggacatccagatgacccagagcccctccagcctctcggcctcggttggcgacagagtaaccataacctgccgggcctcccagagcatcaacagctacctcgactggtaccagcagaagcccggcaaggcgcccaagctcttgatttacgcggcaagcagcttgcagtccggcgtcccctcacggttcagcgggagcgggtcaggcaccgactttacgctcaccatctcgagcctccagccagaggactttgccacctactactgccaacagtattacagcaccccgttcaccttcggcccaggaaccaaggtggagatcaagcgcaccgtggccgcccccagcgtcttcatcttcccgcccagcgacgagcagctgaaaagcggcaccgcctccgtggtgtgcctgctgaataacttttacccgcgggaggccaaggtgcagtggaaggtggacaacgccctccagagcgggaactcccaggagagcgtgaccgaacaggacagcaaggactccacgtactcccttagcagcaccctgaccctgtcgaaggccgattacgagaagcacaaggtgtacgcctgcgaggtgacccaccagggtttatcctcgcccgtgaccaagtccttcaaccgaggcgagtgc

SEQ ID NO: 355 - protein, 471 aa, Homo sapiens; identical to SEQ ID NO: 235

SEQ ID NO: 356 - protein, 20 aa, Homo sapiens
METPAQLLFLLLLWLPDTTG

SEQ ID NO: 357 - protein, 125 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 358 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 359 - DNA, 1413 bp, Artificial Sequence
  Treme_HC_IgG2-CO01
atggagacgccggcccagctattgttcctcctcctcctctggctccccgacaccaccgggcaggtccagctagttgagagcggcgggggcgtcgtccagcccggcaggtccctcaggctcagctgcgccgcctcggggttcaccttcagctcctacggcatgcactgggtcaggcaggcccccggcaaggggctcgagtgggtcgccgtcatctggtacgacggtagcaataagtattacgccgatagcgtcaagggccggtttaccataagcagggacaacagcaagaacaccctctacctgcagatgaacagtctgagggccgaggataccgccgtgtactactgtgctcgggaccccaggggtgccactctgtactactactactacggcatggacgtgtggggccagggcacgacggtgaccgtgagctccgcctccaccaagggcccctctgtgttcccgctggccccctgcagccggtccaccagcgaaagcaccgccgccctgggctgcctggtgaaggactacttccccgagcccgtgaccgtcagctggaacagcggagctctgaccagcggcgtgcacacctttcccgccgtgctccagagcagcggcttgtacagcctgtccagcgtggtgaccgtgccgagcagcaacttcggcacccaaacgtacacctgcaacgtggaccataagcccagcaacaccaaggtggacaagaccgtggagcggaaatgctgcgtggagtgcccaccctgtcccgccccgccggtggccggcccctccgtgtttctgtttccgcccaagccgaaggacaccctgatgatcagccgcaccccggaggtgacctgcgtggtggtggacgtgagccacgaggaccccgaggtgcaattcaactggtacgttgatggcgtggaggtccacaacgccaagaccaagcccagggaggaacagtttaactccaccttccgggtcgtgagcgtgctgactgtggtgcaccaggactggctgaacggcaaggagtacaagtgcaaggtgagcaacaaggggctgcccgcccccatcgagaagacgatctccaagaccaagggccagccccgcgaaccccaagtgtacaccctgccccccagccgggaggaaatgaccaaaaaccaggtgagccttacctgtctggtgaagggcttttaccccagcgacatcgccgtggaatgggagtcgaacggccagccggagaacaactataaaaccacccctcccatgctggacagcgacggctctttcttcctgtatagcaagctgactgtggacaagagccgctggcagcagggcaacgtgttctcatgctccgtgatgcacgaagccctacacaaccactacacccagaaaagcctcagcctcagccccggcaag

SEQ ID NO: 360 - DNA, 1413 bp, Artificial Sequence
  Treme_HC_IgG2-CO02
atggagacgcccgcccaactcctctttctcctcctcctctggctccccgacacgaccggccaagtccagctcgtcgagagcggcggcggcgtcgtccagccggggaggtccctcaggctctcgtgcgccgccagcggcttcaccttcagttcctacggcatgcactgggtcaggcaggcccccggcaagggtctggagtgggtcgccgtcatctggtacgacggcagcaacaagtactacgccgacagcgtaaagggccggttcaccatcagcagggacaattcgaagaacaccctgtatctgcagatgaactccctcagggccgaggacaccgccgtgtactactgcgccagggaccccaggggggccaccctctactattactactacggcatggacgtgtgggggcaggggaccaccgtcaccgtgtccagcgccagcacgaaggggcccagcgtcttcccgctggccccctgcagcaggagcaccagcgagagcaccgctgccctggggtgcctggtgaaggactactttccggagcccgtgacagtgagctggaacagcggcgccctgaccagcggggtgcacacgttccccgcagtgctgcagagcagcgggctgtacagcctctccagcgtggtgaccgtgcccagcagcaactttggcacccagacgtacacctgcaacgtggaccacaagccctcaaataccaaggtcgacaagaccgtggagcggaagtgctgtgtggagtgcccaccctgcccagccccgcccgtggccggcccctccgtgttcctgtttcccccgaagccgaaggacaccctcatgatctccaggacccccgaagtgacctgcgtggtggtggacgtgagccacgaggaccccgaggtgcagttcaactggtacgttgacggggtggaggtgcacaacgccaagaccaagccccgcgaggagcaattcaacagcaccttcagggtggtgagcgtactgaccgtagtgcaccaggactggctgaacggcaaggagtacaagtgtaaggtgagcaacaagggcctgcccgcccccatcgaaaagacaatttccaagacgaaggggcaacccagggagccccaggtgtataccctgccccccagcagggaggagatgacgaagaaccaggtgtcgctgacctgtctcgtcaagggcttctatccgagcgacatcgccgtggagtgggagtcgaacgggcaacccgagaacaactataagaccacgccccccatgctggactccgacgggagcttcttcctctacagcaagctgaccgtggacaaaagccggtggcagcaggggaacgtgttcagctgctccgtgatgcacgaggcgctgcataatcactacacccagaagtccctgagcctgagcccgggcaag

SEQ ID NO: 361 - DNA, 1413 bp, Artificial Sequence
  Treme_HC_IgG2-CO03
atggagacgccagcccagctcctctttctcttactcctctggctaccggacaccaccggccaggtccagctcgtcgagagcggcggcggcgtcgtccagccgggcaggtccctcaggctcagctgcgccgccagcggcttcaccttcagctcctacggcatgcactgggtaaggcaggcgccgggcaagggcctagagtgggtcgccgttatctggtacgacgggagcaacaaatactacgccgacagcgtcaagggaaggttcaccatcagcagggataactccaaaaataccctctacctccagatgaactccctgagggcggaggataccgcggtgtactactgcgccagggatcccaggggcgccaccctctactattactactacggcatggatgtatggggccaggggaccaccgtgaccgtcagctccgcctccaccaaaggcccgtccgtgttccccctggcgccctgcagcaggagcaccagcgagagcaccgctgccctgggctgcctggtgaaggactacttcccggagcccgtgaccgtgtcatggaactccggggccctgaccagcggcgtccacaccttccccgccgtgctgcagtcctccggactgtactcgctgagctccgtggtgacggtccccagctccaatttcgggacccagacctacacctgcaacgtggaccacaagcccagcaacaccaaggtggacaagaccgtggaacgaaagtgctgcgtcgagtgtcccccctgccccgccccgcccgtcgccggccccagcgtgttcctgttcccacccaagcccaaggacacgctgatgatctcccggacccccgaggtgacctgcgtggtcgtggacgtgtctcacgaggaccccgaggtgcagttcaattggtacgtggacggggtcgaggtccacaacgccaagactaagccccgggaggagcagttcaacagcacgttcagggtggtgtccgtgctgaccgtcgtccaccaggactggctcaacggcaaggagtacaagtgcaaggtttccaacaaggggctccccgcccccatcgagaagacgatttccaagaccaagggccaaccccgcgagccccaggtgtacaccctgccccccagcagggaggagatgaccaaaaaccaggtgtccctgacctgcctggtgaaggggttctacccgagcgacatcgccgtggagtgggagagcaacgggcagcccgagaacaactacaagaccaccccgccgatgctggatagcgacgggagcttcttcctctactccaagctcaccgtggacaagagccgctggcagcagggcaacgtgttcagctgcagcgtgatgcacgaggccctgcataaccactacacccagaaaagcctgtccctgagccccggcaag

SEQ ID NO: 362 - DNA, 1413 bp, Artificial Sequence
  Treme_HC_IgG2-CO04
atggagacacccgcccaactcctctttttgctcctcctttggctccccgacaccaccggccaggtccagctcgtcgagagcggcggcggggttgtccagccgggccgctccctcaggctcagctgtgccgccagcggcttcactttcagcagctacggcatgcactgggtcaggcaggcccccggcaagggcttggagtgggttgccgttatctggtacgacggcagcaacaagtactacgccgattccgtcaagggccgcttcaccataagcagagacaacagcaaaaacacgctctatctgcagatgaacagcctgcgggccgaggacaccgccgtgtattactgtgccagggatccgcgcggcgccaccctgtactactattactacgggatggacgtgtggggccagggcaccactgttaccgtctccagcgccagcacgaaggggcccagcgtctttccgctggccccctgcagccggagcacgtccgagagcactgccgccctggggtgcctggtgaaggactacttccccgagcccgtgaccgtctcatggaactccggcgctctgacctccggggtgcataccttccccgccgtgcttcagtccagcggcctgtacagcctgagctccgtggtgaccgtgccctccagcaactttgggactcagacctacacctgcaacgtcgaccacaagccaagcaacaccaaggtagacaagaccgtggagcggaagtgctgcgtggagtgcccgccctgccctgcccctcccgtcgccggcccaagcgtgttcctgttcccacccaagcccaaggataccctgatgatttcccggacccccgaggtgacctgcgtcgtggtggacgtcagccacgaagaccccgaggtgcagttcaattggtacgtggatggcgtggaagtgcacaacgccaagacgaagccaagggaggagcagtttaactccaccttccgggtggtgagcgtgctcaccgtcgtccaccaggactggctcaatgggaaggagtacaagtgcaaggtgtccaataagggcctgcccgcccccatcgagaaaacgatcagcaagaccaaggggcagccaagggagccccaggtgtacaccctcccacccagccgggaggagatgaccaagaatcaggtcagcctcacttgcctggtgaagggcttttacccctccgacatcgccgtggagtgggagagcaacggccagcccgaaaataactacaagaccaccccaccgatgctggatagcgacggcagcttcttcctgtacagcaagctgaccgtggacaagtcccgctggcagcagggcaacgtgttctcgtgcagcgtgatgcacgaggctctgcataaccactacacccagaaatccctctccctgtcccccggcaag

SEQ ID NO: 363 - DNA, 1413 bp, Artificial Sequence
  Treme_HC_IgG2-CO05
atggagacacccgcccagctcctcttcctcctcctattgtggctcccggataccaccgggcaggtccagctggtggagagcggcgggggcgtcgtacagcccggcaggagcctcaggctcagctgcgccgccagcggcttcaccttcagcagctacggcatgcactgggtcaggcaggccccagggaaggggttggagtgggtcgccgtcatctggtacgacgggagcaacaaatactacgcagacagcgtcaagggccgattcaccattagccgggataacagcaagaacaccctctacctgcaaatgaacagcctgagggccgaggacacggccgtatactattgcgccagggacccccgtggcgccacactgtactattactactacggtatggacgtttgggggcagggtactaccgtgaccgtctcgagcgccagcaccaaaggccccagcgtgttccccctggccccctgctccaggagcaccagcgagtccaccgccgcgctgggctgcctggtgaaggattacttccccgagcccgtgacggtgagctggaacagcggggccctgacaagcggagtgcataccttcccggcagtgctgcaaagcagcggcctctacagcctgagcagcgtcgtgaccgtgcccagcagcaacttcggcacacagacctacacctgcaacgtggaccacaagcccagcaacacgaaggtggacaagaccgtggagaggaagtgctgcgtggaatgcccaccctgccccgccccgcccgtggccggccccagtgtgtttctgttcccacccaagccgaaggataccctgatgatctcccggacccccgaggtgacctgcgtggtggtggatgtgagccacgaggaccccgaagtgcagttcaactggtatgtcgacggcgtggaggtacacaatgccaagaccaagcccagggaggaacagttcaacagcacgtttcgggtggtgagcgtgctcactgtcgtccaccaagactggctgaacggcaaggagtacaagtgcaaggtgagcaacaaggggctgcccgcgcccatcgagaaaaccatctccaagaccaaaggccagccgcgggagccccaggtgtataccctgccaccgagcagggaggagatgaccaaaaatcaagtgtcgctgacctgcctcgtcaagggcttttacccaagcgatatcgcggtggagtgggaaagcaacggccagcccgaaaacaactacaagaccaccccgcccatgctcgactcagatggtagcttctttctgtacagcaagctgaccgtggacaagagcaggtggcagcagggcaacgtgttctcctgcagcgtgatgcacgaggccctgcacaaccactatacccaaaagagcctaagcctgagccccggcaag

SEQ ID NO: 364 - DNA, 1413 bp, Artificial Sequence
  Treme_HC_IgG2-CO06
atggagacgcccgcccagctcctcttcctcctattgctgtggctccccgataccaccgggcaggtccagctcgtagagtcgggcggcggagtagtccaaccggggaggagcctcaggctcagctgcgcagcctccggcttcaccttcagcagctacggcatgcactgggtacggcaggccccgggaaagggcctcgagtgggtcgccgtcatctggtacgacggcagcaacaagtactacgccgacagcgtcaagggccgcttcaccatctccagggataacagcaagaacaccctttacctgcagatgaacagcctcagggccgaggacaccgccgtgtattactgcgcgcgggatccccgcggcgcgacgctgtactactactactatgggatggacgtgtggggccagggcactaccgtcaccgtgtccagcgctagcacgaagggcccgtccgtgttccccctggccccctgctcccggagcacctccgagagcaccgccgccctgggttgcctggtgaaggactatttccccgagcccgtcaccgtgagctggaacagcggcgccctcacatccggcgtgcataccttcccggccgtgctccagagcagcggcctgtattcactgtcgagcgtggtgaccgtgcccagcagcaactttggcacccagacgtacacctgcaacgtggaccacaagccgagcaacaccaaggtggacaagaccgtggagcggaagtgctgcgtggagtgtcccccgtgtcccgccccgcccgtagccggcccctccgtattcctcttccctcccaagcccaaggacacgctcatgatctcgcggacacccgaggtgacctgcgtggtggtggacgtcagccacgaggatcccgaggtgcagttcaactggtatgtggacggagtggaggtgcataacgccaaaaccaagcccagggaagaacagttcaacagcaccttcagggtggtgagcgttctgaccgtcgtgcaccaggactggctcaacggcaaggagtacaagtgtaaggtgtccaacaaggggctgcccgcccccatcgagaagaccatctcgaaaaccaaaggccagccccgcgagccccaggtgtacaccctccccccgtcccgggaggagatgaccaagaaccaggtaagcctgacctgtctggtgaagggcttctaccccagcgacatcgctgtggagtgggagagcaacgggcagcccgagaataactacaaaaccaccccgcccatgctggacagcgacggaagctttttcttgtactccaagctgaccgtcgacaagagccggtggcagcagggcaacgtgttcagctgcagcgtgatgcacgaggccctgcacaaccactacacccagaaaagcctcagcctgagccccgggaag

SEQ ID NO: 365 - DNA, 1413 bp, Artificial Sequence
  Treme_HC_IgG2-CO07
atggaaaccccggcccaactcctcttccttcttctcctctggctccccgacaccaccggccaggtccagctcgttgagtccggcggcggcgtagtccagcccgggcgttcgctcaggctcagctgcgccgcgtccggcttcacctttagcagctacggcatgcactgggtacggcaggcccccggcaaagggctcgagtgggtcgccgtcatttggtacgacggcagcaataagtactacgcagacagcgtcaagggaaggttcaccatcagcagggataactccaagaataccctctacctgcaaatgaactccctgcgggccgaggacaccgccgtgtactattgcgcccgggaccccaggggggccaccctgtactactactactacggcatggatgtgtggggccagggcaccaccgtgaccgtcagctcagccagcaccaagggccccagcgtgttccccctcgccccgtgtagccggagcacctccgagagcaccgcggccctggggtgcctggtgaaggactacttccccgaacccgtcaccgtgagctggaacagcggggccctgaccagcggagtgcacaccttcccggccgtgctacagagcagcggcctgtactccctgtcatccgtggtgaccgtgccctcgtccaacttcggcacccagacctatacctgcaacgtggaccacaaaccctccaacaccaaggtggacaagaccgtggagaggaagtgctgcgtggaatgccctccctgccccgcgcccccagtggccgggccctccgtcttcctgttccccccgaagccgaaagatacgctgatgatcagcaggacccccgaggtgacctgtgtggtggtggacgtgagccacgaagatcccgaggtgcagtttaactggtacgtcgacggggtggaagtccacaacgccaagaccaagcccagagaggaacagttcaacagcacgttccgggtggtgtcggtgctcaccgtggtccaccaggattggctgaacggaaaggagtataagtgcaaggtgagcaacaaggggctcccggccccgatcgagaagaccatctccaaaaccaaagggcagccccgggaaccccaggtatacaccctgccaccaagcagggaggagatgaccaagaaccaggtgagcctgacctgtctggtgaagggcttctaccccagcgacatcgcagtggagtgggagagcaacggccagcccgagaacaactacaagacaacaccgcccatgctggacagcgacggctccttttttctgtactccaagctgacggtggacaagagccgctggcagcagggcaacgtgttcagctgcagcgtgatgcatgaggccctgcacaaccactacacccagaagtccctgtccctcagcccgggcaag

SEQ ID NO: 366 - DNA, 1413 bp, Artificial Sequence
  Treme_HC_IgG2-CO08
atggagacgcccgcccagctcctcttcctccttttgctgtggctccccgacaccacgggccaggtccagctcgtagagtccggcggcggcgtcgtacagcccggccggagcctcaggttgtcgtgcgccgcctccggtttcaccttctccagctacgggatgcattgggttcggcaggcccccgggaagggcctagagtgggtcgccgtcatctggtacgacggctccaataaatactacgccgacagcgtcaaggggcgattcactatcagcagggacaacagcaagaacaccctctacctgcagatgaacagcctgcgcgcggaggacaccgcggtgtactattgcgccagggacccgcgaggcgccaccctgtactactactactacggcatggacgtgtggggtcagggcaccaccgtgaccgtgagcagcgccagcacgaagggtcccagcgtgttccccctggcgccctgctccaggagcacgtccgagagcaccgccgcactgggctgcctggtgaaggattacttcccggagcccgtgaccgtcagctggaactccggggccctcacgagcggcgtgcataccttccccgccgtcctgcagagctccggcctgtacagcctctcctccgtggtcaccgtcccaagcagcaatttcggcacccagacctacacctgcaacgtggatcataagcccagcaataccaaggtggacaagaccgtggagcgcaagtgctgtgtcgagtgccctccctgcccggccccacccgtcgccggcccgagcgtgttcctcttccctcccaagcccaaggacacgctgatgatcagccgcacccccgaggtgacctgtgtcgtcgtggatgtgagccacgaggatcccgaggtgcagtttaactggtacgtagacggcgtggaggtacacaacgcgaagaccaagcctagggaggagcagtttaactccaccttccgggtggtgagcgtcctgacggtggtgcatcaggactggctcaatggtaaggagtacaagtgcaaggtgagcaacaagggcttgcccgcccctatcgagaagacaatcagcaagaccaagggccagccccgggagccgcaggtgtacaccctgcccccttcgagggaggaaatgaccaagaaccaggtgagcctgacctgtctggtgaagggtttttaccccagcgacatcgcggtggagtgggagagcaacgggcagcccgagaacaactataagaccaccccacccatgctggacagcgacgggagcttcttcctgtacagcaagctgaccgtcgacaagtcccgatggcagcagggcaacgtgttcagctgcagcgtgatgcacgaggcgctgcacaatcattacacccagaaaagcctgagcctgagccccggcaaa

SEQ ID NO: 367 - DNA, 1413 bp, Artificial Sequence
  Treme_HC_IgG2-CO09
atggagacgcccgcccagctcctcttcctcctcctcctctggctaccggacaccaccgggcaggtccagctagtcgagtcgggcggcggggtcgttcagcccggccgtagcctccggctcagctgcgccgcctccggcttcaccttcagtagctacggtatgcattgggtccgccaagcccccggcaagggcctcgagtgggtcgccgtcatctggtacgacggctccaataagtactacgcggatagcgtcaaagggcggttcaccatcagccgcgacaacagcaaaaacaccctctacctgcagatgaacagcctgagggcggaggacaccgccgtgtactactgcgccagggaccctcgtggggccacgctgtattactactactatggcatggatgtgtgggggcagggcaccaccgtgaccgtcagctccgccagcaccaaggggcccagcgtcttcccgctggctccgtgctcccggtccacctccgagagcaccgcagccctgggctgcctggtgaaagactactttcccgaacccgtgaccgtcagctggaacagcggcgccctgacgagcggggtgcacaccttccccgcagtgctgcagagcagcggcctgtactcgctctcctccgtggtcacggtgcccagttccaacttcggaacccagacatatacgtgcaacgtggaccacaagcccagcaacaccaaggtggacaaaaccgtggagcggaaatgctgcgtggagtgcccgccctgtcccgcccctcccgtcgccggacccagcgtgtttctgttcccgcccaagcccaaggacacccttatgatctcgcgcacccctgaggtaacctgcgtcgtggtagacgtgtcccacgaggaccccgaggtgcagttcaactggtacgtggatggcgtggaggtccacaacgccaaaaccaagccgcgggaggaacaattcaacagcaccttcagggtggtgtccgtgctgaccgtggtgcaccaggactggctgaacggaaaggagtacaagtgcaaggtgtccaacaagggcctgcccgcgcccatcgagaagacgatcagcaaaaccaagggccagcctagggaaccccaggtctacaccctgccccccagcagggaggagatgaccaagaaccaggtaagcctgacctgcctggtgaagggtttctatccgtccgacatcgcagtggagtgggaaagcaacggccagcccgagaacaactataagaccaccccacccatgctggacagcgacggcagcttcttcctgtacagcaagctgactgtcgacaaaagcaggtggcagcagggcaacgtgtttagctgcagcgtcatgcacgaggccctgcataaccactacacccagaagtccctgagcctctcccccggcaag

SEQ ID NO: 368 - DNA, 1413 bp, Artificial Sequence
  Treme_HC_IgG2-CO10
atggagactcccgcccaactcctctttctactcctcctatggctccccgacaccaccgggcaggtccagctcgtagagtccgggggcggcgtcgttcaacccgggaggagcctcaggctcagctgcgccgccagcgggttcaccttcagctcctacggcatgcactgggtccggcaggcccccggcaagggcctagagtgggtcgccgtcatctggtacgacggctccaacaagtactacgccgacagcgtcaagggcaggttcacgatcagcagggacaacagcaagaacaccttgtacctccagatgaattccctgcgggccgaggacacagccgtgtactactgcgcccgcgaccccaggggtgccacgctgtactattactactacggcatggacgtgtgggggcagggcaccacagtgaccgtcagctcagccagcaccaagggcccctcggtgtttcccctggccccatgcagcaggagcacgagcgagtccaccgccgcgctcggctgcctagtgaaggactacttccccgagcccgtgacggtgagctggaatagcggtgccctgaccagcggcgtgcacaccttccccgccgtgctgcaaagcagcgggctgtactccctgagctccgtggtcacggtgcccagctccaactttggcactcagacctacacctgcaacgtggaccacaagcccagcaatacgaaggtggacaagaccgtggagcggaagtgttgcgtggagtgcccgccctgtcccgccccacctgtggccggtcccagcgtgttcctgtttccccccaagcccaaggacaccctcatgataagcaggacacccgaggtgacctgcgtcgtggtcgacgtgtcccacgaggaccccgaggtgcagttcaattggtacgtggacggcgtggaggtgcacaacgccaagaccaagccgagggaggagcagttcaactcaaccttccgggtcgtcagcgtcctgactgtggtgcaccaggactggctgaatggcaaagagtacaagtgcaaggtgagcaacaagggcctccccgcccccatcgagaagaccatctcgaagacgaagggccagccccgggagccccaggtgtacaccctgccccctagcagggaggagatgaccaagaaccaggtgtccctgacctgcctggtgaagggcttctacccctccgacatcgcggtggagtgggagagcaacggccagcccgagaacaactacaagacgacgccccccatgctggacagcgacgggagcttcttcctgtacagcaagctgaccgtggacaaatctcgctggcagcagggcaacgtattcagctgctcggtgatgcacgaggcgctgcacaaccactacacgcagaagtccctgagcctgagccccgggaaa

SEQ ID NO: 369 - DNA, 1413 bp, Artificial Sequence
  Treme_HC_IgG2-CO11
atggagacgcccgcacagctcctcttcctcctcctactctggctcccggacacaaccgggcaggtacagctcgtagagtccggcggcggcgtcgtccagccggggaggagcctcaggctcagctgcgccgccagcggctttaccttctccagctacggcatgcactgggtaaggcaggcgcccggaaagggcctcgagtgggtcgcggtcatctggtacgacggcagcaataagtactacgccgacagcgttaagggtcggttcaccatcagcagggacaattccaagaatacgctctacctgcagatgaacagcctgcgggccgaggacaccgccgtctactactgcgcgcgagatccccggggggccaccctgtactactactattacggaatggacgtgtggggccagggtaccaccgtgacggtgtcaagcgccagcaccaaaggccccagcgtgttcccgctggccccctgctcccggagcaccagcgagagcaccgccgccctcggctgcctggtgaaggactacttccccgaacccgtgaccgtgagctggaacagcggcgccctgacaagcggcgtccacaccttccccgccgtgttgcagagcagcggtctgtactccctgagcagcgtggtcaccgtgcccagtagcaatttcggcacccagacctacacctgcaacgtggaccataagcccagcaacaccaaggtggacaagaccgtggagaggaaatgctgcgtggagtgcccgccctgccccgccccgcccgtggcgggccccagcgtgttcctgtttccacccaagcccaaggacacactgatgataagcaggacccccgaggtaacctgcgtggtggtggacgtgagccatgaggaccccgaagtgcagtttaactggtacgtggatggcgtggaggtccacaacgccaagaccaagccgcgtgaagaacagtttaactccaccttccgggtggtgtccgtgctcaccgtcgtccaccaggactggctgaacgggaaggaatacaaatgcaaggtcagcaacaagggccttcccgcccccatcgagaaaaccatctccaagacgaaggggcagccccgggagccccaggtctacaccctcccaccctccagggaggagatgaccaagaaccaagtctccctcacttgcttagtgaagggcttttaccccagcgacatcgccgtggagtgggagtccaacggccagcccgagaacaactacaaaacgaccccacccatgctggacagcgacggcagcttcttcctttactccaagctgacggtggataagagcaggtggcagcagggcaacgtgttctcgtgctccgtgatgcacgaggccctgcacaaccactacacccagaaaagcctttccctgagccccggcaag

SEQ ID NO: 370 - DNA, 1413 bp, Artificial Sequence
  Treme_HC_IgG2-CO12
atggagacgccggcccaactcctcttcctcctcctcctctggctcccggacaccaccgggcaggtccagctcgtcgagagcggcggcggcgtcgtacagcccgggaggtccctacgcctcagctgcgcagccagcggctttaccttcagcagctacggcatgcactgggtcaggcaggcccccggcaaggggctcgagtgggtcgccgttatctggtacgacgggtccaataagtactacgccgacagcgtaaagggccgcttcaccatcagcagggacaactcgaagaacaccctctacctgcagatgaactcactgcgggccgaggacaccgccgtgtactactgcgccagggacccccggggcgccaccctgtactactactattacgggatggatgtgtggggccagggcaccaccgtgaccgtgagcagcgcctccaccaagggcccgtccgtcttccccctggccccctgctccaggagcacgagcgagagcacggcggccctgggctgcctcgtgaaggactacttccccgaacccgtgaccgtcagctggaactccggcgccctcacctccggggtccataccttccccgccgtgttacagagcagcggcctgtatagcctgagcagcgtggtgaccgtgccgagcagcaacttcggcacccagacctatacctgtaacgtggaccacaagcccagcaacaccaaggtggacaagaccgtggagaggaagtgctgcgtagagtgcccgccctgtccggccccgcccgtggcgggccccagcgtgtttctgttccctcccaaaccgaaggacaccctgatgatcagcaggacccccgaggtgacctgcgtggtcgtggatgtgtcccatgaagaccccgaggtgcagttcaactggtacgtggacggtgtggaggtgcataatgccaagacgaagccacgtgaggagcagttcaattccactttccgcgtggtgtccgtgctgaccgtggtgcatcaggactggctcaacggcaaggagtataagtgcaaggtgtctaacaagggcctgcccgcccccatcgagaagactatctccaagactaaggggcagccgagggagccccaggtgtataccctgccccccagcagggaggagatgaccaagaaccaggtcagcctgacctgcctggtgaagggcttctacccctccgacatcgccgtggagtgggagagcaacgggcagcccgagaacaactacaagaccaccccgcccatgctggactccgacgggagcttttttctgtattccaagctgaccgtggacaagtccaggtggcagcaggggaacgtgttctcctgctccgtgatgcacgaagccctgcacaaccactatacccagaaaagccttagcctgagccccgggaag

SEQ ID NO: 371 - DNA, 1413 bp, Artificial Sequence
  Treme_HC_IgG2-CO13
atggaaacccccgcccaattactcttccttctcctcctctggctccccgacaccaccggccaggtccaactcgtcgagtccggaggcggcgtcgtccagcccggcaggagcctacggctcagctgcgccgccagcggcttcaccttctccagctacggcatgcactgggttcgccaggccccaggcaaggggctcgagtgggtcgccgtcatctggtacgacggcagcaataagtactacgccgactccgttaagggtaggttcaccatcagcagggacaactccaagaacaccctctacctgcagatgaacagcctgcgtgccgaggatacggccgtctactactgcgcccgggacccccggggggccaccctctactactattactacggtatggacgtctggggccagggcacgaccgtgaccgtgtccagcgcctcgaccaagggccccagcgtcttccccctggccccctgcagcaggagcaccagcgagagcaccgccgccctggggtgcctcgtgaaggattattttccggaacccgtgaccgtaagctggaacagcggcgccctgacctccggcgtgcacaccttccccgccgtactccagtccagcggactgtacagcctgagctccgtggtgaccgtgccctccagcaacttcggcacccagacctacacctgcaacgtggaccacaaacccagcaataccaaggtggataagaccgtggagaggaaatgctgcgtggagtgtcccccttgccccgccccgcccgtggccgggccgtctgtgttcctgttcccacccaagcctaaggacaccctcatgatctccaggacccccgaggtgacctgcgtggtcgtggacgtgagccacgaggaccccgaggtccagttcaactggtatgtggatggcgtggaggtgcataacgccaagaccaagccccgtgaggagcagttcaacagcaccttccgcgtcgtgtccgtgctgaccgtggtccaccaggattggctgaacgggaaagagtacaagtgcaaggtgtccaacaagggcttgcccgcccccatcgaaaagaccatctcgaagaccaagggccagcccagggagccccaggtttacaccctcccgccctccagggaggagatgaccaagaaccaggtgagcctcacctgtctggtgaaaggcttttatcccagcgacatcgccgtggagtgggagagcaacggccagcccgagaacaactacaagaccaccccacccatgctggacagcgacggcagcttcttcctttacagcaagctgaccgtagacaagagcaggtggcagcagggcaatgtgttcagctgcagcgtgatgcatgaagccctgcataaccactacacccaaaagtccctgagcctgagcccggggaag

SEQ ID NO: 372 - DNA, 1413 bp, Artificial Sequence
  Treme_HC_IgG2-CO14
atggagactcccgcccagctcctattcctcctcctcctctggctcccggacaccaccggccaggtacagcttgtggagtccggcggcggagttgtccagcccgggaggtccctcaggctcagctgcgccgccagcgggttcaccttcagcagctacggcatgcactgggtcaggcaggcccccgggaaaggactcgagtgggtcgcagttatctggtacgacgggagcaacaagtactacgccgacagcgtcaagggcaggttcaccatctccagggataatagcaagaacaccctttacctgcagatgaacagcctgcgggccgaggacacagccgtgtactactgcgcccgtgacccccgcggcgccaccctctactactactactacggcatggacgtgtggggccagggcacgaccgtgaccgtcagctccgccagcaccaagggcccctcggtgttccccctggccccgtgcagcaggagcaccagcgagagcaccgcggccctgggctgtctggtgaaggactactttcccgagcccgtgactgtctcgtggaacagcggggccctgacgagcggcgtgcacacgttccccgccgtgctgcagagcagcgggctgtacagcctcagcagcgtggtaaccgtgcccagctccaacttcggcacccagacctacacctgtaacgtggaccacaagccgagcaacaccaaggtggacaagaccgtggagcggaagtgctgcgtggagtgtcccccgtgccccgcccctccggtcgccggccccagcgtgttcctgttcccgcccaagccgaaggacaccctgatgatcagcaggacccctgaggtcacctgcgtggtggtggacgtcagccatgaggatcccgaggtgcagttcaactggtacgtggatggcgtggaagtgcataacgccaagacaaagcccagggaggagcagttcaacagcaccttcagggtggtgagcgtcctgaccgtggtgcaccaagattggctgaacgggaaggagtacaagtgtaaagtgagcaacaaagggctgcccgcccccatcgagaaaaccatctccaagaccaagggccagcccagggagccccaggtgtacaccctgcccccctcacgcgaggagatgaccaagaaccaggtgagcctgacctgcctcgtgaaaggcttctatcccagcgacatcgcggtcgaatgggagagcaacggccagcccgagaacaactacaagacgaccccgcccatgctggacagcgatggcagctttttcctgtacagcaagctgaccgtcgacaagtccaggtggcagcagggcaacgtgttctcctgtagcgtgatgcacgaggccctccacaaccactacacccagaaatccctgagcctgagccccggcaag

SEQ ID NO: 373 - DNA, 1413 bp, Artificial Sequence
  Treme_HC_IgG2-CO15
atggagacaccggcccagctcctcttcctcctcctcctttggctccccgacacgaccgggcaggtccaattggtggagtccggcggcggcgtcgttcagcccggcaggagccttcggctcagctgcgccgccagcggttttaccttcagctcctacggcatgcactgggtcaggcaggcccccggtaagggcctcgagtgggtcgccgtcatctggtacgacgggagcaacaaatactacgccgacagcgtaaagggcaggttcaccatctcgagggacaacagcaagaacaccctctacctgcagatgaacagcctgagggcggaggacaccgcagtgtactactgcgcccgggaccctaggggcgccaccctctactattactactacggcatggacgtgtggggccaaggaactaccgtgaccgtgtcgtccgccagcaccaagggccccagcgtcttccccctggccccctgctcccgtagcacatccgagagcaccgccgccttgggttgcctggtgaaggattacttcccggagccggtgaccgtgtcctggaacagcggggcgctgacctccggagtgcacaccttccccgccgtgctgcagtctagcggtctgtatagcctgtcctccgtggtgaccgtcccctccagcaacttcggtacacaaacctacacctgcaacgtcgaccacaagccctctaacaccaaggtggacaaaaccgtggaaaggaagtgctgcgtcgagtgcccaccctgccctgccccgcccgtggccgggcccagcgtgttccttttcccacccaaacccaaggacaccctgatgatcagccggacccccgaggtgacctgcgtggtggtggatgtgagccacgaggatcccgaagtgcagttcaactggtacgtggacggcgtggaggtgcataacgcgaagaccaagccccgggaggagcagttcaactccacgttcagggtcgtgtcggtcctcaccgtcgtgcaccaggactggctgaacggaaaggagtacaagtgcaaggtgagcaacaaaggcctgcccgcccccatcgagaagaccatctccaagaccaaggggcagcccagggagccccaggtctacaccctgccgcccagccgggaggagatgaccaaaaaccaggtcagcctgacctgcctggtcaagggcttctaccccagcgacatcgccgtggagtgggagagcaacggccagcccgagaacaactacaaaactaccccgccaatgctggacagcgacggctccttctttctgtacagcaagctgaccgtcgacaagtccaggtggcaacagggcaacgtgtttagctgcagtgtgatgcacgaggccctgcacaaccactacacgcagaaaagcctcagcctcagcccaggcaag

SEQ ID NO: 374 - DNA, 1413 bp, Artificial Sequence
  Treme_HC_IgG2-CO16
atggagactcccgcccagctcctcttcctcctcctcctctggctcccggataccaccgggcaggtccaattggtcgaaagcggcggcggggtcgtccagccggggcgcagcctcaggctcagctgcgcggcctccggcttcaccttcagcagctacggaatgcactgggtccggcaggccccggggaagggcctcgagtgggtcgccgtcatctggtacgacggcagcaataagtactacgccgacagcgtcaagggtaggttcaccatcagccgggacaactcaaagaacaccctctatctgcagatgaacagcctgagggccgaagataccgccgtatactattgcgcccgcgaccccaggggcgccaccctctactattattactatgggatggacgtgtggggccaggggaccaccgtgaccgtgagctccgccagcaccaagggcccgtcggtgttcccgctggccccctgctcccggagcacaagcgagagcaccgccgccctggggtgtctggtcaaggactacttccccgagcccgtgacggtgagctggaacagcggcgccctgacctccggggtgcacacgttccccgccgtgctccagagcagcgggctgtacagcctgagctccgtggtgaccgtgccctccagcaacttcggcacccagacgtacacctgcaacgtggaccacaagcctagcaataccaaggtggacaagacggtggagaggaagtgctgcgtggagtgcccgccctgccccgccccgcccgtcgcaggcccctccgtgttcctgttcccgcccaaacccaaggacacgctgatgatcagccggacccccgaggtgacctgcgtggtggtcgatgtgagccacgaggatcccgaggtgcagttcaattggtacgtcgacggcgtcgaagtgcacaacgccaagaccaagccccgggaggagcaattcaacagcaccttccgtgtcgtgtcggtgcttaccgtggtgcaccaggactggctgaacggcaaagagtataagtgcaaggtcagcaacaaaggcctgcccgcccccatcgagaagaccatcagcaagaccaaagggcagccgagggagccccaggtgtataccctgccgccctccagggaggagatgacaaagaaccaggtgtccctcacctgcctggtgaaaggtttctacccctcggacatagccgtggagtgggagtccaacggccagcccgagaacaactacaaaaccacgccccccatgctggatagcgacggcagcttctttctgtacagcaagctgacggtggacaagagccgctggcagcagggcaacgtcttctcctgcagcgtgatgcacgaggccctgcacaaccactacacccagaagtccctgagcctgagcccagggaag

SEQ ID NO: 375 - DNA, 1413 bp, Artificial Sequence
  Treme_HC_IgG2-CO17
atggagactcccgcccagctcctctttctcctcctcctctggcttcccgacaccaccgggcaggtccagctcgtcgagagcggcggcggcgtcgtacagcccggcaggagcctcaggctcagctgcgccgccagcggcttcaccttttcctcctacggaatgcactgggtccggcaggcccccggcaaggggctcgagtgggtagccgtcatctggtacgacggttccaacaagtactacgccgacagcgtcaaaggcaggttcacgatctccagggataacagtaagaacactctctacctgcagatgaactcgctgagggccgaggacaccgccgtctactactgcgccagggaccccaggggggccaccctttactattactattacgggatggacgtgtgggggcaggggaccaccgtgaccgtgtcatccgcctcgaccaaggggcccagcgtcttcccgctcgcgccctgcagcaggtcaacctccgagtcgaccgcagccctgggctgcctggtgaaggattacttccccgagcccgtgaccgtgagctggaacagcggcgcgctgacgagcggggtccacaccttccccgctgtgctgcagagcagcgggctgtactcgctgagcagcgtcgtcaccgtgcccagcagcaactttgggacacagacctacacctgcaacgtggaccataagcctagcaacaccaaggtggacaagaccgtggaacgtaagtgttgtgtggaatgtcccccctgccccgccccacccgtggccggccccagcgtgtttctgttcccacccaaacccaaggacaccctgatgatcagcaggacccccgaggtgacatgcgtggtggtggacgtgagccacgaggatcccgaggtgcagtttaactggtatgtggacggggtggaggtgcacaatgccaagaccaagccccgggaggagcagttcaactcgaccttccgcgtggtgagcgtcctcaccgtggtccaccaggactggctgaatggcaaagagtataaatgcaaggtgagcaacaagggcctgcccgcccccatcgagaagaccatctccaaaaccaaagggcagcccagggagccccaggtctacaccctgccccccagcagggaagagatgaccaagaaccaggtcagcctgacctgcctcgtgaaaggcttctacccctccgatatagccgtggagtgggagagtaacggccagccagagaacaattacaagacgaccccacccatgctggattccgacgggagcttcttcctctacagcaaactgaccgtggataagagcaggtggcagcaggggaacgtgttcagctgcagcgtgatgcacgaggcactgcacaaccactacacccagaaaagcctgtccctgagccccgggaag

SEQ ID NO: 376 - DNA, 1413 bp, Artificial Sequence
  Treme_HC_IgG2-CO18
atggaaacccccgcccagcttctcttccttctcctcctatggctccccgatactaccggccaagtccagctcgtcgagagcggagggggcgtcgttcagcccggccggagcctcaggctcagctgcgccgccagcgggttcaccttcagcagctacggcatgcattgggtccggcaggcccccggcaaaggcctcgagtgggtcgccgttatctggtacgacgggagcaacaagtactacgccgatagcgtcaagggcaggttcaccatctccagggacaattccaaaaatacactctacctgcagatgaatagcctgcgggcagaggacaccgccgtgtactactgcgccagggatccccggggcgcaaccctgtattactactactacgggatggacgtctgggggcagggtaccaccgtgaccgtgtccagcgccagcaccaagggcccctccgtgttccccctcgccccctgcagcaggtccaccagcgagagcaccgccgccctgggctgcctcgtgaaagactacttccccgagcccgtgacggtgtcctggaatagcggagccctgaccagcggcgtgcacaccttccccgccgtgctgcaatccagcggcctgtattcgctgagcagcgtggtgaccgtcccttcctcgaatttcggcacgcagacctacacgtgcaacgtggaccacaagccaagcaataccaaggtggacaagactgtggaacgcaaatgctgcgtggagtgcccgccctgccccgccccaccggtggccgggcccagcgtcttcctgttcccgcccaagccgaaagacacactgatgatcagccggacccccgaggtgacctgcgtggtggtcgacgtgagccatgaggacccggaggtgcagttcaactggtacgtggacggggtggaggtccacaacgccaagaccaagcccagggaggagcaattcaacagcaccttccgagtggtcagcgtgctgaccgtggtgcaccaggactggctgaacggtaaagaatacaagtgcaaggtgtccaataaggggctccccgcgcccatcgaaaaaaccatctccaaaacgaagggccagccaagggagccccaggtgtacaccctgccccccagccgcgaggaaatgaccaagaaccaggtgagcctgacctgtctcgtgaaggggttctaccccagcgacatcgccgtggagtgggagtccaacgggcagccggaaaacaactacaaaaccacgccgcccatgcttgactcagatgggtccttcttcctgtacagcaagctgaccgtggacaaaagccggtggcagcagggcaatgtcttttcctgctcagtgatgcacgaggccctgcacaaccactacacccagaaatcactgagcctgagcccgggcaaa

SEQ ID NO: 377 - DNA, 1413 bp, Artificial Sequence
  Treme_HC_IgG2-CO19
atggagacgcccgcccagctcctcttcctcctcctcctttggctcccggacaccaccggccaggtccagctcgtagagagcggcggcggcgtagtacagcccgggaggagcctcaggctcagctgtgcggcgagcggctttaccttcagcagctacggcatgcactgggtccgccaggcgccgggcaagggactcgagtgggtagccgtcatctggtacgacggaagcaacaagtattacgccgacagcgtcaagggccggtttaccatcagcagggacaactccaagaacacgctctacctgcagatgaatagcctccgggccgaggacacggccgtttactactgcgccagggaccccaggggcgccaccctgtactactactactacggcatggacgtctgggggcaggggaccaccgtgaccgtgagcagcgcctccaccaagggccccagcgtgttccccctcgccccgtgcagccgtagcacgagcgagagcaccgcagccctgggctgcctggtgaaagactacttccccgagcccgtcaccgtctcctggaacagcggcgcgctcacgtccggggtgcacaccttccccgccgtcctgcaatcctcagggctctattccctgagcagcgtagtgaccgtgcccagctccaacttcggcacccagacctacacatgcaatgtggatcacaagccctcaaacaccaaagtggacaagaccgtggagcggaagtgctgcgtggagtgccctccctgccccgccccacccgtggccggccccagcgtgttcctgtttccccccaagcccaaggacaccctgatgatcagcaggacccccgaggtgacctgcgtcgtggtggacgtgagccacgaggatcccgaggtgcagttcaattggtatgtcgacggggtggaggtgcacaacgcgaagacgaagcccagggaggagcagttcaacagcaccttcagggtcgtctccgtgctgaccgtggtgcaccaggactggctgaacggcaaggagtacaagtgtaaagtgagcaataagggcctcccggccccgatcgagaagaccatcagcaagaccaagggccagccgagggagccgcaggtgtacaccctccctcccagccgagaggagatgaccaaaaaccaggtgtccctgacgtgcctggtgaaggggttctacccaagcgacatcgccgtcgagtgggagagcaatggccagcccgagaataactacaagaccacgccccccatgctggacagcgacggctcctttttcctgtacagcaaactgaccgtggacaagagcaggtggcagcagggcaacgtgttcagctgcagcgtgatgcatgaggccctgcacaaccactacacccagaagtccctctccctaagccccggtaag

SEQ ID NO: 378 - DNA, 1413 bp, Artificial Sequence
  Treme_HC_IgG2-CO20
atggagacgcccgcccaactcctcttcctactcctcctctggctcccggacacaaccggccaggttcagctcgtcgagagcggagggggcgttgtccagcccggcaggtccctcaggctcagctgcgccgcgagcggcttcaccttcagcagctacggcatgcattgggtccggcaggcccccggcaagggcctcgagtgggttgccgtcatctggtacgacggcagcaacaagtactacgccgacagcgtcaaggggaggttcaccatcagcagggacaactccaagaataccctctatctgcagatgaacagcctgagggccgaggacaccgcggtgtactactgcgcccgggatcccagaggcgccaccctctattactactactacggcatggacgtctgggggcaggggaccaccgtgacggtgagcagcgccagcaccaaggggccctcggtgttccccctcgcgccctgctcacgttccaccagcgagagcaccgccgccctcggctgtctggtgaaggactacttccccgagccggtcaccgtgtcctggaatagcggcgccctgacgagcggcgtccacaccttccccgccgtcctccagagctccggtctgtatagcctgtccagcgtggtgaccgtgcccagcagcaatttcggaacccagacctatacttgcaatgtggaccacaagccgtccaacaccaaggtggacaagacggtcgaacgcaaatgctgcgttgagtgcccaccctgccccgccccgcccgtcgcggggccaagcgtcttcctgtttccgcccaagcctaaagacaccctcatgatcagccggacccccgaggtgacctgcgtggtggtcgacgtgtcccacgaagaccccgaagtgcagttcaattggtacgtggacggggtggaggtgcacaacgccaagacgaaacccagggaggagcagttcaactctactttccgggtggtgagcgtgctgacggtggtgcaccaggactggctgaacgggaaggagtacaagtgcaaggtgtccaacaagggactgccggcccccatcgagaagaccatcagcaagaccaagggccagccccgagagccccaagtgtacacgctccctcccagcagggaagagatgaccaagaaccaggtgagcctgacatgcctggtgaagggtttctacccatccgacatcgcggtggagtgggagtccaacgggcagcccgaaaacaattacaagaccacccctcccatgctggactcggacggcagcttctttctgtactccaagctgaccgtggacaagagcaggtggcagcagggcaacgtgttcagctgcagcgtgatgcacgaggccctgcacaaccattacacccagaagtccctcagcctgagccccggaaag

SEQ ID NO: 379 - DNA, 1413 bp, Artificial Sequence
  Treme_HC_IgG2-CO21
atggagactcccgcccagcttttgttcctcctcctcctatggctcccggacaccaccggacaggtccagctcgtagagagcgggggaggcgtcgttcagcccggtcggtcgctaaggctctcgtgcgcggccagcggcttcacctttagcagctacggcatgcactgggtcaggcaggcccccggtaagggtctggagtgggtcgccgtcatctggtacgacggctccaacaagtattacgccgattccgttaaagggcggttcaccatttccagggacaactccaagaacaccctctacctgcagatgaattccctgcgggccgaagacaccgccgtgtattactgcgcgcgggacccccggggggccaccctgtattattactattacgggatggacgtctggggccagggcaccaccgtcacggtcagctccgccagcacaaagggtccgagcgttttccccctggccccctgctcgcgctccaccagcgagtccaccgccgccctgggctgtctggtcaaggactacttccccgagccggtgactgtcagctggaactccggcgcgctcacgagcggggtgcatacgttccccgccgtcctacagagttcggggctgtactccctgagcagcgtggtgacggtgcccagctccaacttcgggacccagacctacacctgcaacgtggaccacaagcccagcaacaccaaggtggataagacggtggagaggaagtgctgcgtggagtgcccgccctgtccggccccgcccgtggccggccccagcgtgttcctctttccccccaagcccaaggacaccctgatgatctcgaggacgcccgaggtgacctgcgtggtggtcgacgtgagccacgaggatcccgaggtgcaattcaactggtacgtggacggggtggaggtgcacaacgccaaaaccaagccaagggaagaacagttcaatagcacctttagggtggtaagcgtgctgaccgtcgtgcaccaggattggctgaacgggaaggagtacaagtgcaaggtgagcaacaagggcctccccgccccaatcgagaagaccatcagcaaaaccaaggggcaacccagggagccccaggtgtataccctgcccccgtccagggaggagatgacaaagaaccaggtgtccctgacctgtctggtcaagggcttttatcccagcgacatcgccgtggagtgggaaagcaacgggcagccagaaaacaactacaagaccacgccccccatgctggacagcgatggttcctttttcctgtacagcaagctgaccgtggacaagagtaggtggcaacaggggaacgtgttctcctgcagcgtgatgcatgaggccctccacaaccactacacccagaaaagcctgtcactgtcgcccgggaag

SEQ ID NO: 380 - DNA, 1413 bp, Artificial Sequence
  Treme_HC_IgG2-CO22
atggagactcccgcacagttgctgttcctcctactcctctggctccccgacaccacgggacaggtccagttggtcgagtccgggggcggggtcgtccaacccgggcgatccctcaggctcagctgtgccgccagcggcttcacgttcagcagctacggcatgcactgggtcaggcaggcccccggcaaggggctcgagtgggtcgccgtcatttggtacgacggctccaacaagtactacgccgacagcgtcaagggccgcttcaccatcagccgggataacagcaagaacactctctatctgcagatgaacagcctgagggccgaagacacggccgtgtactactgcgccagggacccccgcggcgccaccctgtactactactattacggcatggacgtctggggccagggtaccaccgtgaccgtgagcagcgcctccaccaagggccccagcgtgttcccactcgccccctgcagccggagcacaagcgaatccaccgccgctctcggatgcctggtgaaggactacttccccgagcccgtgaccgtgtcgtggaatagcggcgccctgaccagcggcgtccacaccttccccgccgtgctgcagagcagcgggctgtactccctgagctccgtggtcacggtgccctcctccaatttcggcacccagacctacacctgcaatgtagaccacaagccctccaataccaaagtggacaagaccgtggagaggaagtgttgcgtggagtgtcccccctgccccgccccgcccgtggccggccccagcgtgttcctctttccgccgaagcccaaggacaccctgatgatcagccgcacgccggaggtgacctgcgtggtggtggacgtgagccacgaagaccccgaggtccagtttaactggtatgtggacggcgtggaggtgcacaacgccaagaccaagcccagggaggagcagttcaacagcacctttagggtggtgagcgtgctgacggtcgtgcaccaggactggctgaatggcaaagagtacaagtgcaaggtgtccaacaagggcctgcccgccccgatcgagaagacgatctccaagaccaagggccagccccgcgagccccaggtctataccctccctcccagcagggaggaaatgaccaaaaatcaggtgtccctgacctgcctggtgaaggggttttaccccagcgatatcgccgtggaatgggagtcgaacggccagccagagaacaactataaaaccaccccgcccatgctggactccgacggcagcttcttcctgtacagcaagctgaccgtagacaagtcgcgctggcagcagggcaatgtcttcagctgctcggtgatgcacgaggccctgcataatcactacacccagaaaagcctgagcctgtcccccgggaag

SEQ ID NO: 381 - DNA, 1413 bp, Artificial Sequence
  Treme_HC_IgG2-CO23
atggagacacccgcccagctcctcttcctcctcctactctggttgcccgacaccaccggacaggtacagctcgtagaatccggcggcggcgtcgtacagcccggcaggtccctacggctctcctgtgccgccagcgggttcacgttcagcagctacggcatgcattgggtccgtcaagccccgggcaagggtttagagtgggtcgccgtcatctggtacgacggctccaacaagtactacgccgacagcgtcaagggcaggttcaccatttcacgggacaatagcaagaacacgctctacctgcagatgaacagcctgcgagccgaggacaccgccgtgtactactgcgcccgggaccccaggggcgccaccctctactattactactacgggatggatgtctggggccagggaaccaccgtgaccgtgtcctccgccagcacaaaggggccctccgtgttccccctggccccctgcagcaggagcacctcggagagcaccgccgccctgggctgcctggtgaaggactatttccccgagcccgtgaccgtcagctggaacagcggcgcgctgacctccggcgtgcatacctttccggccgtgctgcagagcagcggcctgtactcactgagcagcgtggtcaccgtcccgtccagcaacttcgggacccagacctatacctgcaacgtggaccacaagcccagcaacaccaaggtcgacaagaccgtggagcggaagtgctgcgtggaatgccccccgtgcccggcgccgcccgtggccggccccagcgtcttcctgttcccacccaagccgaaggataccctgatgatcagcaggacccccgaggtcacctgcgtcgtggtggacgtgtcccacgaggaccccgaggtgcagttcaactggtacgtcgacggcgtcgaggtccacaacgccaagacaaagccaagggaggagcagtttaacagtacgttccgggtggtgagcgtgctgaccgtggtccaccaggactggctgaacggcaaggagtataagtgcaaggtcagcaacaaggggctgcccgcccccatcgaaaagactatcagcaagaccaaagggcagccccgggaaccccaggtgtacaccctccccccaagcagggaggagatgaccaagaaccaggtgagcttgacatgcctggtgaaggggttctaccccagcgacatcgccgtcgagtgggagtccaatggccagcccgagaacaactacaagaccaccccgcccatgctcgatagcgacggcagcttcttcctgtacagcaagctgaccgtggacaagtccaggtggcagcagggcaacgtgttctcgtgcagcgtgatgcacgaggccctgcataaccactacacccagaaaagcctcagcctatcccccggcaag

SEQ ID NO: 382 - DNA, 1413 bp, Artificial Sequence
  Treme_HC_IgG2-CO24
atggagacgcccgcccaactcctcttcctcctcctcctctggctcccggacaccaccggccaggtccagctcgtcgagagcggcggcggggtcgtccagccaggcaggagcctaaggctttcctgcgccgccagcggcttcacctttagcagctacggcatgcactgggttcgccaggcccccggcaagggcctcgagtgggtcgccgttatctggtacgacggcagcaacaagtactacgcggacagcgtcaagggcaggtttaccataagcagggacaactccaagaacaccttgtacctgcagatgaacagcctgcgagccgaggacactgccgtgtactactgcgcgcgcgacccccgcggcgcgaccctgtactactactactacgggatggatgtctggggccaggggaccaccgtgacggtaagctccgcgagcaccaaggggccctcggtgttccccctggccccctgctccaggtccaccagcgagtccaccgccgccctggggtgtctggtgaaggactacttccccgagcccgtgacagtctcctggaacagcggggccctcacaagcggcgtgcacaccttccccgccgtgctgcagtcaagcggactgtacagcctgtccagcgtggtgaccgtgccgtccagcaatttcggcacccagacctacacctgtaacgtcgaccacaagcccagcaacaccaaggtggacaagaccgtggagcgcaagtgctgcgtggaatgccccccgtgcccggccccacccgtggccggcccctccgtgtttctgttcccacccaaacccaaggacacgctgatgatcagcaggacccccgaggtcacctgcgtggtggtggacgtgagccacgaagaccccgaggtgcagttcaactggtacgtggacggcgtggaggtgcacaacgccaagaccaagccgcgggaggagcagttcaatagcacctttagggtggtgagcgtactgaccgtggtgcaccaggactggctgaacgggaaggaatacaagtgtaaggtcagcaacaaggggctccccgcccccatcgagaaaaccatcagcaaaaccaaggggcaaccgcgagagccccaggtgtacaccctgccaccgagcagggaagagatgaccaagaatcaggtgagcctgacctgcctggtgaaaggcttctacccaagcgatatcgccgtggagtgggagagcaatgggcagcctgagaataactacaaaaccaccccgcccatgctggactccgacgggagcttctttctgtatagcaagctgaccgtggataagagccgttggcagcaggggaacgtgttcagctgttcagtgatgcacgaggccctccataaccactacactcaaaagtccctcagccttagccccggcaag

SEQ ID NO: 383 - DNA, 1413 bp, Artificial Sequence
  Treme_HC_IgG2-CO25
atggagactcccgcccagctcctctttctactcctcctctggctccccgacacgaccgggcaggtccagctcgtcgagagcggcgggggcgtcgtacagcccggcaggagcctcaggcttagctgcgccgcctccgggttcacatttagcagctacgggatgcactgggtcaggcaggcaccgggcaagggcctcgagtgggtcgccgtcatctggtacgacggctccaacaagtactacgccgatagcgtcaagggccggttcacgatcagcagggacaacagcaagaacacgctttacctgcagatgaacagcctgagggccgaggataccgccgtttattactgcgccagggacccccggggggccaccctgtactactactactacggcatggacgtgtggggacagggtaccaccgtgaccgtgagcagcgcctccacgaaggggcccagtgtgttccccctggccccctgcagcaggtccaccagcgagagcaccgcggccctgggctgcctagtgaaggactacttccccgagcccgtgaccgtgagctggaactccggcgccctcaccagcggggtccacacctttccggcggtgctccagagcagcggcctgtactccctcagcagcgtcgtgacggtacccagcagcaacttcggcacccaaacctacacctgtaatgtggaccacaagcccagcaacaccaaggtcgacaagaccgtggagcgaaagtgctgcgtggagtgccctccctgccctgccccgcccgtggccgggcccagcgtgttcctgttccctcccaagccgaaggacaccctgatgatttcccggacccccgaggtgacgtgcgtggtggtggacgtgtcccacgaggaccccgaagtgcagttcaactggtacgtggacggggtggaggtgcacaacgcgaagacgaagccccgggaggagcagttcaacagcaccttcagagtcgtgagcgtgctgaccgtcgtgcaccaggattggctgaacggcaaggagtacaagtgtaaggtgagcaacaaggggctgcccgcccccatcgagaagacgatctcaaagaccaagggccagcccagggaaccgcaggtgtacacgctgccccccagcagggaggagatgaccaagaaccaggtgtccctgacgtgcctggtcaagggcttctacccctccgatatcgccgtggagtgggaatccaacggtcagcccgagaacaactacaaaaccactccgcccatgctggactccgacggcagcttctttctgtactccaagctgaccgtggacaaatccaggtggcagcagggcaacgtgttttcctgctccgtgatgcacgaggccctgcacaaccactacacccagaagtccctctccctgtcccccggcaag

SEQ ID NO: 384 - protein, 475 aa, Artificial Sequence; identical to SEQ ID NO: 282
  Treme_HC_IgG1 (tremelimumab IgG1 heavy chain)

SEQ ID NO: 385 - protein, 20 aa, Artificial Sequence
  Treme_HC_IgG1 (signal peptide)
METPAQLLFLLLLWLPDTTG

SEQ ID NO: 386 - protein, 125 aa, Artificial Sequence; identical to SEQ ID NO: 357
  Treme_HC_IgG1 (variable region, VH)

SEQ ID NO: 387 - protein, 330 aa, Artificial Sequence
  Treme_HC_IgG1 (constant region)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - DNA, 1425 bp, Artificial Sequence
  Treme_HC_IgG1-CO01
atggagactcccgcccagctcctcttcctcctcctactctggcttcccgacaccaccgggcaggtacagctcgtcgaatccgggggcggcgtagtccagccgggcaggtcgctccggctcagctgcgccgcctccgggtttaccttcagcagctacggcatgcattgggtcaggcaggcccccggcaaggggctcgagtgggttgccgtcatctggtacgacggctcaaataaatactacgccgacagcgtcaagggcaggttcaccatcagcagggacaatagcaagaacacgctctacctgcagatgaacagcctgcgggccgaagacaccgccgtgtattactgcgccagggacccccgcggcgcgaccctgtactactactactacggcatggacgtgtggggccagggcacgaccgtgaccgtgtcctctgccagcactaagggccccagcgttttccccctggccccgagcagcaagagcacctccggcggcacggccgccctggggtgcctggtgaaggactatttccccgagcccgtgaccgtgagctggaactccggcgccctgacctctggcgtccacaccttccccgccgtgctgcagagtagcggcctgtacagcctgtcctccgtggtcaccgtgcccagcagctcgctgggcacccagacctacatctgcaatgttaaccacaagccctccaataccaaggtggataagagggtggagccaaagagctgcgacaagacacacacctgccccccgtgtcccgcccccgagctgctgggcggcccctccgtgttcctgttcccacccaagccgaaggacaccctcatgataagccggacccccgaggtgacctgcgtggtggtggatgtgagccacgaggaccccgaagtgaagttcaactggtacgtggacggcgtggaggtgcacaatgccaagaccaaaccgcgtgaggagcagtacaacagcacctaccgcgtggtgagcgtgcttaccgtccttcatcaagactggctgaacggcaaggagtacaagtgcaaggtgtccaataaggccctgccggcccccatcgagaagaccatctccaaggccaaggggcagccccgggagccccaggtgtacacgctgccccccagcagggaggagatgaccaagaaccaggtgtccctcacctgcctggtgaagggcttctaccccagcgacatagccgtggaatgggaatccaacgggcagcccgaaaataactacaagacgacccctcccgtgctggactccgatggcagctttttcctgtactcaaagctgaccgtggacaagagcaggtggcagcagggcaacgtgtttagctgttccgtgatgcatgaggctctgcacaaccactacacccagaaaagcctgagcctgagccccggcaag

SEQ ID NO: 389 - DNA, 1425 bp, Artificial Sequence
  Treme_HC_IgG1-CO02
atggagacgccggcccaactccttttcctccttctcttgtggctccccgacaccaccggccaggtccagctcgtcgaatccggaggcggggtcgtccagcccggcaggagcctccggctcagctgcgcggcctccgggttcacgtttagcagctacggcatgcactgggtacgtcaggcccccggcaagggtctggagtgggtcgcggtcatctggtacgacggtagcaacaagtattacgcggactcggtcaaggggcggttcaccatcagcagggataacagcaagaacacgctctacctgcagatgaacagcctgagggccgaggacacggccgtgtactactgcgccagggacccccgaggcgccaccctgtactactactattacggcatggacgtgtggggccagggcaccacagtgacggtgagcagcgcctccaccaaaggcccctccgtcttccccctggcccccagctccaagagcacaagcggcggcaccgccgcgctcggctgcctggtgaaggattacttccccgagcccgtgaccgtgagctggaacagcggcgccctgacctccggcgtgcataccttccccgccgtgctgcagtccagcgggctgtactccctgagcagcgtggtgaccgtgcccagctccagcctcggcacccagacctacatctgcaatgtgaatcacaagccgtccaacaccaaggtggacaagcgtgtggaacccaagtcgtgcgacaagacccacacctgcccgccctgccccgccccggagctcctgggcggcccgtccgtgttcctgttccctcccaagcccaaggatacactgatgatcagcaggacccccgaggtgacctgcgtggtggtggacgtgagccacgaggaccccgaggtgaaatttaactggtacgtggacggggtggaggtccacaacgccaaaacgaagccgcgagaagaacagtacaactccacctaccgggtggtcagcgtcctgaccgtcctgcatcaagactggctgaacggaaaagagtacaagtgcaaggtcagcaacaaggcgctgcccgccccgatcgagaagacgatcagcaaggccaaaggccagccccgcgagccccaggtctacaccctgccccccagcagagaggagatgacgaagaaccaggtgtccctcacctgtctggtgaagggcttctacccctccgacatcgccgtcgagtgggagagcaatgggcagcccgagaacaattataagaccaccccgcccgtgctggactccgacggcagcttctttctgtacagcaagctgaccgtggacaagtcgcggtggcagcagggcaacgtgttcagctgctcggtgatgcacgaagccctgcacaaccactatacccagaaaagcctgagcctctcccccgggaag

SEQ ID NO: 390 - DNA, 1425 bp, Artificial Sequence
  Treme_HC_IgG1-CO03
atggaaacccccgcccaactcctcttcctcctcctcctatggcttccggacaccaccgggcaggtccagctcgtcgagtccggcgggggcgtcgtccagccgggcaggagcctcaggctctcctgcgccgcatcaggcttcacctttagctcgtacgggatgcactgggtccggcaggcgcccggcaagggcttggagtgggttgccgtaatctggtacgacggcagcaacaagtactacgccgactccgtcaagggccggttcaccatctccagggacaacagcaagaacaccctctacctgcagatgaacagcctgagggcggaggacaccgccgtgtactattgcgccagggaccccaggggcgccaccctgtattactactactacggcatggacgtgtggggccagggcacaacagtcacggtgtcgtcagccagcaccaaaggcccgtccgtcttccccctggcccccagcagcaagagcacatccgggggaaccgccgccctgggctgtctggtgaaggactacttccccgagcccgtgaccgtgtcgtggaacagcggcgccctgaccagtggggtgcatacgttccccgccgtgcttcaaagcagcggcctgtacagcctgagctccgtggtgaccgtgcccagcagctcgctggggacccagacctacatctgtaatgtgaaccacaagcccagcaataccaaggtggacaagcgagtggagcccaagtcctgtgataagacccacacctgcccgccctgccccgcgcccgaactgctgggcggccctagcgtgttcctgttccctcccaaacccaaagacactcttatgatcagccggacccccgaggtgacctgtgtggtggtggacgtcagccatgaggacccggaagtgaagtttaactggtacgtggacggcgtggaggtgcataacgccaaaaccaaaccccgggaggagcagtacaacagcacgtacagggtcgtgtccgtgctcaccgtgctgcaccaggattggcttaacggcaaggagtacaagtgcaaggtgagcaacaaggccctgcccgccccgatcgagaagaccatctccaaggctaagggccagcctagggagccacaggtgtacacactgcccccctccagggaggaaatgacgaaaaatcaggtgagcctgacctgcctggtgaaggggttctacccctccgacatcgccgtggagtgggaaagcaacgggcaacccgagaataactacaaaaccaccccgcccgtgctggatagcgacggcagcttcttcctgtactccaagctgaccgtggataagagccgatggcagcagggcaacgtgttcagctgctcagtgatgcacgaggcgctgcataaccactacacccagaagagtctgtcgctgagccccggcaaa

SEQ ID NO: 391 - DNA, 1425 bp, Artificial Sequence
  Treme_HC_IgG1-CO04
atggagactcccgcccaactcctattcctactcctcctctggctcccggacaccacggggcaagtccagctcgtggagtccggcgggggcgttgtacagcccggccgaagcctcaggctcagctgcgccgccagcggcttcaccttctccagctacggcatgcactgggtccgccaggcccccgggaaggggctcgagtgggtcgccgtcatctggtacgacggctccaacaagtactacgccgacagcgtcaagggcaggttcaccatctcccgggataactccaagaataccctctacctgcagatgaacagcctgcgagccgaggataccgcggtctactactgcgcccgcgaccccaggggcgccaccctgtactactactattacggcatggacgtgtggggccagggtaccaccgtgaccgtgtcctccgccagcacgaaagggcccagcgtcttcccgctggcccccagctccaagagcacgtccggcggcaccgccgccctgggatgtctggtgaaagactactttcccgaacccgtgaccgtgtcgtggaactcaggcgcccttaccagcggagtgcacaccttcccggccgtgcttcagagctcgggactctattccctgagcagcgtggtcaccgtgcccagcagcagcctgggcacccagacctacatttgcaacgtgaaccacaagccctctaacacgaaggtggacaagagggtggagcccaagagctgcgacaagacccacacctgccccccgtgcccagcgcccgagctgctcggcggccccagcgtgttcctgttccctcccaagccgaaggacacgctgatgatcagcaggacgccagaggtaacctgcgtggtggtagacgtgtcccacgaggaccccgaggtgaaattcaactggtacgtcgatggcgtggaggtgcacaacgccaagacgaaaccccgggaggagcaatataattccacctacagggtggtcagcgtgctgaccgtgctccaccaagactggctgaacgggaaagaatacaagtgcaaagtgtccaataaagccctgccagcccccattgagaagaccatcagcaaggccaaggggcagcccagggaaccccaggtgtacaccctgcccccatccagggaggagatgaccaagaaccaggtgtccctgacgtgcctggtcaagggcttctatcccagcgacatcgccgtcgagtgggaaagcaatgggcaacccgagaacaactacaagaccaccccgcccgtgctcgactccgacggcagcttcttcctctactccaagctgaccgtggataagagccgctggcagcagggcaatgtgttcagctgtagcgtgatgcacgaggccctgcacaaccactacacccaaaagtcgctcagtctgtcccccggcaag

SEQ ID NO: 392 - DNA, 1425 bp, Artificial Sequence
  Treme_HC_IgG1-CO05
atggaaacgcccgcccagctcctcttcctcctcctcctctggctccccgacactacgggccaggtacagctcgtcgagagcgggggcggcgttgtacagcccggccggtccctcaggctatcctgcgccgccagcggcttcaccttcagcagctacggcatgcactgggtcaggcaggcccccgggaagggcctcgagtgggtcgccgtcatctggtacgacggctccaataagtactacgcggacagcgttaaggggcgcttcacgatcagcagggacaactccaagaacacgctctacctgcagatgaactccctgagggcggaggacaccgccgtgtactactgcgccagagatcccaggggtgcgaccctctattactactactacggcatggacgtgtggggccagggaacgaccgtgaccgtgtccagcgccagcaccaaagggcccagcgtgttccccctggccccctccagcaagagcacgagcggtggcaccgccgccctcggctgcctggtgaaagactattttcccgagcccgtgacggtgagctggaacagcggggccctgaccagcggggtgcatacgttccccgccgtgttgcagtcgagcggcctgtactccctgagctccgtggtgaccgtgccgtcctcctcgctgggcacccaaacctacatctgtaacgtgaaccacaagcccagcaataccaaggtggacaagcgggtggagccgaaatcctgtgacaagacccacacctgcccgccctgccccgcccccgagctgctgggcgggccctccgtgttcctgttccctcccaagccgaaggacaccctgatgatctcgaggacccccgaggtgacctgcgtggtggtcgacgtgagccacgaagaccccgaggtgaagttcaactggtacgtggacggggtggaggtccacaacgccaagactaaaccccgcgaggaacagtacaacagcacctacagggtggtcagcgtgctgaccgtgctgcaccaggactggctgaatggcaaggaatacaagtgcaaggtgtccaataaggcactgccagcgcccatcgagaaaaccatcagcaaggcgaaggggcagccgagggagccccaggtgtacacgctgccccccagtagagaggagatgaccaagaaccaggtgtcgctaacttgcctggtgaaggggttctacccctcggacatcgccgtggagtgggagtccaacggccagcccgagaataactacaagaccacccctcccgtgctggactccgacggcagcttcttcctgtacagcaagctgaccgttgataagtcccggtggcagcagggaaacgtgttttcctgcagcgtcatgcacgaggcgctgcacaaccactacacccaaaaaagcctgagcctcagtcccggcaag

SEQ ID NO: 393 - DNA, 1425 bp, Artificial Sequence
  Treme_HC_IgG1-CO06
atggagactccggcccagctcctcttcctcctcctcctctggctccccgacaccaccggtcaggtccagctcgtcgagagcggaggcggcgtcgtccagcccgggcggtcgctcaggctcagctgcgccgccagcggcttcaccttcagcagctacggcatgcattgggtcaggcaggccccgggcaagggtcttgagtgggtcgccgtcatctggtacgacggctccaacaagtactacgccgacagcgtcaaaggccggttcaccatttcccgggataactccaagaatacgctctacctgcagatgaacagcctccgcgccgaggacaccgccgtctactactgcgcacgggacccccggggggccacgctgtactattactactacggcatggacgtgtggggccaggggaccaccgtaaccgtgagctccgccagcaccaagggccccagcgtgtttccgctcgcccctagcagcaagtccacctccgggggcaccgccgccctggggtgcctggtgaaggactacttccctgagcccgtgaccgtcagctggaacagtggcgccctgaccagcggggtgcacacgttccccgccgtgctgcagagctccggcctctatagcctcagcagcgtcgtgaccgtgccgagcagctccctgggtacccagacctacatatgcaacgtaaaccataaaccctccaacacgaaggtggacaaaagggtggaacccaaaagctgcgacaagactcacacatgcccgccctgccccgccccagagctgctggggggccccagcgtgttcctgttcccgcccaagcccaaggacaccctgatgatcagccgcacccccgaagtgacctgcgtggtggtggacgtgagccacgaggacccggaggtgaagttcaactggtacgtggatggggtggaagtgcacaatgccaagaccaagccccgggaggagcagtacaactctacctaccgggtggtgagcgtgctcacggtgctgcaccaggactggctcaatggcaaggagtataagtgcaaggtgagcaacaaggccctgccagcccccatcgaaaaaacgatcagcaaggccaagggccagccccgggagccacaggtgtacaccctgcccccctccagggaggagatgaccaagaaccaggtgtccctgacctgcctggtgaagggcttctacccctccgacatcgccgtcgagtgggagtccaacggccagccagagaacaactacaagaccacgccccccgtgctcgacagcgacggcagcttctttctctactccaagctgaccgtggataagtccaggtggcagcagggcaacgtctttagctgtagcgtcatgcacgaggccctgcacaaccactacactcagaaaagcctgagcctgtcccccggcaag

SEQ ID NO: 394 - DNA, 1425 bp, Artificial Sequence
  Treme_HC_IgG1-CO07
atggagactccggcccagctcctcttcttgctcctcctctggctcccggacaccaccgggcaggtccaactcgtcgaatccggcggcggcgtcgtacagcccggcaggagcctcaggctttcctgtgccgccagcggcttcaccttcagctcctacggcatgcactgggtcaggcaggcccccgggaagggcctcgagtgggtcgccgtcatctggtacgacggcagcaacaagtactacgccgactccgtcaagggcaggttcaccatcagcagggacaattccaaaaacacgctctacctgcaaatgaacagcctgcgcgccgaggacacagccgtgtactactgcgcccgggatccccggggcgccaccctctactactactattacgggatggatgtgtgggggcagggcaccacggtgacggtgagcagcgcctccaccaaaggccccagcgtgttccccctggcgcccagcagcaaaagcaccagcgggggaaccgccgcgctgggctgcctggtgaaggactactttcccgagcccgtgaccgtgtcctggaacagcggcgccctcacgagcggggtgcacaccttccccgcggtgctgcagagcagcggcctgtacagcctgagcagcgtggtgaccgtcccctcctccagcctgggcacccagacatacatctgcaacgtgaaccataagcccagcaataccaaggtcgacaagcgagtggagcccaagagctgcgacaagactcatacctgcccgccctgccccgcccccgagctgctgggcggccccagcgtgttcctgttcccgcccaaaccgaaggataccctgatgatatcccgcacccccgaggtgacctgcgtggtggtggacgtgagccacgaggacccggaggtgaaattcaactggtacgtggatggagtggaagtgcataacgccaagaccaagcccagggaggagcagtacaacagcacctaccgagtggtgagcgtgctgaccgtgctgcaccaagactggctgaacggcaaagagtacaagtgcaaagtgtcaaataaagccctccccgcccccatcgagaaaaccatctcgaaggccaagggccagccacgcgagccccaggtgtacaccctcccgcccagccgggaggagatgaccaagaaccaagtgtccctgacgtgcctggtgaaggggttctaccccagcgacatagccgtagagtgggagagcaatggccagcccgagaataattataagacgactccccccgtgctcgacagcgacggcagcttcttcctctacagcaagctcaccgtcgacaagagcaggtggcagcagggcaatgtgttctcctgctccgtcatgcatgaggccctgcacaaccactacacccagaaaagcctgtccctgtccccaggtaag

SEQ ID NO: 395 - DNA, 1425 bp, Artificial Sequence
  Treme_HC_IgG1-CO08
atggagactcccgcccagctcctattcctcctcctcctctggcttcccgataccaccggtcaggtccagctcgtcgagtccggcggcggcgtggtacaacccggacggtccctccggctcagctgcgccgcgtccggcttcaccttcagctcctacgggatgcactgggtccggcaggcccccggtaagggcctcgagtgggtcgccgttatctggtacgacggcagcaacaagtactacgccgacagcgtcaagggccggttcacaatcagcagggacaactccaagaataccctctacctgcagatgaacagcctgcgggccgaggatacggcggtctactactgcgccagggacccgaggggcgccaccctgtattactattactacggcatggacgtgtggggccagggcaccaccgtgaccgtgtccagcgccagcaccaaggggccctcggtgtttcccctggcccccagctcaaagagcaccagcggcgggaccgcggccctgggatgcctggtgaaggactactttcccgagcccgtgaccgtgtcctggaactccggcgcgctgacgagcggcgtacacacctttcccgccgtgctgcagagcagcggcctctatagcctgagcagcgtggtgaccgtgcccagcagcagcctgggcacgcagacctacatctgcaacgtgaaccacaagccgagcaacaccaaggtggataagagggtcgagcccaagtcgtgtgacaagacacatacctgccccccgtgccccgcccccgagctgctggggggccccagcgtgttcctgttcccacccaagccgaaagacacgctgatgattagcaggacccccgaggtgacctgcgtggtggtggacgtcagccacgaggaccccgaggtgaagttcaactggtacgtggacggcgtggaggtgcataatgctaagaccaagccccgggaggagcagtacaactccacctacagagtggtaagcgtactgaccgtgctgcaccaggactggctgaacggtaaggagtacaagtgtaaggtgagcaacaaggccctgcccgcccccatcgagaagacgatctcgaaggccaagggccagccccgggagccccaggtctacacgctccctcccagcagggaggagatgacgaagaaccaggtcagcctcacgtgcctcgtgaagggcttctaccccagcgacatagccgtggagtgggagtccaacggacagcccgagaacaactacaagaccacgccccccgttctggactccgacggatcctttttcctctacagcaaactgaccgtggacaagtcccggtggcagcagggcaacgtgttcagctgcagcgtgatgcacgaagccctgcacaaccactatacccagaaaagcctgtccctcagccccggcaag

SEQ ID NO: 396 - DNA, 1425 bp, Artificial Sequence
  Treme_HC_IgG1-CO09
atggagacgcccgcccagctcctcttcctcctactcctttggctccccgacaccaccgggcaggtccagctcgtcgagtccggaggcggcgtcgtccagcccggcaggagcctcaggctcagctgcgccgccagcgggttcaccttcagcagctacggcatgcattgggtcaggcaggcccccggtaagggactcgagtgggttgccgtcatctggtacgacggcagcaataagtactacgccgatagcgtcaagggccgattcaccatctccagggacaactccaagaacacgttgtacctgcagatgaacagcctgagggcggaggacaccgccgtgtactactgcgcccgggatccgcggggggccacgctgtactactactactacggcatggatgtgtgggggcagggcaccaccgtgacggtgtccagtgcctctaccaagggcccctccgtgttccccctggcccctagcagcaagagcacaagcggcggcaccgccgccctgggatgtctggtcaaagactacttccccgagcccgtgaccgtgagctggaacagcggcgcactcaccagcggcgtccataccttcccggcggtgctgcagagctccggtctgtacagcctgagcagcgtcgtgacggtgccctcctcctccctgggcacccagacctacatctgcaacgtcaaccataagcccagcaacaccaaggtggacaagagggtggagccgaaaagctgcgacaaaacccacacctgcccgccctgtcccgcgcctgagctcctcggcggacctagcgtgttcctgttcccacccaagcccaaagacacactcatgatctccaggacccccgaggtcacctgcgtggtggtggacgtctcccacgaggaccccgaggtgaagttcaactggtatgtggacggcgtggaggtccacaacgccaagaccaaacccagggaggaacagtacaattctacctaccgcgtggtgagcgtgctgactgttcttcaccaggactggctgaacgggaaggaatacaaatgcaaggtgagcaacaaggccctgcccgcccccatcgagaagaccatctccaaggcgaagggccagccccgggaaccccaggtgtacaccctgccccccagcagggaggagatgaccaagaaccaggtgtccctgacctgcctcgtgaaggggttctaccccagcgacatcgccgtggagtgggaaagcaacggccagcccgagaacaactacaagacaaccccacccgtgctggactccgacggcagctttttcttatacagcaaactgactgtggacaaaagccgctggcagcagggcaacgtgttcagctgcagcgtgatgcacgaagccctgcacaatcactacacccagaaaagcctgagcctcagccccggcaag

SEQ ID NO: 397 - DNA, 1425 bp, Artificial Sequence
  Treme_HC_IgG1-CO10
atggagacgcccgcccagcttctcttcctcctactcctctggctccccgacaccaccgggcaggtccagctcgtcgagagcggcggcggcgtggtgcagcccggccggagcctcaggttaagctgcgcggcgagcggcttcaccttctccagctacggcatgcactgggtccgccaggcgcccggcaaggggctcgagtgggtcgccgtaatctggtacgacggcagcaacaagtactacgccgacagcgtcaagggcagattcacaatctccagggacaactctaagaacaccttgtacctgcagatgaacagcctgcgcgccgaagacacggccgtgtactactgcgcccgggatccccggggcgcgaccctgtactactattactacggcatggacgtgtggggccaagggaccaccgtgaccgtgagcagcgccagcaccaagggcccctccgtgttcccgctggccccctccagcaagtccaccagcggcggcaccgcagccctcggctgcctggtgaaggactattttcccgagccggtgaccgtgagttggaatagcggcgccctgaccagcggcgtacacaccttccccgcggtgctgcagagctccggcctgtactccctgagcagcgtggtgaccgtgcccagctccagcctcggcacccagacctacatctgcaatgtgaaccacaagccgagcaacaccaaggtggataagagggtggagccgaaatcgtgcgacaaaacgcacacctgccccccatgtcccgcccccgaactcctgggcggtcccagcgtgtttctgttcccacccaaaccgaaggacaccctgatgatctccaggacacccgaggtgacctgcgtggtggtggatgtgtcccacgaggaccccgaggtgaaattcaattggtacgtggacggcgtggaggtccacaacgccaagaccaagcccagggaggaacaatacaactccacctacagggtggtgtcagtgctgaccgtcctgcaccaggattggctgaacggcaaggagtacaagtgcaaggtgtccaacaaggccctgccggcacccatcgagaaaaccatcagcaaagccaagggccagccccgggaaccccaagtgtacaccctgccccccagccgggaggaaatgaccaagaaccaggtgagcctcacctgcctggtcaagggcttctaccccagcgacatagccgtggagtgggagagcaacggccagcccgaaaacaactataagaccaccccgcccgtcctggacagcgacggctcttttttcctgtacagcaagctgaccgtggacaagagccgatggcagcaggggaacgtcttcagctgcagcgtgatgcacgaggccctgcataaccattatacccagaaaagcctcagcctgtcgcccggcaag

SEQ ID NO: 398 - DNA, 1425 bp, Artificial Sequence
  Treme_HC_IgG1-CO11
atggagacacccgcccagctcctcttccttctcttgctctggctccccgacacgaccgggcaggtccagctcgtcgagtcgggcggaggcgtcgtccagcccggaaggagcctcaggctatcctgcgccgcgagcggcttcaccttcagctcctacggtatgcactgggtccggcaggcccccggcaaggggctcgagtgggtagccgtcatctggtacgacggctccaacaagtactacgccgacagcgtcaagggccggttcaccatcagcagggacaacagcaagaacaccctctacctgcaaatgaacagcctgagggccgaagataccgccgtgtactattgcgccagggacccccggggcgccacactatattactactactacggcatggacgtgtgggggcagggcaccaccgtgaccgtgtctagcgcgagcacgaagggccccagcgtgttccccctggcccccagctcaaagagcactagcggcggaaccgccgccctgggctgcctggtcaaggactattttccggagcccgtcacggtgtcctggaacagcggcgccctgaccagcggggtgcacaccttccccgccgtgctgcagagcagcgggctctacagcctgagcagcgtggtcaccgtgccttccagcagcctgggtacccagacctacatctgcaacgtgaatcacaaacccagcaacaccaaggtggacaagagggtggagcccaagagctgcgacaagacgcacacctgcccgccctgtcccgcccccgaactgctgggaggcccctccgtgttcctgttcccgcccaagccaaaggacaccctgatgataagcaggacccccgaggtgacctgcgtggtggtggacgtgtcccacgaggaccccgaggttaagttcaactggtatgtggacggcgtggaagtgcacaacgccaaaaccaagccccgggaggagcagtacaacagcacctatagggtggtgagcgtgctcaccgtgctgcaccaagactggctgaacgggaaagagtataagtgcaaggtgagcaataaagcgctgcccgccccgatcgagaagaccatcagcaaggccaagggccagccccgggagccgcaagtatacaccctgccgccgtcccgggaggagatgaccaagaaccaggtgagcctgacctgcctcgtgaaagggttttaccccagcgacatcgcggtggagtgggagtccaacggccaacccgagaacaactacaagaccaccccacccgtgctggactccgacggatcctttttcctctactccaagctgaccgtggataagtccaggtggcagcagggcaacgtgttcagctgcagcgtaatgcacgaggccctgcacaatcattacacgcagaaaagcctgtctctgagccccggcaag

SEQ ID NO: 399 - DNA, 1425 bp, Artificial Sequence
  Treme_HC_IgG1-CO12
atggaaacgccagcccagctcttattcctcctcctcctctggctcccggacaccaccggccaggtccagctcgtagagtcagggggcggcgtcgtccagcccggcaggtcccttcgcctctcctgcgccgccagcggcttcaccttcagcagctacggcatgcactgggtcaggcaggcgcccggcaagggcctcgagtgggtcgccgtcatctggtacgacggcagcaacaaatactacgccgacagcgtcaagggccggttcaccatcagcagggacaacagcaagaacaccctctacctgcagatgaattccctgcgggctgaggataccgcggtgtactactgcgcccgcgaccccaggggcgcgacgctgtactactactactacggcatggacgtgtgggggcaggggaccaccgtcaccgtgagcagcgccagcaccaaagggccatccgtgtttcccctggccccgagctccaagagcaccagcggcggcacagccgccctgggctgtctggtgaaggactatttcccggagcccgtgaccgtgtcctggaacagcggcgccctgaccagcggcgtgcacacgttccccgccgtgctgcaaagctccggcctgtacagcctgagcagcgtggtgaccgtgcccagcagcagcctgggaacgcagacctacatctgtaacgtgaaccataagcccagcaacaccaaggtggacaaacgcgtcgagcccaagagttgcgacaagacccacacctgccctccctgtcccgccccagagctcctcgggggacccagcgtgttcctctttccccctaagcccaaggacacgctgatgattagcaggactcccgaggtgacctgcgtggtggtggacgtgagccacgaggacccagaggtgaaattcaactggtatgtggatggcgtggaggtccacaacgccaaaaccaagcccagggaggaacagtataacagcacctacagggtcgtatccgtcctgaccgtactgcaccaggactggctgaacggcaaggagtataagtgcaaagtcagcaataaggccctgcccgcacccatcgagaaaaccatctccaaggccaagggccagcccagggagccccaggtgtataccctgccccccagcagggaggagatgaccaagaatcaggtgagcctaacttgcctggtgaagggcttttaccccagcgacatcgccgtggagtgggagtccaacggccagcccgagaacaactataagaccaccccgcccgtgctggacagcgatggctccttcttcctctacagcaagctgaccgtggacaagagcaggtggcagcagggcaacgtgttctcctgcagcgtgatgcacgaggccctgcataatcattacacccagaagtcgctgagcctgagccccggtaag

SEQ ID NO: 400 - DNA, 1425 bp, Artificial Sequence
  Treme_HC_IgG1-CO13
atggagactccagcccaactcctattcttgctccttctctggctccccgacaccaccggtcaggtccagctcgtcgagagcggaggcggcgttgtacagcccggccgcagccttcgactaagctgcgccgcctcgggctttaccttcagcagctacggcatgcactgggtcaggcaggccccaggcaaggggctcgagtgggtagccgtcatctggtacgacggaagcaataagtactacgcggacagcgttaagggccggtttaccatcagcagggacaacagcaagaacaccctctacttgcagatgaacagcctgagggcggaggatacggccgtgtactattgcgccagggatccccggggcgccaccctgtactactactattacggcatggacgtgtggggccagggcaccaccgttaccgtgagctcggccagcaccaaggggcccagcgtcttccccctggcccccagctccaagagcaccagcggcgggaccgccgccctgggctgcctggtgaaggactacttccccgagcccgtgacggtaagctggaacagcggcgccctgaccagcggcgtgcacaccttccccgccgtgctgcaaagcagcggcctctactccctgagtagcgtggtgaccgtgcccagctctagcctgggcacgcagacctacatctgcaacgtgaaccataaacccagcaacaccaaagtggataagcgggtggagcccaagtcctgcgacaagacacacacctgcccgccctgccccgcccccgagctgcttggcggccccagcgtctttctgttcccgcccaagccgaaggacacactcatgatcagccgtacccccgaggtcacctgcgtggtggtggacgtgagccacgaggaccccgaagtcaagttcaactggtatgtggacggcgtcgaagtccacaacgccaagaccaagcccagggaggagcagtacaacagcacctacagggtcgtctctgtgctgaccgtactgcaccaggactggctgaacggcaaggagtacaagtgcaaggtgagcaacaaggccctgcccgcccccatcgagaagaccatctccaaggccaagggccagccgagggaaccccaggtgtacaccctgcccccctcccgcgaggaaatgaccaaaaaccaggtgagcctgacctgcctggtgaaggggttctaccccagcgacatcgccgtggagtgggagagcaacggccagcccgaaaacaactacaagacgaccccgccggtgctggacagcgacggcagcttcttcctgtacagcaagctgacggtggacaagagccgttggcagcaaggcaacgtgttcagctgctccgtgatgcacgaggcgctccacaaccactacacccagaaatccctgagcctgtcgccggggaag

SEQ ID NO: 401 - DNA, 1425 bp, Artificial Sequence
  Treme_HC_IgG1-CO14
atggagacgcccgcccagctcctcttcctcctcctcctctggctccccgacaccacgggccaggtccagctcgtcgaaagcgggggcggcgtcgtccaacccggacgaagcctccggctctcctgtgccgcctcgggctttacattctccagctacgggatgcattgggtaaggcaagccccggggaagggcctcgagtgggtcgccgtcatctggtacgacgggagcaataagtactacgcagacagcgtcaagggccggttcacgatctccagggacaattccaagaacaccctctacctgcagatgaactccctgagggccgaggatacggccgtgtactactgcgcccgggaccccaggggagccaccctgtattactactactacggcatggatgtgtggggccaggggaccacggtgacggtgtccagtgccagcacaaagggccccagcgtgttccccctggcccccagcagcaagagcaccagcggtgggaccgccgcgctcggctgcctggtgaaggattacttccccgagcccgtgaccgtgagctggaactccggcgccctcacgagcggggtgcacacgttccccgcggtgctgcagagcagtggcctgtactccctcagcagcgtggtgaccgtgcccagcagctcactgggcacccagacctacatctgcaacgtgaaccacaagcccagcaacaccaaagtcgacaagagggtggagccaaaaagctgcgataagacccatacctgtcctccctgccccgcccccgagctgctcggcggacccagcgtcttcctgttccctcccaaacccaaggacaccctgatgatctccaggacccccgaggtgacgtgcgtggtcgtggacgtgtcccacgaggaccccgaggtgaagttcaactggtatgtggacggcgtggaggtccacaacgccaagaccaaaccccgggaggagcagtataacagcacctacagggtcgtgagcgtgctgaccgtgctccaccaggactggctgaacggcaaggagtacaagtgtaaggtttccaacaaggccctgcccgcccccatcgagaagacgatctccaaggccaagggccagcccagggagccccaggtgtataccctgcccccctctagggaggagatgaccaagaaccaggtgagcctgacgtgcctggtgaagggcttttacccctccgacatcgccgtggagtgggagagcaatggtcagcccgagaacaactacaagaccaccccgcccgtgctggacagcgacggctccttcttcctgtacagcaagctgaccgtggacaagtcccggtggcagcagggcaacgtgttcagttgctctgtgatgcacgaggccctgcacaaccactacacccagaaaagcttatccctgagccccggcaag

SEQ ID NO: 402 - DNA, 1425 bp, Artificial Sequence
  Treme_HC_IgG1-CO15
atggagacacccgcccaactgctctttttactcctcctctggctccccgacaccacgggccaggttcagttggtcgagtccgggggcggcgtcgtccagccgggccggagcctccgcctttcctgcgccgcctccggcttcaccttctccagctacggcatgcattgggtccgccaagcccccgggaaggggcttgagtgggtcgccgttatctggtacgacgggagcaacaagtattacgccgactccgtcaagggcagatttacgattagcagggacaacagcaagaacaccctttacctgcagatgaattccctgcgggcggaagacaccgccgtgtactactgtgcccgggaccccaggggcgcgaccctctactattactactatgggatggacgtgtgggggcagggcaccacggtgaccgtgagctctgcctccaccaagggccccagcgtattccctctggccccctccagcaaaagcaccagcggcggcacggccgccttggggtgcctggtgaaagattacttccccgaacccgtcaccgtgagctggaactccggcgccctgaccagcggggtgcacaccttccccgccgtgctgcagtcctccgggctctactcgctgagcagcgtggtgaccgtgcccagctcctccctgggcacccagacctatatctgcaacgtcaaccacaaacccagcaacaccaaggtcgataagcgggtggaacccaagagttgcgacaaaacccacacctgcccgccctgccccgccccagagctgctgggagggcccagcgtgttcctcttccctcccaagccgaaggacaccctcatgatcagccgcacccccgaagtgacgtgtgtggtggtggacgtgtcacacgaggaccccgaggtcaagttcaactggtatgtcgacggcgtcgaggtgcacaacgccaagacgaagccgagggaggagcagtacaacagcacctacagggtggtgtccgtcctgaccgtgctgcaccaggactggctgaacggcaaggagtataagtgcaaggtgagcaataaggccctgcccgcccccatcgagaagaccatcagcaaggccaagggccagccccgggagccccaggtgtacacactcccgcccagcagggaagaaatgaccaagaaccaggtgagcctgacctgtctcgtgaaaggcttctacccctccgacatcgcagtggagtgggagagcaacgggcagccggaaaacaactataagacgacgcccccggtgctggatagcgatggcagctttttcctgtacagcaaactgaccgtcgacaagtccaggtggcagcagggcaacgtgttcagctgcagcgtgatgcatgaagccctgcataaccattacacgcagaaaagcctgagcctgagccccggcaag

SEQ ID NO: 403 - DNA, 1425 bp, Artificial Sequence
  Treme_HC_IgG1-CO16
atggagacgcccgcccagctccttttcctcctcctcctctggctcccagataccaccggccaggtccagctcgtcgagagcggcggcggagtcgtccagcccggccgctcgcttcggctttcctgcgccgcctccgggttcaccttctcctcgtacggtatgcactgggtcaggcaggcccccgggaaagggctcgagtgggtagccgtcatctggtacgacggcagcaacaagtactacgccgacagcgtaaaggggcgcttcaccatctccagggacaacagcaagaacacgctttacctgcagatgaacagcctgagggccgaagacaccgccgtctactactgcgcccgggaccccaggggtgccaccttgtactattactactacgggatggacgtgtggggccagggcacgaccgtgaccgtgtcgagcgcgtccaccaagggccccagcgtgttcccgctggctcccagctccaagagcacctccgggggcacagcggccctgggctgcctggtgaaggactacttccccgagcccgtgacggtgagctggaattccggcgccttgaccagcggcgtccacacctttcccgccgtgctccaaagcagcggcctgtatagcctgagctccgtggtgacagtccccagcagcagcctcggcacccagacctacatatgcaacgtcaatcacaaaccctccaacaccaaggtcgacaaacgggtggagcccaaaagctgcgacaagacccatacgtgcccgccctgccccgcccccgagctgctgggcgggcccagcgtattcctcttcccgccgaagcccaaggacaccctgatgatcagcaggaccccggaggtgacgtgcgtggtggtcgacgtctcccacgaagaccccgaggtgaagttcaattggtacgtggatggcgtggaggtgcacaacgccaagacgaaacccagggaggagcaatataacagcacatacagggtggtgtccgtgctgaccgtgctgcaccaggactggctgaacggcaaggagtacaagtgcaaggtgagcaacaaggccctccccgcccccatcgagaagaccatcagcaaggccaagggccagcccagggagccccaggtgtacaccctgccacccagcagggaggagatgacgaagaatcaggtgagcctcacctgcctggtgaagggcttctaccccagcgacatcgccgtggagtgggagtccaacggccagcccgagaacaactacaagacgacccctcccgtcctggactccgacgggagcttcttcctgtactccaagctcaccgtggacaaaagccgttggcagcagggcaacgtgttcagctgcagcgtgatgcatgaggccctgcacaatcactatacccaaaagtccctcagcctgtcccccggcaag

SEQ ID NO: 404 - DNA, 1425 bp, Artificial Sequence
  Treme_HC_IgG1-CO17
atggagactcccgcccagcttctattcctactcttgctctggctcccggacaccaccggccaggtccagctcgtggagtccggcggaggggtggtccaacccgggcggtcgctccggctctcctgcgccgccagcggtttcacattcagcagctacgggatgcactgggttaggcaggcacccggcaagggcctcgagtgggtcgccgtcatctggtacgacggcagcaacaaatactacgccgatagcgtcaaaggacgctttacgatcagccgggacaactccaagaacaccctctacctgcagatgaacagcctgagggcggaggacaccgccgtgtattactgcgccagggatcccaggggcgccaccctgtactactactattacggcatggatgtgtggggccaggggacgacggtgaccgtgagctccgcctccaccaagggcccaagcgtgttccccctggcccccagcagcaagagcaccagcggcgggaccgccgccctggggtgcctggtgaaggactacttccccgagcccgtgacggtgtcctggaactccggcgcgctgaccagcggggtgcacaccttccccgccgtgctgcagagcagcggcctgtacagcctgtccagcgtggtgaccgtgccctcctcaagcctgggcacccagacctacatctgcaacgtcaatcacaaacctagcaacaccaaagtggataagcgggtggagcccaaatcatgcgacaagacgcacacttgtccaccgtgccccgcccccgagctcctgggtgggcccagcgtgttcctgttccctcccaagcccaaggacacgctcatgatctcgcggacccctgaggtgacctgtgtggtggtggacgtgagccacgaggatcccgaggtgaagttcaactggtacgtggatggcgtggaggtgcacaacgccaagaccaaaccccgggaggaacagtacaacagcacgtaccgggtggtgagcgtcctgaccgtgctgcaccaggactggctaaacggcaaagagtacaagtgtaaggtgagcaataaggccctgccggcccccatcgagaagacgatctccaaggccaagggccagccccgggagccgcaggtgtacaccctgccccccagtagggaggaaatgaccaagaaccaggtgagcctgacgtgtctggtgaagggcttctacccctcagacatcgccgtggagtgggagagcaacggccagcccgagaacaattataagaccaccccgcccgtgctggattcggacggctcctttttcctctacagcaagctgaccgtcgacaagtcccgatggcagcagggcaacgtgttcagctgcagcgtgatgcacgaggcgctgcacaaccactacacgcagaaaagcctgagcctcagccccggtaag

SEQ ID NO: 405 - DNA, 1425 bp, Artificial Sequence
  Treme_HC_IgG1-CO18
atggagacacccgcccagttgcttttcctcctccttctctggctccccgacaccaccgggcaggtccagctcgtcgagagcggcggcggcgtcgttcagcccggacggtccctcaggctcagctgcgccgccagcggtttcacgtttagcagctacggcatgcattgggtcaggcaagcgcccggcaaggggctggagtgggtcgccgtcatctggtacgacgggagcaacaagtactacgccgacagcgtcaagggcaggttcaccatcagccgcgacaatagcaagaacaccttatatctgcagatgaacagcctcagggccgaggacacggccgtctactactgtgccagggacccccggggcgccaccctgtactactactactacggcatggatgtgtggggccaaggcaccaccgtgaccgtcagcagcgcgtccaccaaagggcccagcgtattccccctggccccttccagcaagtccacctccggcggcaccgccgccctgggctgcctggtgaaggactacttccccgagcccgtcaccgtatcttggaacagtggcgccctgaccagcggcgtgcatacctttcccgccgtgctgcaatccagcggactgtacagcctgtcctccgtggttaccgtgcccagcagctccctgggcacgcagacctacatctgtaacgtgaaccataagccctccaataccaaggtggacaagcgtgtggagcccaagagctgcgacaagacccacacctgtccgccctgccccgccccggagctgctgggcggccccagcgtgttcctgttcccacccaagcccaaggacaccctgatgatcagccggacccccgaggtgacctgcgtggtggtggacgtgagccacgaggaccccgaggtgaaattcaactggtacgtggacggcgtggaggtgcacaacgccaagaccaagccgagggaggagcagtacaattccacctacagggtggtgagcgtgctcaccgtgctgcatcaggactggctgaatgggaaggaatacaaatgcaaagtgagcaacaaggctctgcccgcccccattgagaaaacaatcagcaaagccaaaggccagcccagggagccccaggtgtacaccctgccgccgagccgggaggagatgaccaagaaccaggtgagcctgacctgcctggtgaagggcttttatccctctgacatagccgtggagtgggagagcaacgggcagcccgagaacaactacaagacgaccccgcctgtgctggactccgacgggtccttttttctgtatagcaagctcacggtggacaagtccaggtggcagcagggcaacgtgttcagctgcagcgtgatgcacgaggccctgcataaccactatacccagaaaagcctgagcctgagccccggcaag

SEQ ID NO: 406 - DNA, 1425 bp, Artificial Sequence
  Treme_HC_IgG1-CO19
atggagacgcccgcccaattactctttctcctcctcctttggctccccgataccaccgggcaggtacaactcgtagagtccggcggcggcgtcgttcagcccggccggtcccttcggctcagctgcgcggcctccggctttacgttcagcagctacggcatgcattgggtacggcaggcccccggcaagggcctcgagtgggtcgccgtcatctggtacgacggcagcaataagtactacgccgattccgtcaagggaagatttaccatcagccgggacaactccaagaacaccctctacctccagatgaactccctgcgggccgaggacaccgccgtgtactactgcgccagggacccccggggcgccaccctgtactactactactacgggatggacgtgtggggccagggcaccaccgtgaccgtcagcagcgcgagcacgaaagggcccagcgtgttcccgctggccccgtccagcaagtccaccagcggcggcaccgccgccctgggttgcctcgtgaaggactacttccctgagccggtgaccgtgtcctggaactccggcgccctgaccagcggagtgcacaccttccccgcggtgctgcagagcagcgggctgtacagcctaagctccgtagtgacggtcccctccagcagtctggggacccagacctacatatgcaacgtgaaccacaaaccctcgaacaccaaggtggataagagggtcgagcccaaatcctgcgacaaaacccatacgtgcccgccctgccccgcgcccgagctgctgggtgggccatcggtgttcctgttccccccgaagcccaaggacacactgatgatcagccggacccccgaagtgacctgcgtggtggtggacgtgagccacgaggacccggaggtgaagttcaattggtacgtggatggcgtggaggttcataatgccaagaccaagccgcgggaagaacagtataactccacctaccgggtggtgagcgtgctcaccgtcctgcaccaggactggctgaatgggaaggagtacaagtgcaaagtgtccaataaagcccttcccgcccccatcgagaagacgatcagcaaggccaaaggacagccccgggagcctcaggtgtacacgctgccccccagcagggaggagatgaccaagaaccaggtgagcctgacctgtctggtgaagggcttctacccaagcgatatcgcggtggagtgggagtccaacggccagcccgagaacaattacaagaccaccccgcccgtgctggattccgacgggagcttcttcctgtacagcaagctgaccgtggacaagtcccggtggcagcagggaaatgtgttcagctgtagcgtgatgcacgaagccctgcacaaccattacacccagaaaagcctgagcctgagccccggcaag

SEQ ID NO: 407 - DNA, 1425 bp, Artificial Sequence
  Treme_HC_IgG1-CO20
atggagacgcccgcccagctcctcttcctcctcctcctctggctcccggacacaaccgggcaggtacagctcgtcgagtccggcgggggtgtcgtccagcccgggcgttcccttaggctcagctgtgcggcctccgggttcaccttcagcagctacggcatgcactgggtaaggcaggcccccggtaaggggctcgagtgggtcgcggtcatctggtacgacgggtccaacaagtactacgccgactccgtgaaggggaggttcaccatctcccgagacaacagcaagaataccctctacctgcaaatgaattccctgcgggccgaggataccgccgtctactattgcgccagggacccccgaggcgccacgctgtactactactactacgggatggacgtgtgggggcagggcaccaccgtgaccgtgagctccgccagcaccaagggaccctccgtgttcccgctcgcgcccagctccaaaagcaccagcggcggtacagccgcgctgggatgcctcgtgaaggactacttccccgagcccgtcaccgtgagctggaatagcggagccctgacgagcggcgtgcacaccttccccgccgtcctgcagagcagcggcctgtactcgctctcctcggtggtgaccgtgcccagcagcagcctgggcacccagacctatatctgcaatgtgaaccacaagcccagcaacaccaaggttgacaagcgggtggagcctaagtcctgcgacaaaacccacacctgcccgccctgccccgcccccgagctgctcggcgggcccagcgtgttcctgttcccgcccaagcccaaggacaccctgatgatcagccgcaccccggaggtcacctgtgtggtggtggacgtgagccatgaggaccccgaggtgaagttcaactggtatgtggacggggtggaggtgcacaacgccaagaccaaaccgagggaggagcagtacaactccacctacagggtggtgtccgtcctgaccgtgctgcaccaggattggctcaacgggaaggagtacaaatgcaaggtgagcaacaaggccctgcccgcccccatcgagaagaccatcagcaaggccaagggacagcccagggagccccaggtgtataccctccctcccagccgtgaggaaatgaccaagaaccaggtgagcctgacctgtctggtcaaagggttctaccccagcgacatcgccgtcgagtgggaaagcaacggccagcccgagaacaactacaagaccacgccccccgtgctggacagcgatggcagctttttcctgtacagcaagctgacggtggacaagtcgaggtggcaacagggcaacgtgttctcgtgcagcgtgatgcacgaggccctgcacaaccactatacccagaaaagcctcagcctgtcccccggcaag

SEQ ID NO: 408 - DNA, 1425 bp, Artificial Sequence
  Treme_HC_IgG1-CO21
atggaaacccccgcccaactcctcttcctcttgctcctctggctccccgatacgaccgggcaggtccagctcgtcgaaagcgggggaggcgtggtacagcccgggcgtagcctcaggctcagctgcgccgcctccgggttcaccttttcatcttacggcatgcactgggttcggcaggcccccggcaagggcctcgagtgggtcgccgtgatctggtacgacggctcgaacaagtactacgcggactccgtcaagggcaggttcaccatcagccgggataactccaaaaacaccttatacctgcagatgaactccctccgggccgaggacaccgccgtgtactattgcgcgcgcgatcccaggggcgcgaccctgtactactactactatggcatggacgtgtgggggcaaggtaccaccgtcaccgtcagcagcgccagcaccaaaggcccctcggtgttccccctggcgcccagcagcaaaagcaccagcgggggcaccgcggccctgggctgcctggtcaaagactacttccccgagcccgtgaccgtgtcctggaacagcggggccctgaccagcggcgtgcacaccttcccggccgtgctgcagagcagcgggctgtacagcctgagctccgtggtgacggtgccctccagcagcctggggacacagacgtacatatgtaacgtgaaccataagcccagcaacaccaaagtggacaaacgcgtggaacccaaaagctgcgacaagacccacacttgtcccccctgccccgcccccgagctcctgggcgggcccagcgtgttcttgttccccccgaaaccgaaggacaccctgatgatttcccggacccccgaagtgacctgcgtagtcgtggacgtgagccacgaggaccccgaggtgaagttcaattggtacgtggacggcgtggaggtccacaacgccaagaccaagccccgggaggagcagtacaactccacctatagggtcgtgagcgtgctgaccgtgctgcaccaggactggctgaacggcaaggagtataagtgcaaggtgtccaataaggccctccccgcccccatcgagaagaccatatccaaggccaagggccagccaagggagccgcaggtgtacaccctgccgccctcgagggaggagatgaccaaaaatcaggtgagcctgacctgcctggtcaaggggttctacccgagcgacatcgccgtggagtgggagagcaacgggcagcccgagaacaactacaagaccacccctcccgtcctggactccgacggcagcttcttcctgtattccaagctgaccgtggataagtccaggtggcagcagggcaacgtgttcagctgtagcgtgatgcatgaggccctgcataaccattacacccagaaatccctgagcctgagcccgggcaaa

SEQ ID NO: 409 - DNA, 1425 bp, Artificial Sequence
  Treme_HC_IgG1-CO22
atggagacgcccgcccagctcctcttcctcctcctcttatggctccccgacaccaccggccaggtccagctcgtcgagagcgggggcggggtagtccagcccggcaggtccctccggcttagctgtgccgcctcggggttcacattcagctcctacggcatgcactgggtacgacaggcaccggggaagggactcgagtgggtcgccgttatctggtacgacggcagcaacaagtactacgccgacagcgtcaaaggcaggttcaccatcagcagggacaacagcaagaacaccctatacctgcagatgaatagcctgcgagccgaggacactgccgtgtattattgcgccagggatccccggggagccacgctctattattactactacgggatggacgtgtggggccaggggaccaccgtgacggtgtcatctgcctccacgaagggtccgagcgtgttcccgctggcccccagctccaagagcacgagcggcggcaccgccgccctgggctgcctggtgaaggattacttccccgagcccgtgaccgtgtcctggaatagcggcgccctgaccagcggcgtgcataccttccccgccgtcctgcagagcagcggcctgtacagcctgtcttccgtggtcaccgtgcccagcagcagcctcggcacgcagacctatatctgcaacgtgaaccacaaaccgagcaacacgaaggtggacaagcgtgtggagcccaaaagctgcgataagacccacacgtgtcccccctgccccgcccccgagctgctgggcgggcccagcgtgttcctgttccccccgaagcccaaggacaccctgatgatctcccgaacccccgaggtgacctgtgtagtcgtcgatgtgagccacgaggacccggaggtgaaatttaactggtacgtggacggggtggaggtgcacaacgcgaagacgaagccccgagaggagcagtacaacagcacctacagggtggtgagcgtcctgaccgtgctgcaccaggactggctgaacgggaaagagtacaagtgtaaagtcagcaacaaggccctgcccgcccccatcgagaagaccatctccaaggccaagggccagccccgcgagccccaagtgtacaccctgccccccagcagggaggagatgaccaagaaccaggtgagcctgacgtgcctggtcaagggcttttacccctccgacatcgcggtcgagtgggagagcaatggccagcccgagaacaactacaagaccaccccgcccgtgctggactccgacggcagcttcttcctgtacagcaagctgaccgtggacaagtcgcggtggcaacaaggcaacgtgttctcctgctcggtgatgcacgaggccctgcacaaccactacacccagaaaagcctgagcctcagccccggtaag

SEQ ID NO: 410 - DNA, 1425 bp, Artificial Sequence
  Treme_HC_IgG1-CO23
atggagacacccgcgcagttgctattcctcctactcctctggctccccgataccacgggccaggtccaattggtagagtccggcggcggcgtagtccagcccggccggtccctcaggctttcctgcgccgcctcgggcttcaccttctccagctacgggatgcactgggtccggcaggcccccgggaagggcttggagtgggtcgccgtcatctggtacgacggaagcaacaagtactacgccgactccgtcaagggtaggttcaccatcagcagggacaactcgaagaacaccttgtatctgcagatgaactcccttagggccgaggacacggccgtgtactactgcgcccgggaccctcgaggagccaccctgtactactattactacgggatggacgtgtgggggcaagggacgaccgttaccgtgagctccgccagcacgaaggggcccagcgtcttcccactggcccctagcagcaagagcacctccggcggcaccgccgccctgggctgcctggtgaaggattacttcccggagcccgtgaccgtgagctggaactccggcgcgctcaccagcggcgtccacaccttccccgccgtgctgcagagcagcgggctgtattcgctgagctcggtggtcaccgttcccagctcaagcctggggacccagacgtatatctgtaacgtgaaccacaagcccagcaacaccaaggtggacaaaagggtcgagcccaagagctgcgacaagacccatacatgtcccccctgccccgcgcccgagctgctggggggacccagcgtgttcctctttccgcccaagcccaaagacaccctcatgatcagccgaacccccgaggtcacctgcgtggtagtagacgtgagtcacgaggacccggaggtgaagttcaattggtacgtggacggcgtggaggtgcacaacgccaagaccaaaccccgtgaggagcagtacaatagcacctacagggtcgtgagcgtgctcaccgtgctccaccaggactggctgaacggcaaggagtacaaatgcaaggtgtcgaacaaggcgctccccgcccccatcgaaaagactatctccaaggctaagggccagcccagagagccccaggtgtacaccctgcccccgtcccgggaggaaatgaccaagaaccaggtcagcctcacctgcctggtgaagggcttttaccccagcgacatcgcagtggagtgggagagcaacggtcagcccgaaaataactataagaccaccccgcccgtcctggacagcgacggaagcttcttcctgtacagcaagctcaccgtggacaagtcccggtggcagcagggcaacgtatttagctgctccgtgatgcacgaagccctgcacaaccactacacccagaaaagcctgtccctcagccccggcaag

SEQ ID NO: 411 - DNA, 1425 bp, Artificial Sequence
  Treme_HC_IgG1-CO24
atggagacgcccgcccagctcctcttcctcctcctcctatggctacccgacacaaccgggcaggtccagctcgtcgaatccggcggcggggtagtccagccaggtcgctccctcaggttgtcctgcgccgcctccggctttacgttcagcagctacggcatgcactgggtccgacaggcccccggcaaggggctcgagtgggtcgccgtaatctggtacgacggcagcaacaagtactacgccgacagcgtcaagggaaggttcaccatcagcagggacaatagcaagaacaccctatacctccagatgaacagcctgagggcggaggacaccgccgtgtactactgcgcccgggaccccaggggagccaccctgtattattactactatgggatggacgtgtggggccaaggcaccaccgtgaccgtgtcctccgcgagcaccaaggggcccagcgtgttccccctcgcgccctccagcaagagcaccagcggggggaccgccgccctggggtgcctggtgaaggactacttccccgagcccgtgaccgtctcctggaacagcggcgccctgacgtccggcgtgcacaccttccccgccgtcctgcagagcagcggcctgtactccctgtcatcggtcgtgaccgtgccgtcctcctccctcggcacccagacctacatctgtaacgtgaaccacaagccctccaacacaaaggtggacaaacgggtagagccgaagtcctgtgacaagacccacacctgccctccctgccccgctcccgagctgctcggcgggcccagcgtcttcctcttccctcccaagcccaaggacacgctaatgatctcccgcacccccgaggtgacctgcgtggtggtggacgtgagccacgaggacccggaggtgaagttcaactggtacgtggacggcgtggaggtgcacaacgccaagaccaaacccagggaggagcagtataatagcacctatagggtggtgtccgtgctaacggtgctgcaccaggactggctcaacgggaaggagtacaagtgcaaggtcagcaacaaggcgctgccggccccgatcgagaagaccatctcgaaggccaaggggcagcctagggagccccaggtctacacgctgccccccagcagggaggaaatgaccaagaaccaggtgtccctgacgtgcctggtgaagggtttctaccccagcgacatcgccgtggagtgggagagcaacggccagcccgagaacaactataagaccaccccgcccgtgctggacagcgacgggagcttcttcctctatagcaagctgaccgtggacaagagccgctggcagcagggcaacgtgttctcctgctccgtgatgcacgaggccctgcacaaccactacacgcagaaatccctgtccctgagcccgggcaag

SEQ ID NO: 412 - DNA, 1425 bp, Artificial Sequence
  Treme_HC_IgG1-CO25
atggagacacccgcccagctccttttcctcctcctcctctggctccccgacaccaccgggcaggtacaactcgtcgagtccggcggcggggtcgtacagcccggccggtccctccggctctcctgcgccgccagcggcttcaccttctcaagctacgggatgcattgggtcagacaggcccccggtaaggggctcgagtgggttgcggtcatctggtacgacggcagcaacaagtactacgccgacagcgtcaaaggccggttcacgatcagccgcgacaacagcaagaacaccctctacctgcaaatgaattcccttagggccgaggatacggccgtctattactgcgcccgcgacccgaggggcgccaccctgtattattactactacggcatggacgtgtggggccagggcaccacggtgaccgtctccagcgcctccaccaagggtccctcggtgttccccctggcgcccagctcgaagtccaccagcggcgggaccgcggccctgggatgtctggtcaaggactacttcccagagcccgtgaccgtgtcctggaactcaggggccctgacttccggggtgcacaccttcccggccgtgctgcaaagctcggggctgtacagcctgagctccgtggtgaccgtccccagcagcagcctgggcacccagacctacatctgcaacgtgaaccacaagcccagcaataccaaggtggacaagagggtggagcccaagtcctgcgataagacgcatacctgcccgccctgtcctgcccccgaactgctgggagggcccagcgtgttcctcttcccacccaagcccaaggacaccctgatgatctcccgcacgcccgaggtgacctgcgtggtggtggacgtgagccacgaagaccccgaggtgaagttcaactggtacgtcgatggtgtggaggtacacaatgcaaagacgaagcccagggaggagcagtacaatagcacctacagggtggtgagcgtgctgacggtcctgcatcaggactggctgaacggcaaggagtacaagtgcaaggtcagcaacaaggccctgccggcccccatcgagaagaccatcagcaaggccaagggccagccgagggagccccaggtgtacaccctgcccccctccagggaagagatgaccaagaaccaggtgtccctgacctgcctggtgaaggggttctacccctcagacatagctgtggagtgggagtctaatgggcagcccgagaacaattacaagaccaccccgcccgtgctggactccgacggcagcttcttcctctactccaaactgacggtggataagagccgatggcagcagggcaacgtgttttcctgctccgtgatgcacgaggccctgcacaaccactacacccagaagtccctcagcctgtcccccggcaag

SEQ ID NO: 413 - protein, 235 aa, Artificial Sequence; identical to SEQ ID NO: 267
  IPI_LC (ipilimumab light chain)

SEQ ID NO: 414 - protein, 20 aa, Artificial Sequence
  IPI_LC (signal peptide)
METPAQLLFLLLLWLPDTTG

SEQ ID NO: 415 - protein, 108 aa, Artificial Sequence; identical to SEQ ID NO: 185
  IPI_LC (variable region, VL)

SEQ ID NO: 416 - protein, 107 aa, Artificial Sequence [sequence omitted]

SEQ ID NO: 417 - DNA, 705 bp, Artificial Sequence
  IPI_LC-CO01
atggagactcccgcccagctcctcttcctactcctcctctggctccccgacacgaccggcgagatcgtcctcacccagtcccccggcaccctcagcctcagccccggcgagagggccaccctctcgtgcagggccagccaatccgtaggcagcagctacctagcctggtaccagcagaagccgggccaagccccaaggctcctcatctacggggcctttagcagggccaccgggatccccgacaggttcagcgggagcgggagcgggacggacttcaccctcaccatctcccgcctcgagcccgaggacttcgctgtctactactgccagcaatacggcagctccccctggacattcggccaggggaccaaggtggagatcaagaggaccgtggcggccccctccgtgttcatcttcccgccctcagacgagcagctgaaaagcggcaccgcctccgtggtgtgcctcctcaacaacttttacccccgcgaggccaaggtgcagtggaaggtggacaacgccctgcagagcggtaactcgcaggagagcgtgaccgagcaggacagtaaggacagcacctacagcctgtccagcaccctcaccctcagcaaggccgactacgagaagcacaaggtgtacgcctgcgaggtgacccaccaggggctgagcagccccgtgaccaagagcttcaacaggggggagtgt

SEQ ID NO: 418 - DNA, 705 bp, Artificial Sequence
  IPI_LC-CO02
atggaaacccccgctcagctcctcttcttactcctcctctggttgcccgacaccacgggcgagatcgttctcacccagtcccccgggacccttagcctcagcccgggggagagggccaccctcagctgccgggccagccagagcgttggcagcagctacctcgcctggtaccagcagaagcccggccaggccccgaggctcctcatatacggggccttctccagggcgaccgggatccccgacaggttcagcggctcgggctccgggaccgacttcaccctcaccatctcgagactcgagccggaggacttcgccgtgtactattgccagcagtatggctcctccccctggacctttggacagggcaccaaggtggagatcaagaggaccgtggccgcacccagcgtgttcatctttccaccgagcgacgagcagctgaagtccggcaccgccagcgtggtgtgcctactcaacaacttctaccccagggaagccaaggtgcagtggaaagtggacaacgccctgcagagcgggaactcccaggagtccgtgaccgaacaggactccaaggacagcacgtacagcctcagcagcaccctcaccctgagcaaggccgactacgaaaaacacaaggtctacgcctgcgaggtgacccaccaggggctgtcctcccccgtcaccaaaagctttaacaggggcgagtgc

SEQ ID NO: 419 - DNA, 705 bp, Artificial Sequence
  IPI_LC-CO03
atggagacgcccgcccagctcctcttcctcctcctcctctggctccccgacaccaccggagagatagtcctcacgcaaagccccggcactctctccttgagccccggcgagagggccaccctctcctgccgggccagccagagcgtcggtagcagctatttggcctggtaccaacagaagcccggccaggcgccccgcctcttgatctacggggccttcagccgggcgacgggcatcccggacaggttttccgggagcggcagcggcaccgacttcaccctcacaatcagccgactagaaccagaggattttgccgtctattattgccagcagtacggctcgagcccctggaccttcggacagggcacgaaggtggaaatcaagcgtaccgtcgccgccccctccgtgttcatcttcccgcccagcgacgagcaactcaagagcggcacggccagcgtggtgtgcctgcttaacaacttctatccgcgggaagccaaggtgcagtggaaagttgataacgccctgcaatccggcaatagccaggagagcgtcaccgagcaggactccaaggacagcacgtatagcctgagctcgaccctgaccctgagcaaggctgactacgagaagcacaaggtgtacgcctgtgaggtgacgcatcaggggctgagctcgcccgtgacgaagtccttcaacaggggcgagtgc

SEQ ID NO: 420 - DNA, 705 bp, Artificial Sequence
  IPI_LC-CO04
atggagactccggcccaactcctcttcctactcctcctctggcttcccgacaccaccggcgagatagtcctcacccagagccccggcacactcagcctctcccccggcgagagggccaccctctcttgtcgggcctcccagagcgtcggctcgagctacctcgcctggtaccagcaaaagccgggccaggcgccgaggctactcatctacggcgccttcagccgcgccaccggcatccccgaccggtttagcggcagcggcagcggcaccgacttcaccctcaccataagcaggctcgagccggaggacttcgccgtgtactactgccagcagtacggcagcagcccctggaccttcggccagggcaccaaggtggagatcaagcgcaccgtggccgcccccagcgtgttcatcttcccacccagcgatgagcagctcaagagcgggaccgccagcgtcgtgtgtctgctcaacaacttctatccccgggaagccaaggtgcagtggaaggtggacaacgccctgcagtccgggaatagccaggagtccgtgaccgagcaggatagcaaggactccacgtacagcctctcgagcaccctgaccctctcgaaggccgattacgaaaagcataaggtctacgcctgtgaggtgacccaccaggggctctccagccccgtgacgaaaagcttcaataggggggagtgc

SEQ ID NO: 421 - DNA, 705 bp, Artificial Sequence
  IPI_LC-CO05
atggaaaccccggcccagctcctcttcctcctcctcctctggttgcccgacaccaccggagagatcgttctcacgcagagccccgggaccctatcgctctcgcccggggagagggccaccttgtcctgccgggccagccaaagcgtcggctccagctacctcgcctggtatcagcagaagcccggccaggccccgaggttgcttatctacggggccttcagccgggccacaggcatacccgaccggttcagcgggtccggcagcggcaccgacttcaccctcaccatatcgaggctcgagcccgaggacttcgccgtgtattactgccagcagtacggcagctcgccctggaccttcggccagggcactaaagtggagatcaagaggacggtggccgccccctccgtgttcatcttcccgcccagcgatgagcagctgaaaagcggcaccgctagcgtggtgtgcctcctcaacaacttctaccccagggaggcaaaggtgcaatggaaggtggataacgccctgcaatccggcaacagccaggagtccgtgaccgaacaggatagcaaggattcgacgtacagtctgagcagcaccctgaccctgtccaaggccgactacgagaagcacaaggtgtacgcctgcgaggtgacccaccagggcctgtcgtcgcccgtgaccaagagcttcaaccggggcgagtgc

SEQ ID NO: 422 - DNA, 705 bp, Artificial Sequence
  IPI_LC-CO06
atggagacgcccgcccagctcctcttcctcctcctcctctggttgcccgacaccaccggcgagatcgtcctcacccaatcccccgggaccctctccctctccccaggcgagagggccacgctttcctgcagggcctcgcagagcgtcggcagctcctacctcgcctggtatcagcagaagcccggccaggccccgcggctattgatctacggggcctttagccgggccaccggcatccccgacaggttcagcggctccgggagcggcaccgacttcacgctcacgatcagcaggctcgagccggaggatttcgccgtgtactactgccagcagtacgggagcagcccgtggaccttcgggcaaggcacgaaggtcgagataaagaggaccgtggccgcccccagcgtgttcatcttcccgcccagcgacgagcagctgaaaagcggcactgccagcgtggtgtgtctgctgaacaacttctacccccgggaggccaaggtccagtggaaggtggataacgccctgcagtccggcaacagccaggagagcgtgaccgagcaggactccaaggactccacctacagcctgtccagcaccctcaccctcagcaaggccgactatgagaagcataaggtctacgcctgcgaggtgacccaccagggcctgagcagcccagtgaccaagtcctttaaccgcggggagtgc

SEQ ID NO: 423 - DNA, 705 bp, Artificial Sequence
  IPI_LC-CO07
atggagactcccgcccagctcctcttcttgctactcctctggctcccggacaccaccggcgagatcgttctaacgcaaagccccggcaccctcagccttagcccgggcgagagggccaccctctcctgtagggccagccagtccgtagggagctcctacctcgcctggtaccaacagaagcccggccaggcccccaggttgcttatttacggggccttcagccgcgccaccggcatacccgataggttcagcggtagcggcagcgggaccgatttcacgctcaccatcagcaggctcgagcccgaggactttgccgtgtattactgtcaacagtacggcagcagcccctggacgttcggccagggcaccaaggtggagatcaagcggaccgtggccgcccccagcgtgttcatctttcccccctctgacgagcagctgaaaagcggcacggccagcgtggtgtgcctgctgaacaatttctaccccagggaggccaaggtccagtggaaagtcgataacgccctgcagtccggcaacagccaggagagcgtcaccgagcaggatagcaaggacagcacctacagcctcagcagcaccctgaccctgagcaaggccgactacgagaagcacaaggtatacgcctgcgaggtgacgcaccaggggctcagcagccccgtgaccaagagcttcaaccggggcgagtgc

SEQ ID NO: 424 - DNA, 705 bp, Artificial Sequence
  IPI_LC-CO08
atggagacacccgcccagcttttattccttctcctcctatggctccccgacaccaccggggagatcgtactcacccagtccccgggcaccctcagcctcagccccggcgagagggccacactctcctgtcgggcctctcagagcgtcggaagctcctacctggcctggtaccagcaaaagcccggccaggcgccccgacttctcatctacggggctttctccagggccacgggcatccccgacaggttttccggcagcggcagcggcaccgacttcacgctcaccatctcgaggctagagcccgaggatttcgccgtgtactactgccagcagtacggcagcagcccgtggaccttcgggcagggcaccaaggtggagatcaagcgcaccgtggcggccccgagcgtcttcatcttcccacccagcgacgagcagctgaaaagcgggaccgccagcgtggtgtgtctgctcaacaatttttacccccgggaggccaaggtgcagtggaaggtggacaacgccctgcagagcgggaactcgcaggagtcggtcaccgagcaggacagcaaggactccacgtattccctgtcctcgaccctgaccctgtcaaaggccgactatgagaagcacaaggtctacgcctgcgaggtgactcaccaggggctgagcagccccgttaccaaatcctttaacaggggggagtgc

SEQ ID NO: 425 - DNA, 705 bp, Artificial Sequence
  IPI_LC-CO09
atggaaacccccgcccagctactcttcctcctcctcctctggcttccggatacaaccggcgagatcgtcctcacccagtcccccgggaccctcagcctctcccccggggaaagggcgaccctcagctgtcgggccagccaaagcgtcgggagcagctacctcgcctggtaccagcagaagcccggacaggccccccgcctcctcatttacggggcgttcagccgggccaccggcatccccgaccgcttctccgggagcggcagcggaacggacttcacgctcacgatcagcaggctcgagccggaggactttgccgtctattactgtcagcaatacggtagctccccctggaccttcggccaggggaccaaggtggaaatcaagcggaccgtggccgccccgagcgtgttcatcttcccgcccagcgacgagcagctgaaaagcggtaccgcctccgtggtgtgcctgctgaacaacttctacccaagggaggccaaggtgcagtggaaggtggacaacgccctccagagcgggaactctcaggagagcgtcaccgagcaggattcgaaggacagcacctacagcctgtcctcgaccctgaccctgtcgaaggccgactacgagaagcataaagtctatgcctgcgaagtgacccaccagggcctcagcagccccgtgacgaagtccttcaacaggggggagtgc

SEQ ID NO: 426 - DNA, 705 bp, Artificial Sequence
  IPI_LC-CO10
atggagactcccgcccagctcctcttcctcctcctcttgtggctcccggacaccaccggcgaaatagtcctcacccagagccccggcaccctcagcctctccccaggggaacgggccacgctaagctgcagggcctcccagtccgtcgggagcagctatctcgcgtggtaccagcagaagccggggcaggccccccggctcctcatatacggggccttcagtagggccacgggcatacccgacaggttcagcgggtccggctcgggcacggacttcaccctgaccattagccggttggagcccgaggacttcgccgtatattactgccagcagtacggctccagcccctggaccttcggccaggggaccaaggtggagataaagaggaccgtcgccgcccccagcgttttcatcttcccgccctccgacgagcagctgaagtccgggaccgcctccgtggtgtgcctgctcaacaacttctaccccagggaggccaaggtccagtggaaggtagacaacgccctccagtccgggaacagccaggagagcgtgacagaacaggacagcaaggactccacctattccctgtctagcaccctgaccctgagcaaggccgattacgagaagcacaaggtgtacgcctgcgaagtgacccaccagggcctcagctcccccgtgaccaagagcttcaaccggggcgagtgc

SEQ ID NO: 427 - DNA, 705 bp, Artificial Sequence
  IPI_LC-CO11
atggagactcccgcccagctcctcttcctcctcctcctctggctacccgacaccaccggcgagatcgtcctcacgcagtcccccggcaccctcagcttgagccccggggagcgggccaccctctcttgcagggccagccagagcgtcggctcctcctacctcgcctggtatcagcagaaaccaggccaggccccccgtctccttatctacggcgccttcagccgcgctaccggaatccccgaccggttcagcggcagcggttccggcacagatttcacgctcaccatttccaggctcgagcccgaggacttcgccgtgtactactgccagcagtacggcagctcgccctggaccttcggacaggggaccaaggtggaaatcaagaggaccgtggcggccccctccgtgtttatcttcccgccctcggacgagcagctaaagagcggcaccgcctccgtggtgtgcctgctcaacaacttctatccccgggaggccaaggtgcagtggaaggtggacaacgccctccagagcggaaactcgcaggagagcgtcaccgagcaggactccaaggactcgacttacagcctgagctccaccctgaccctcagcaaggccgattacgagaagcacaaggtctacgcctgcgaggtgacccaccagggactgagctcccccgtgaccaagagcttcaaccggggggagtgc

SEQ ID NO: 428 - DNA, 705 bp, Artificial Sequence
  IPI_LC-CO12
atggagacgcccgcccagctactcttcctcctcctcctctggctccccgacaccaccggggagatagtcttgacccagtcccccggcacgctttccctctcccccggggagagggcgaccctcagctgtagggccagccagagcgttggcagcagctacctcgcctggtatcagcagaagccgggccaggccccgaggctcctcatctacggagctttctccagggccaccggaatccccgaccggttctccggcagcggcagcgggaccgacttcaccttgaccatctccaggctcgagcccgaggacttcgccgtgtactactgtcagcagtacggctcatcgccctggaccttcgggcagggcaccaaggtggaaatcaagaggacggtggccgcccctagcgtgttcatctttccccccagcgacgagcagctgaaaagcggcaccgcctccgtggtctgcctgctcaataatttctacccgcgtgaggccaaggtgcaatggaaagtcgacaacgccctccagagcggcaacagccaggagagcgtgacagagcaggacagcaaggactccacctacagcctgtcctccactctgaccctgtcgaaggccgactacgaaaagcacaaagtctacgcctgcgaggtcacgcaccaggggctgagtagccccgtgaccaaatccttcaacaggggcgagtgc

SEQ ID NO: 429 - DNA, 705 bp, Artificial Sequence
  IPI_LC-CO13
atggagactcccgcccagctcctctttctcctcctcctctggctacccgacaccaccggcgagatcgtcctcacccagagccccggcactctcagcctcagccccggggagcgggccaccttatcgtgcagggcctcccaatccgtgggaagcagctacctcgcgtggtaccagcagaagcccggccaggccccgcggcttctcatctacggagcctttagcagggccaccggcatcccggacaggttctcaggcagcggcagcggcaccgattttaccctcaccatcagccgactagaaccggaggacttcgccgtgtactactgccagcagtacggcagctcaccctggaccttcggccagggcacgaaggtggaaatcaagcgcaccgtggccgcgcccagcgtgttcatcttccctcccagtgacgaacagctgaagtccgggaccgcctcggtggtctgcctgctgaacaacttttatcccagggaggccaaagtgcagtggaaggtggataacgcgctgcaaagcggcaacagccaggagagcgtcaccgagcaggacagcaaggacagcacctactcgctgtcctcgaccctgacgctgagcaaggccgactacgagaagcacaaggtgtacgcctgtgaggtcacgcatcagggcctcagcagccccgtgaccaagagcttcaaccggggcgagtgc

SEQ ID NO: 430 - DNA, 705 bp, Artificial Sequence
  IPI_LC-CO14
atggagacgcccgcacagctcctcttcctccttctcctctggctccccgacaccaccggcgagatcgtcttaacccagagccccggcaccctcagccttagccccggggagcgcgccaccctctcctgccgcgccagccaaagcgtcggctcgtcctatctcgcctggtatcaacagaagcccggtcaggcccccaggctcctcatctacggcgccttcagcagggccaccggcatcccggaccggttctccggctccggcagcggcaccgacttcaccttgacgatcagcaggctcgagccggaggacttcgccgtgtactactgccagcagtatggcagcagcccctggaccttcggccaggggaccaaggtcgagatcaagaggaccgtggcggcccccagcgtgttcatcttccctcccagcgatgagcagctcaagagcgggaccgccagcgtggtgtgcctgctgaacaatttttacccccgggaggccaaggtgcagtggaaagtagacaacgccctgcagtccgggaactcccaggagtcggtgactgagcaagacagcaaggacagcacctacagcctgtccagcacgctcaccttgtccaaggcggactatgagaagcacaaggtgtacgcctgtgaggtgacccatcagggcctctcctctcccgtgaccaagtccttcaataggggggagtgt

SEQ ID NO: 431 - DNA, 705 bp, Artificial Sequence
  IPI_LC-CO15
atggagacgcccgcccagctactcttcctactactcctctggctccccgacaccaccggcgagatcgtactcacgcagtcgccggggaccctcagcctcagccccggcgagagggccaccctctcctgcagggcatcccagagcgtcggctccagctacctcgcctggtaccagcagaagcccggccaggcccccaggctcctcatctacggggcgttcagcagggccaccggcatacccgataggttctccggctccggctccgggaccgacttcaccctcacaatcagccgtctcgagcccgaggacttcgcggtgtactactgccagcagtatgggagctccccctggacgttcggccaggggacgaaggtcgagatcaagcggaccgtcgcggctcccagcgtgtttatcttcccgcccagcgacgagcaactgaaaagcggcaccgccagcgtggtgtgcctgctgaacaacttctacccccgcgaggccaaggtccagtggaaggtggataacgccctgcagagcgggaacagccaggagagcgtgaccgagcaagacagcaaagacagcacatactccctgagcagcaccctgacactgagcaaggccgactatgagaagcacaaggtgtacgcctgtgaggtgacgcaccagggcctgagctcccccgtgaccaagagcttcaacaggggcgagtgc

SEQ ID NO: 432 - DNA, 705 bp, Artificial Sequence
  IPI_LC-CO16
atggagacgcccgcccagctcctctttcttctcctcttgtggctccccgacaccaccggggagatcgtactcacgcagtcgcccggcacactcagcctcagcccaggcgagagggccaccctctcctgcagggccagccagtccgtcggcagcagctacctcgcctggtatcaacagaaacccgggcaggccccccggctcctcatatacggggccttctccagggccaccgggatccccgatcgtttctccggcagcggatcgggcaccgacttcacgctcacgatctccaggctcgagccagaggacttcgccgtgtactactgccagcagtacggcagcagcccctggaccttcggtcagggcaccaaggtggagatcaagcgcacagtggccgccccctccgtgttcatctttccgcccagcgatgagcagctgaagtccgggacggccagcgtggtgtgcctgctcaacaacttctacccacgggaggccaaggtgcaatggaaggtggacaacgccctgcagagcggcaacagccaggaatccgtgacggagcaggactccaaagacagcacctattccctgagcagcaccctgacgctctccaaagccgactatgagaagcacaaggtgtacgcctgtgaagtcacccaccaggggctgtcgagcccggtgaccaagagcttcaaccggggcgaatgc

SEQ ID NO: 433 - DNA, 705 bp, Artificial Sequence
  IPI_LC-CO17
atggagacacccgcccagctcctcttcctcttgctgctctggctacccgacaccaccggggagatcgtcctcacccaatcgcccggcacgctcagcctctcccccggcgagcgggccaccttgagctgccgggccagccagagcgtcggatcctcgtaccttgcctggtaccagcagaagcccggccaggccccccggttgctcatctacggggcgttcagcagggccaccggcatccccgacaggttcagcggcagcggctccgggaccgacttcaccctcaccatcagccgtctcgagcctgaggacttcgccgtgtactactgccagcagtacgggtcctccccctggaccttcggccagggcacgaaggtggagatcaagcggaccgtcgccgcccccagcgtgttcatattccccccgagcgatgaacagctgaagtccgggaccgctagcgtggtgtgcctgctgaataacttctacccccgcgaggccaaggtccagtggaaggtggacaacgccctgcagagcggcaacagccaggagagcgtgaccgaacaggatagcaaggacagcacctacagcctgagcagcacactgaccctgtccaaggcggactacgagaagcacaaggtgtacgcctgcgaggtgacccatcagggtctgtccagccccgtgaccaaaagcttcaatcgaggcgaatgc

SEQ ID NO: 434 - DNA, 705 bp, Artificial Sequence
  IPI_LC-CO18
atggagacgccggcgcagcttctcttcctccttctactctggctcccagacaccacaggcgagatcgtcctcacccagagcccgggaaccctcagcctttccccaggagagcgggcgaccctcagctgcagggccagccagagcgtcggcagcagctacctcgcctggtaccaacagaagccgggccaggcgcccaggctcctcatctacggggccttttcccgggccaccggcatccccgatcgcttcagcggctcggggagcgggaccgacttcaccctcaccatcagcaggcttgaacccgaggacttcgcggtgtactattgccagcagtatgggagcagcccctggaccttcggccagggcaccaaagtcgagatcaagagaaccgtggccgccccctccgtgtttatcttcccgccctcggacgagcagctgaagagtggcaccgcgagcgtggtctgcctcctgaacaacttctacccgcgggaggccaaggtacagtggaaggtggacaatgcgctccaatccgggaactcccaggagagcgtgaccgagcaggacagcaaggatagcacctacagcctgagcagcaccctgaccctgagcaaggccgactacgagaagcacaaagtgtacgcgtgcgaggtgacccaccaggggctctccagccccgtgaccaagtcctttaacaggggggagtgc

SEQ ID NO: 435 - DNA, 705 bp, Artificial Sequence
  IPI_LC-CO19
atggagacgcccgcccagctccttttcctcctcctcctctggttgcccgacaccaccggcgaaatcgtgctcacgcagagccccggcacgctcagcctcagccccggggagagggccacgcttagctgccgcgccagccagagcgtcggcagcagctacttagcctggtaccagcagaagcccgggcaggccccccgccttctaatctacggcgccttttcccgcgccaccggcatccccgacaggttcagcggcagcggctccggcaccgacttcaccttgacgatcagcaggctcgagcccgaggatttcgccgtgtactactgccagcaatacggcagcagcccctggaccttcggccaggggaccaaggtggagataaagaggaccgtggccgcccccagcgtgttcatcttcccgcccagcgacgaacagctgaaaagcggcacggcctcggtggtgtgcctcctgaacaacttctacccccgcgaggccaaggtgcagtggaaggtggacaatgccctgcagagcggcaattcgcaggagagcgtgaccgagcaggacagcaaggatagcacctacagcctgtcaagcacactgaccctctccaaagcggactacgagaagcacaaggtgtacgcctgcgaggtgacccaccagggcctcagctcgcccgtgaccaagagcttcaaccgcggcgagtgt

SEQ ID NO: 436 - DNA, 705 bp, Artificial Sequence
  IPI_LC-CO20
atggagactcccgcccaactcctcttcctcctcctcttatggctcccggacaccacgggcgagatcgtccttacacagagccccgggaccctcagcctcagccccggcgagagggccacgctcagctgcagggcctcccagtccgtcgggtccagctacctggcctggtaccagcagaagcccggccaagcgccccggcttctcatctacggagctttcagccgggcgaccggcataccggaccggttcagcgggtccggctcgggcaccgacttcaccctcaccatcagcaggctcgagcccgaggacttcgccgtctactactgccagcagtacgggtcctccccctggaccttcgggcagggcaccaaggtggagatcaagaggaccgtcgccgcccccagcgtcttcatctttccccccagcgacgagcagctgaaaagcggcaccgccagcgtggtgtgcttactgaacaatttctatccgagggaggccaaggtgcagtggaaggtggacaacgccctgcagtccgggaacagccaggagtcagtaacggaacaggacagcaaggacagcacctacagcctgagcagcacgctgacgctgtcgaaggccgactacgagaagcacaaggtgtacgcctgcgaggtgacccaccagggcctgtccagccccgtgacgaagtccttcaatcgaggagagtgc

SEQ ID NO: 437 - DNA, 705 bp, Artificial Sequence
  IPI_LC-CO21
atggagacgccggcccagctcctattcctcctcctcctctggctcccggatactaccggcgagatcgtcctcacccagagccccggcaccttgagcttgagccccggcgagagggccaccctcagctgcagggcaagccagagcgtcggcagcagctacctcgcctggtaccagcaaaagcccgggcaggcccctcgtctcctaatctacggggcctttagcagggccaccgggatcccagatcggttctcgggctccgggagcggcaccgacttcaccctcaccatcagccggctcgagcccgaggacttcgccgtgtactactgccagcagtatggcagcagcccctggaccttcgggcagggcacgaaggtagagatcaaacggaccgtggccgccccctccgtgttcatcttcccgcccagcgatgagcagctgaaaagcggcacggcctccgtggtgtgcctgcttaataacttttacccgagggaggcaaaggtacagtggaaggtggacaacgctctgcagtccggcaacagccaggagagcgtcaccgagcaggatagcaaggatagcacctactcactgtccagcacgctgaccctgagcaaggccgactacgagaaacacaaggtgtacgcgtgtgaagtgacccaccaggggctgagcagccctgtaaccaagagcttcaaccggggcgaatgc

SEQ ID NO: 438 - DNA, 705 bp, Artificial Sequence
  IPI_LC-CO22
atggagactccggcccagctcctcttcctcctcctcctctggctccccgacaccacgggcgagatcgtccttacccagtcccccggaaccctcagcctcagcccgggggagagggcgaccctcagctgcagagccagccagagcgtaggtagcagctacctcgcctggtaccagcagaagcccgggcaggccccccgcctcttgatatacggggccttttcgcgggccacggggatacccgaccgcttctccggatccggcagcggcaccgacttcacgctcacgatctcgagactcgagccggaggacttcgcggtgtactactgccagcagtacggcagcagcccctggacctttggccaaggcaccaaggtggaaatcaagcggaccgtggcggcccccagcgtctttatcttccccccgagcgatgagcagctgaaaagcgggaccgccagcgtggtgtgcctgctgaataacttctatccccgggaggccaaagtgcagtggaaagtggacaacgcgctgcaatccgggaactcccaggagtctgtgaccgaacaggacagcaaggacagcacctatagcctgtcctccaccttaacgctcagcaaggccgactacgagaaacacaaggtctacgcctgcgaggtgacgcaccaaggcctgtccagccccgtgaccaagagctttaacaggggggagtgt

SEQ ID NO: 439 - DNA, 705 bp, Artificial Sequence
  IPI_LC-CO23
atggagacaccggcccagctactattcctcctcctcctctggctccccgacaccaccggcgagatcgtcctcacccagagccccgggactttatccttgtcccccggcgagcgcgccacgctcagctgcagggccagccagagcgtcggttcgagctacctcgcctggtaccaacagaagcccggccaggcccccaggctcctaatctacggggccttttccagggccaccggcatcccggacaggttcagcggcagcggatccgggaccgactttaccctcacgatctcgcggcttgagcccgaggacttcgccgtgtactactgtcagcagtacggctcgagtccctggaccttcggccaggggaccaaggtggagatcaagaggaccgtggccgcccccagcgtcttcatcttcccgcccagcgacgagcaactgaaaagcgggaccgcgagcgtcgtctgcctgctgaacaacttctatccccgggaagccaaggtgcagtggaaggtggacaacgcgctgcaaagcgggaactctcaggagtccgtgaccgagcaggacagcaaggacagcacctactccctgagctcgacgctgaccctgagcaaggccgactacgagaaacataaggtgtacgcctgcgaggtgacccaccaagggctgagctcgccggtgaccaagagcttcaataggggcgagtgt

SEQ ID NO: 440 - DNA, 705 bp, Artificial Sequence
  IPI_LC-CO24
atggaaacccccgcccagctcctctttctcctcctcctctggctccccgacaccaccggggagatcgtcctcacccagtcccccggcaccctcagcctcagcccgggcgagcgggccaccttatcctgcagggccagccagagcgtcggctccagctatctcgcctggtaccagcagaagccgggccaggccccgcgtctcctcatctacggggccttctcgagggccaccgggattcccgacaggttcagcggctcgggaagcgggaccgatttcaccctaaccatcagcaggttagagcccgaggacttcgcggtgtactactgccagcagtacggcagctccccctggaccttcggacagggcaccaaagtggagatcaaacgcaccgtggccgccccgtccgtgttcatcttcccgccctccgacgagcagctgaaatctggcaccgccagcgtggtgtgcctgctaaataacttctacccccgggaggccaaggtgcagtggaaggtggacaatgccctgcagagcgggaacagccaggagagcgtgacggagcaggacagcaaggacagcacctacagcctgtccagcaccctgaccctgtccaaagccgattacgagaagcacaaggtgtacgcctgcgaggtcacccaccaaggcctgagcagccccgtgaccaagagcttcaacaggggcgaatgc

SEQ ID NO: 441 - DNA, 705 bp, Artificial Sequence
  IPI_LC-CO25
atggagactcccgcgcagctcctcttcctcctccttctctggcttccagacaccacgggcgagatcgtcctcacccagagcccgggcaccctcagcctctcccccggcgagagggcaaccctaagctgccgcgcgagccagagcgtaggcagctcctacctcgcctggtaccagcagaaaccggggcaagccccgcggctcctcatctacggggctttctccagagccaccggcatccccgaccgcttcagcggcagcggcagcgggacagactttaccctcaccatcagcaggctcgaacccgaggacttcgccgtgtactattgccagcagtacggctccagcccctggacctttggccagggcaccaaggtggagatcaagaggaccgtggccgcccccagcgtgttcatcttcccgcccagcgacgaacagctgaaaagcgggaccgccagcgtcgtgtgcctgctgaataacttctaccccagggaggccaaggtgcagtggaaggtggacaacgccctccaaagcggcaacagccaagagagcgtcaccgaacaggactccaaggactcgacctactccctgtccagcaccctgaccctcagcaaggcggactacgagaagcacaaggtgtacgcctgcgaggtcacccaccagggcctgagctcgcccgtgaccaagagcttcaacaggggtgagtgc

SEQ ID NO: 442 - protein, 468 aa, Artificial Sequence; identical to SEQ ID NO: 252
  IPI_HC (ipilimumab heavy chain)

SEQ ID NO: 443 - protein, 20 aa, Artificial Sequence
  IPI_HC (signal peptide)
METPAQLLFLLLLWLPDTTG

SEQ ID NO: 444 - protein, 118 aa, Artificial Sequence; identical to SEQ ID NO: 183
  IPI_HC (variable region, VH)

SEQ ID NO: 445 - protein, 330 aa, Artificial Sequence; identical to SEQ ID NO: 387
  IPI_HC (constant region)

SEQ ID NO: 446 - DNA, 1404 bp, Artificial Sequence
  IPI_HC-CO01
atggagacgccggcccagcttctcttcctacttctcctctggctccccgacaccaccggccaggtccagctcgtcgagtccggcggcggggtagtccagcccgggcggtcacttaggctctcctgtgccgcaagcggcttcaccttcagctcctacaccatgcactgggtccggcaggcgcccgggaagggcctggagtgggtcacctttatcagctacgacgggaacaacaagtactacgcggatagcgtcaaggggcgcttcaccattagccgggacaacagcaagaacaccctctacctgcagatgaacagcctgagggccgaagacaccgcgatatactactgcgctaggaccgggtggctgggccccttcgactactgggggcagggcaccctggtgaccgtctccagcgcctccacgaagggcccctccgtgttccccctggccccctccagcaagagcacctccggcggcaccgccgccctggggtgtctcgtcaaggactattttcccgagcccgtgacggtcagctggaacagcggggcgctcaccagcggcgtgcataccttccccgccgtgctgcagagcagcggcctgtactccctgtccagcgtggtgaccgtcccctcgagcagcctgggcacgcagacctacatctgcaacgtcaaccacaagcccagcaacaccaaagtggataagcgggtggagcccaagagctgtgacaagacccacacctgccccccgtgtcccgcccccgaactgctcggcgggccgagcgtgttcctgttccctcccaagcccaaggacaccctgatgatatcccggacgcccgaggtcacctgcgtggtggtggacgtgagccacgaggatcctgaggtcaagtttaactggtacgtggacggcgtcgaggtgcacaatgccaagaccaagccacgcgaggagcaatacaacagcacctacagggtggtcagcgtgctgaccgtcctgcaccaggactggctgaacgggaaggaatacaagtgcaaggtgtccaacaaggccctgcccgccccgattgagaagaccatcagcaaggccaagggccagcccagggaaccccaggtgtataccctgccccccagccgcgaggagatgacgaagaaccaggtaagcctcacctgcctcgtgaaggggttctacccctccgatatcgccgtggagtgggagagcaacggccagcccgagaataactacaagactaccccgcccgtgctggactccgacgggtcctttttcctgtactccaagctgaccgtagacaagagccggtggcagcagggcaacgtcttcagctgcagcgtgatgcacgaggccctgcataaccactatacccagaaaagcctgagcctgagccccggcaag

SEQ ID NO: 447 - DNA, 1404 bp, Artificial Sequence
  IPI_HC-CO02
atggagacacccgcccagctccttttcctcctcctcctctggctcccggacaccaccggccaggtccagctcgtcgagagcggcgggggagtggtccagccgggccggagccttcggttgtcctgcgccgccagcggcttcacgttctccagctacaccatgcactgggtccgacaggcccccggcaagggccttgagtgggtcaccttcatcagctacgacggcaataataagtactacgccgacagcgtcaaggggcggtttaccatcagccgggataacagcaaaaacaccctctacctgcagatgaacagcctgagggccgaggacaccgccatctactactgtgcccgaacggggtggctgggccccttcgattactggggccaggggacgctggtgactgtcagctccgcaagcaccaagggccccagcgtgttccccctggcccccagttcaaagtccaccagcggcggcaccgccgcgctggggtgcctggtgaaggactactttccggagcccgtgaccgtgagctggaacagcggcgccctgaccagcggggtccacaccttcccggccgtgctgcagagcagcggcctgtacagcctaagcagcgtggtcaccgtgccctccagctccctcggcacccagacctacatctgcaacgtcaaccacaagccctcaaacaccaaggtggacaagcgggtggagccaaagtcctgcgacaaaacccacacatgccctccctgccccgcccctgagctgctgggcggccccagcgtcttcctgttccctcccaagcccaaggacaccctgatgatcagccggacccccgaggtgacctgcgtggtggtggacgtgagccacgaggacccggaggtcaagttcaactggtacgtggacggcgtggaggtgcacaacgccaagaccaagcccagagaggagcagtacaacagcacctacagggtggtgtccgtcctgaccgtgctgcaccaggactggctgaacggcaaggagtacaaatgcaaggtgtcgaataaggccctccccgcccctatcgaaaagaccatctccaaggccaagggccagcccagggagccccaggtgtacaccctgccccccagcagggaggagatgaccaagaaccaggtgagcctgacctgcctggtgaagggcttctacccctccgacatcgccgtggaatgggaatccaacggccagcccgagaacaactacaagaccacaccccccgtcctggacagcgacggcagcttcttcctgtatagcaagctgaccgtcgacaagagcaggtggcagcaggggaacgtgttcagctgctccgtgatgcacgaggccctgcacaatcactacacccagaaaagcctgagcctcagcccgggcaag

SEQ ID NO: 448 - DNA, 1404 bp, Artificial Sequence
  IPI_HC-CO03
atggagacgcccgcccagttgcttttcctcctcctcctctggcttccggacaccacgggccaggtccagttggtcgaaagcggcggcggcgtcgtccagcccgggcggtcccttcgactctcctgcgccgcctccggcttcaccttcagctcctatacgatgcattgggtacggcaggccccaggcaagggcctcgagtgggtcaccttcatctcatacgacggcaacaacaaatactacgccgacagcgtcaaggggcgcttcaccatctcgcgggacaacagcaaaaacaccctatacctgcagatgaactccctgcgggccgaggacaccgccatctattactgcgcccgtaccggatggctgggaccgttcgactactggggccaggggacgctggtgaccgtcagctccgccagcaccaaggggcccagcgtgttccccctggcccccagctccaagagcaccagcgggggcaccgcggccctcggttgcctggtgaaggattacttccccgagccggtgaccgtcagctggaactccggcgccctcaccagcggcgtgcacacctttcccgccgtgctgcagagcagcggcctgtacagcctgagcagcgtggtgacagtgcccagcagcagcctgggcacgcagacctacatttgtaacgtgaaccacaaacccagcaacactaaggtggacaagcgagtggagcccaaaagctgcgacaagacccacacctgcccgccctgcccggcgcccgagctgctggggggtcccagcgtgttcctgttccctcccaagcccaaggacaccctgatgatcagcaggacgccggaggtgacctgcgtggtggtggatgtcagccacgaggaccccgaggtcaagttcaactggtatgtggacggggtggaggtccataacgcgaagaccaagcccagggaggagcaatacaatagcacctacagggtggtcagcgtgctgaccgtgctgcaccaggactggctgaacggcaaagagtacaagtgcaaggtgtcgaacaaagccctgcccgcgcccatcgagaagaccatctccaaggccaaagggcagcccagggaaccccaagtgtacaccctcccgccctccagggaggaaatgaccaagaaccaggtcagcctgacctgtctggtgaaggggttctacccctccgacatagccgtggagtgggaatccaacgggcagcccgaaaacaactacaagaccaccccgcccgtgctggattccgatggcagcttcttcctctactcgaagctcaccgtcgacaagtcccggtggcagcagggcaatgtgttcagctgcagcgtgatgcacgaggccctgcacaaccactacacacagaaaagcctcagcctgtcccccggcaag

SEQ ID NO: 449 - DNA, 1404 bp, Artificial Sequence
  IPI_HC-CO04
atggagactcccgcccagctcctattcctcctcctcctctggctccccgacaccaccgggcaggtccagctcgtagagagcggaggcggggtcgttcagcccggccggagcctccggctcagctgcgccgcctccgggtttaccttctcctcctacaccatgcattgggtccggcaggcccccggcaagggcctagagtgggtcacattcatcagctacgacggcaacaacaagtattacgcggatagcgtaaaggggaggttcaccatcagcagggataatagcaagaacaccctctacctgcagatgaatagtctgcgagccgaggacacggccatctactactgcgccaggactggctggctgggcccgttcgactactggggccagggcaccctcgtgaccgtgtccagcgccagcacgaagggtccctccgtgttccccctggccccctccagcaagtcgaccagcgggggcaccgccgccctggggtgcctggtgaaggactacttccccgagcccgtgaccgtgagctggaacagtggcgcgctgaccagcggcgtgcacaccttccccgccgtgctgcagagcagcggcctgtactccctgtccagtgtggtgaccgtgcccagcagcagcctgggcacccagacctatatctgcaacgtgaaccacaagccctccaacaccaaggtggataagagggtggagcccaagtcctgcgataagacccatacgtgcccgccctgccccgcccccgaactgctggggggccccagcgtcttcctgtttccccccaaacccaaggacaccctgatgatcagcaggacccccgaggtgacctgcgtggtggtggacgtgagccacgaggaccccgaggtaaagtttaactggtacgtggacggggtggaggtccacaacgccaagacgaagccaagggaggagcagtacaacagcacgtaccgggtcgtgagcgtcctgaccgtcctccatcaagactggctcaacggcaaggagtacaagtgcaaggtgtccaacaaggccctccccgcccccatcgagaagaccatcagcaaagccaagggccaaccccgggaaccccaggtgtacacgctcccgcccagcagggaggagatgaccaaaaaccaggttagcctgacctgcctggtgaaggggttttacccctccgacatcgccgttgagtgggagagcaatggccagcccgaaaacaactacaagaccaccccgcccgtgctcgactcagacggtagcttcttcctgtacagcaaactgaccgtggacaagagccgctggcagcagggcaacgtgtttagctgcagcgtgatgcacgaagccctgcacaaccattacacgcagaaaagcctcagcctgtccccgggcaag

SEQ ID NO: 450 - DNA, 1404 bp, Artificial Sequence
  IPI_HC-CO05
atggaaacccccgcccagctcctcttcctcctactcttgtggctccccgacaccaccggccaggttcaactcgtggagagcgggggcggagtcgtccagcccgggaggagcttacggctcagctgcgccgcctcggggttcacgttctcaagctacaccatgcactgggtccgccaggcccccgggaaggggctcgagtgggtcaccttcatcagctacgacggaaacaacaagtactacgccgactccgtaaaggggaggttcacgatctccagggacaattccaagaacaccttgtacctgcagatgaatagcctgcgcgccgaggacaccgccatctattactgcgccaggaccggctggctgggcccattcgactactgggggcaggggaccctggtgaccgtgtcgagcgccagcaccaaggggcccagcgtcttccccctggccccctccagcaagagcacctccggcggcaccgccgccctcgggtgcctggtgaaggactacttccccgagcccgtcacggtgtcctggaacagcggcgccctgacgagcggcgtgcacaccttccccgccgtgctgcagtcaagcggcctgtacagcctgagcagcgtggtgactgtgcccagctccagcctgggcacccagacctatatctgcaacgtgaaccacaaaccctccaacacgaaggtggacaaaagggtggagcccaaaagctgcgacaagacccacacctgtccgccgtgtcccgcgcccgagctgctggggggcccctccgtgttcctgtttccccccaagcccaaggacaccctgatgataagcaggacgcccgaggtgacctgcgtggtggtggacgtgagccacgaggaccccgaggtgaagttcaattggtacgtggacggcgtggaggtgcacaacgccaagaccaagccgcgtgaagaacagtataactccacctaccgggtggtcagcgtcctgaccgtgctccaccaggactggctcaacggcaaggaatacaagtgcaaagtaagcaacaaggctctgcccgcccccatcgagaagacgatctccaaagccaaaggccagcccagggagccccaggtgtacaccctccctcccagcagggaggagatgaccaagaaccaggtgagcctgacttgcctggtcaagggtttctacccaagcgacatcgctgtggagtgggaaagcaacggccagcccgagaataactacaagaccaccccgcccgtgctggactcggatgggagcttttttctgtactccaagctgaccgtcgacaagtcgcgttggcagcagggcaacgtgttcagctgcagcgtgatgcacgaggccctgcacaatcactacacccagaaatcgctgagcctgtcgccgggcaag

SEQ ID NO: 451 - DNA, 1404 bp, Artificial Sequence
  IPI_HC-CO06
atggagactcccgcccaattactcttcctcctcctcctctggttacccgacaccaccgggcaggttcagctcgtagagagcggcgggggagtcgtccagcccgggcgtagcctcaggctatcctgcgccgccagcgggttcaccttcagcagctacaccatgcactgggtcaggcaggcgcccggcaagggcctcgagtgggtcaccttcatcagctacgacggcaacaacaagtactacgccgactccgtcaagggcaggttcaccatcagccgcgacaacagcaagaacaccctctacctgcagatgaactccctgagggccgaggacaccgcgatctattactgcgccaggaccgggtggctggggcccttcgattactggggacaggggactctcgtgaccgtgagcagcgccagcacgaagggccccagcgtgttccccctggccccctcaagcaagagtacctccggcgggaccgccgcgctggggtgcctcgtgaaggactacttccccgagccggtgaccgtgtcctggaactctggcgccctgaccagcggggtccataccttccccgccgtgctccagagcagcgggctgtactcgctcagcagcgtggtgaccgtgcccagcagcagcctggggacccagacctacatctgcaacgtcaaccacaaacccagcaacaccaaggtggacaagcgtgtggagccaaagagctgcgacaagacccacacctgcccgccctgccccgcccccgagctgctgggcggcccctcggtgttcctcttcccacccaagcccaaggacaccctgatgatcagcaggacccccgaggtgacctgcgtggtggtggatgtgagccacgaggacccggaggtgaagttcaattggtacgtggacggcgtggaggttcacaacgccaaaactaagccccgcgaggagcagtataacagcacctaccgggtggtgtccgtgctgaccgtcctccatcaggactggctgaacgggaaggagtacaagtgcaaggtgagcaataaggcgctgcccgcccccatcgagaagaccatcagcaaggccaagggccagcccagggagccccaggtgtacaccctgccccccagccgggaggagatgacaaagaaccaggtgagcctcacctgcctggtcaaaggcttctatcccagcgacatagcggtggagtgggaaagcaatggccagcccgagaacaactacaagaccaccccgcccgtgctggacagcgacggcagcttcttcctgtacagcaagctcacggtggacaagagcaggtggcagcagggcaacgtgtttagctgcagcgtgatgcacgaagccctgcacaaccattacacccagaagagtctcagcctctcccccggcaag

SEQ ID NO: 452 - DNA, 1404 bp, Artificial Sequence
  IPI_HC-CO07
atggagacacccgcccagctcctcttcctcctcctcctctggctccccgacacgaccggccaagtacagctcgtcgagtccgggggaggcgtcgttcagcccggccggagcctcaggcttagctgcgccgcgagcggcttcaccttcagctcctacaccatgcactgggtccgccaggcccccgggaaggggctcgagtgggtcacgttcatcagctacgacggcaacaataagtactacgccgattccgtcaaggggcggttcaccatcagccgggataacagcaagaacaccctctatctgcagatgaacagcctgagggccgaggataccgcaatctattactgcgcccgcaccgggtggctgggcccgttcgactactgggggcaggggaccctggtgacggtgtcctccgcctcgaccaagggcccctccgtgttcccgctggccccctcgtccaagagcaccagcggcggcaccgctgccctgggctgtctggtcaaggactactttccagagcccgtgaccgtgtcctggaatagcggggccctgaccagcggagtgcacaccttccccgccgtcctgcaatcctcgggcctgtactccctgagctccgtagtgaccgtccccagcagcagcttagggacccagacctatatctgcaacgtgaaccacaaacccagcaacacgaaggtggacaagagggtagagcccaaaagctgcgacaagacccacacctgcccaccctgcccggccccagagctgctcgggggccccagcgtgttcctgttcccgcccaagcccaaggacacactgatgatcagcaggactccagaggtcacctgcgtggtggtggatgtgtcccacgaggacccggaggtgaagttcaattggtatgtggacggcgtcgaggtccacaacgccaagacaaagccaagggaggagcaatacaatagcacctaccgtgtcgtgagcgtgctgacagtgctgcatcaggactggctcaacggaaaggagtacaagtgtaaggtgtccaacaaggccctgcccgccccgatagaaaagaccatcagcaaagccaagggccagcccagggagccgcaggtgtataccctcccgcccagcagggaggagatgaccaagaaccaggtgtccctgacctgcctggtcaagggattctaccccagcgacatcgccgtggagtgggagagcaacggccaacccgagaacaactacaagaccactccgcccgtgctcgacagcgatgggagcttcttcctgtatagcaagctgaccgtcgacaagagcaggtggcagcagggcaatgtgtttagctgtagcgtcatgcacgaagccctgcacaaccactatacccagaaatccctgagcctgagccccgggaag

SEQ ID NO: 453 - DNA, 1404 bp, Artificial Sequence
  IPI_HC-CO08
atggagacgcccgcccagctcctcttcctcctcctcctctggctacccgacacgaccggccaggtccagctggtggagagcggcggcggcgtagtccagcccggacggagcctccgcctcagctgcgccgccagcggctttaccttcagcagctacaccatgcattgggtcaggcaggcccccgggaagggccttgagtgggtaacatttatcagctacgacggcaacaacaagtattacgccgacagcgtcaagggccgcttcaccatttcccgagacaacagcaagaacaccctctatctgcagatgaacagtctgcgcgcggaggacaccgcgatctactactgcgcccgcaccggttggctcgggccgttcgattactggggccaggggaccctggtgaccgtgagttccgccagcacgaaggggccgagcgtgtttcccctggcccccagcagcaagagcacgagcggcggcaccgccgccctggggtgcctggtgaaggactacttcccggaacccgtgaccgtgagctggaacagcggggccctgaccagcggcgtgcacaccttccccgccgtgctgcagagcagcgggctgtactccctgagctctgtggtgacggtccccagcagcagcctgggcacccagacctacatctgcaatgtgaaccacaagcctagcaacaccaaggtggacaagcgggtcgagcccaagagttgcgacaagacccacacctgccctccctgcccagcccccgaactgctggggggccccagcgtgttcctcttcccacccaagcccaaggacacgctgatgatcagcaggacgcccgaggtgacctgcgtcgtggtcgacgtgagccacgaggaccccgaagtgaaattcaactggtacgtggacggcgtggaggtgcataacgccaaaaccaaaccccgggaggagcagtacaactccacctatagggtcgtgtcggtgctcaccgtgctgcatcaggattggctgaacggcaaggaatataagtgcaaagtgagcaacaaggccctgcccgcaccgatcgagaaaacgatcagcaaagccaagggccagcccagggagccccaggtgtatacgctgccgcccagccgggaagagatgactaagaaccaggtgtccctgacctgcctggtgaagggcttctaccctagcgacatcgcggtcgagtgggagagcaacggccagcccgagaacaactataagacgactccccccgtgctggacagcgacggctcctttttcctgtatagcaaactgaccgtggacaagagcaggtggcagcaggggaacgtgttctcgtgcagcgtgatgcatgaggccctgcataaccactacacccagaagtcgctgagcctgtcccccggcaag

SEQ ID NO: 454 - DNA, 1404 bp, Artificial Sequence
  IPI_HC-CO09
atggagacacccgcccagttgctgttcctcctcctcctctggctcccggataccacggggcaggtacaactagtcgagagcgggggcggcgtcgtccagcccggcaggagcctccggctcagctgcgccgcctccgggttcaccttcagctcctacaccatgcactgggtcaggcaggcccccgggaaagggttggagtgggtcacctttatcagctacgacgggaacaacaagtactacgccgacagcgtcaagggccggttcaccattagccgggacaactccaagaacaccctttacctgcagatgaactccctgcgggccgaggacaccgcaatctactactgcgccaggaccggctggctggggcccttcgattactggggacagggcaccctcgtgaccgtgtccagcgccagcaccaagggccccagcgtctttcccctggcccccagcagcaagagcaccagcggcggcacggccgccctgggctgcctggtcaaggactacttccccgagcccgtgaccgtgtcctggaacagcggcgccctgacctccggcgtgcacaccttcccggccgtgctgcagagcagcggcctctactccctctcctccgtggtgaccgtgcccagcagcagcctgggcacccagacctatatctgcaacgtgaaccacaagccatcgaacaccaaagtggataaaagggtggagcccaaaagctgcgataagacccacacctgtcccccctgcccggcccccgagctgctgggcgggccctcagtgttcctgttcccacccaagcccaaggacaccctgatgatcagcaggacccccgaagtcacatgcgtggtggtcgacgtgtcccacgaagaccccgaggtgaaattcaattggtacgtggacggcgtggaggtccacaacgccaagaccaagccccgtgaagaacaatataactccacgtatagggtggtgtccgtgctgacggtgctgcatcaggactggctgaacggcaaggagtacaagtgcaaggtgagcaacaaggccctgccggcccccatcgagaaaaccatctccaaagccaaggggcagccccgcgagccccaggtctatacgctgccccccagcagggaagagatgaccaagaaccaggtcagcctgacctgcctggtgaagggcttttaccccagcgacatcgccgtcgaatgggagtcgaacgggcaaccggagaacaactacaagaccacccctcccgtgctggacagtgacgggagcttctttctctactccaagctgaccgtcgacaagtcccggtggcaacagggaaacgtgttttcctgcagcgtgatgcatgaggccctccataatcactacacccagaagtccctgagcctgagccctgggaag

SEQ ID NO: 455 - DNA, 1404 bp, Artificial Sequence
  IPI_HC-CO10
atggaaaccccggcccagctcctcttcctcttactcttgtggctccccgacaccaccgggcaggtccagctcgttgagagcgggggcggcgtcgtacagccggggcgaagcctccggctctcctgtgccgcgagcggcttcaccttcagcagctacacgatgcactgggtcaggcaggcccccgggaagggtctggagtgggtaacgttcatcagctacgacggaaacaataagtactacgcggattccgtgaagggccgcttcaccataagcagggataactccaagaacaccctctacctgcagatgaattccctgcgcgccgaggacaccgccatctactactgcgccaggacaggctggctgggccccttcgactattggggccaaggcaccctggtgacggtgtccagcgcgagcaccaagggcccctccgtgttcccgctggcgcccagctccaaaagcaccagcgggggcaccgccgccctgggctgcttggtgaaggactacttccccgagcccgtgaccgtaagctggaacagcggcgccctgacctccggcgtgcacacgttccccgcggtgctccaaagctccggcctctattccctgagcagcgtggtgaccgtgcccagcagctcgctgggcacccagacttacatctgcaatgtgaaccacaagcccagcaacacgaaggtggacaagagggtcgagcccaagagctgcgacaagacccatacctgtcccccctgtcccgcccccgaactgctcggcggcccctccgtgttcctgttccctcctaaacccaaggacaccctgatgatcagcaggacgcccgaagtgacctgtgtggtggtggatgtgagccacgaggatcccgaggtgaagttcaactggtacgtcgacggggtggaggtccacaacgccaagaccaagccccgggaggagcaatacaatagcacctacagggtggtcagcgtgctgaccgtgctgcatcaggactggctgaatggcaaggagtacaagtgcaaggtgagcaacaaggccctgcccgcccccatcgagaagacgatctcaaaggccaagggccaacccagagagccccaggtgtacaccctgccgccctccagagaggagatgacgaagaatcaggtgtccctgacctgcctggtgaagggattctaccccagcgacatcgccgtggagtgggagagcaacggccagcccgagaacaactacaagaccaccccgcccgtcctggacagcgacggctccttcttcctgtacagcaagctgaccgtggataagtcccggtggcaacagggcaacgtgtttagctgtagcgtgatgcatgaggccctgcacaaccactacacccagaaaagcttgtccctgtcccccgggaag

SEQ ID NO: 456 - DNA, 1404 bp, Artificial Sequence
  IPI_HC-CO11
atggagacacccgcccagctcctcttcctcctcctcctctggcttccggacaccaccgggcaggtccagctcgttgagagcgggggaggagtcgtccagccgggaaggagcctaaggctctcctgtgcggccagcgggttcaccttcagctcctataccatgcactgggtccggcaggcccccggcaagggcttggagtgggtcacgttcatctcctacgacggcaacaacaagtactacgccgacagcgtcaagggccggtttaccatcagccgcgacaattccaagaacaccctctacctgcaaatgaactccctgcgggccgaggatacagccatctattattgtgcgagaaccggctggctggggcccttcgactactggggccagggaaccctggtgaccgtgagcagcgcctccaccaagggcccatccgtgtttcccctggcccccagtagcaagagcacgtccggcggcaccgccgccctgggctgcctggtaaaggactacttccccgagcccgtcaccgtgagctggaacagcggggccctgacctccggcgtacacaccttccccgccgtcttacagtcctcgggcctgtatagcctgagctccgttgtgacggtgcccagctcctcactgggcacccagacatacatctgcaatgtgaatcacaaacccagcaacaccaaagtggacaagcgggtggagcccaagtcctgcgacaaaacccacacgtgcccgccctgcccggcccccgagctgctgggtgggcccagcgtgtttctgttcccacccaagcccaaggataccctcatgataagccgcacccccgaggtgacctgcgtggtggtggacgtgagccacgaggaccccgaggtgaagttcaactggtacgtggacggcgtggaggtccacaacgccaagaccaagcccagagaagaacagtacaacagcacgtaccgtgtggtcagcgtgctgaccgtgctgcaccaggactggctgaacggcaaggaatacaaatgcaaggtgagcaataaggccctgcccgcccccatcgaaaagaccatcagcaaagccaagggacagccccgggagccccaggtgtacaccctgcctcccagcagggaggagatgaccaaaaaccaagtctccctgacctgcctggtgaaagggttttaccccagcgacatcgccgtagagtgggagagcaacggccagcccgagaacaattataagaccaccccgcccgtgctggatagcgacgggagtttcttcctgtacagcaagctgacggtggataagagccgttggcagcagggcaacgtgttctcctgctccgtgatgcacgaggccctgcacaaccactacacccagaaaagcctgagccttagccccggaaag

SEQ ID NO: 457 - DNA, 1404 bp, Artificial Sequence
  IPI_HC-CO12
atggaaacccccgcccagctcctcttcctcttgctcctatggctcccggacacaaccgggcaggtccagctcgtcgagagcgggggcggggtcgtccagcccgggcggagcctccgtttgagttgcgccgccagcggcttcaccttcagcagctacaccatgcactgggtccgtcaggccccggggaagggcctcgagtgggttaccttcatcagctacgacggcaacaacaagtactacgccgattccgtcaaggggcgtttcacgatttcccgggacaattccaagaacaccctctacctgcagatgaacagcctgagggcggaggacaccgccatctactactgcgcccggaccggctggctgggcccgtttgactattggggccagggcaccctggtgaccgttagcagcgccagcaccaagggtcccagcgtcttcccgctggcccccagctccaagagcaccagcggcggcaccgccgcgctgggctgcctggtcaaggactacttccccgagcccgtgaccgtcagctggaacagcggggccctgaccagcggcgtccacaccttcccggccgtgctgcagagcagcgggctgtacagcctgagcagcgtggtgaccgtgccaagcagcagcctgggtacccaaacgtacatctgtaacgtgaaccacaagcccagcaacaccaaggtggataagagggtggagccgaaaagctgcgacaagacccatacctgccctccctgccccgcccccgagcttctgggcggcccgtcggtcttcctgttcccgcccaaacccaaggacaccctcatgatctcccggacacccgaggtgacctgcgtcgtcgtggacgtgtcacatgaggaccccgaggtcaagttcaactggtacgtggacggcgtggaagtgcataacgccaagaccaagccccgagaggagcagtacaacagcacctaccgcgtggtgagcgtgctcaccgtgctgcaccaggattggctcaacggaaaggagtacaaatgcaaggtgtccaataaggccctccccgcgcccatcgagaagacaatctcaaaggcaaagggacagccccgggagccccaggtatacaccctgcccccctcccgcgaggagatgacaaagaaccaagtgagcctgacctgcctcgtgaagggcttctacccctccgacatagccgtggagtgggagagcaacggccagcccgagaacaactacaagaccaccccgcccgtgctggactccgacggcagcttcttcctgtacagcaagctgaccgtggacaagtccaggtggcagcaaggcaacgtgttcagctgcagcgtgatgcacgaggccctgcacaatcactacacccagaaaagcctgtccctgagccccggcaag

SEQ ID NO: 458 - DNA, 1404 bp, Artificial Sequence
  IPI_HC-CO13
atggagacacccgcccagctactcttcctcctccttctctggcttccggacaccaccggccaggtccagctggtggagagcggcggcggcgtcgtacagcccgggaggtccctccggttgagctgtgccgccagcggcttcacattttccagctacaccatgcactgggtcaggcaggccccgggcaagggcctcgagtgggtcacctttatctcctacgacggcaacaacaagtactacgccgacagcgtcaaagggcggttcaccatcagcagggacaacagcaagaacaccctctacctgcagatgaacagcctgagggccgaggatacggccatctactactgcgcccggaccggctggctgggccccttcgactactgggggcagggcaccctcgtcaccgtgagcagcgccagcacaaaagggccctccgtgtttcccctcgccccctcgtccaaatccaccagcggcggcaccgctgccctggggtgcctggtgaaggactactttcccgagcccgtgaccgtgagctggaatagcggcgccctgacctccggcgtgcacacattccccgccgtgctgcagagcagcggcctgtacagcctgagcagcgtggtcaccgtgccctccagtagcctggggacccagacctacatctgtaacgtgaaccacaagcccagcaacaccaaggtggataaaagggtggagccaaagtcctgcgacaagacccatacctgccccccgtgccccgcccccgaactcctgggcgggcccagcgtgttcctcttcccacccaagcccaaggacacgctgatgatcagccggacccccgaggtgacctgcgtggtggtggacgtgagccacgaggatcccgaggtgaagttcaactggtacgtggatggcgtggaggtgcataacgccaagaccaagccgagggaggagcagtataacagcacctatagggtggtcagcgtgctcacggtcctgcaccaggattggctgaacggcaaagagtacaagtgcaaggtgtccaataaggccctgcccgcccccatagagaagaccatctccaaggccaagggccagcccagggagccccaggtgtacacgctgcccccctccagggaggagatgaccaaaaatcaggtgagcctgacctgcctggtgaaggggttctaccccagcgatatcgccgtcgagtgggagtccaatgggcaaccggaaaacaactacaagactaccccgcccgtgctggactcggacggcagcttcttcctgtactccaagctgaccgtcgacaagtcaaggtggcagcagggcaatgtgttcagctgtagcgtgatgcatgaggccctccacaaccactatacccaaaagagcctttcgctctcccccggcaag

SEQ ID NO: 459 - DNA, 1404 bp, Artificial Sequence
  IPI_HC-CO14
atggagacgcccgcccagctcctctttttactcctcctctggctccccgacaccaccggccaggtccagctcgtcgagtccgggggaggcgtcgtccagccgggcaggagcctcaggctcagctgcgccgcctccggcttcacgttcagcagctacacaatgcattgggtcaggcaggcgcccggtaaagggctcgagtgggtaaccttcatcagctacgacggcaacaacaaatactacgcggacagcgtcaagggcagatttaccatctcccgggataactccaagaataccctctacctccagatgaacagcctgagggccgaggacaccgccatctactactgcgccaggacggggtggctgggaccctttgactactggggccagggcaccctggtcaccgtgagcagcgccagcaccaaaggccccagcgtgttccccctggcacccagcagcaagagcaccagcggtggcaccgccgccctcggctgcctggtgaaggactacttcccggagcccgtgaccgtgagctggaacagcggggccctgacgtccggcgtccacacctttccagccgtgctgcaaagcagcggcctgtactccctgagcagcgtggtgaccgtgccgagcagcagcctgggcacccagacctacatctgtaacgtgaaccacaagccaagcaataccaaggtggacaaaagggtggagcccaagtcctgtgacaaaacccacacctgcccgccctgccccgcccccgaactgctgggcgggccctcggtatttctgttcccgcccaagcccaaggataccctgatgatctcccggacccccgaagtgacctgcgtagtggtggacgtgagccacgaggaccccgaggtgaagttcaactggtacgtggatggcgtggaggtgcacaacgccaagaccaagccccgggaggagcagtataacagcacgtacagggtggtgtccgtgctcaccgtactgcatcaggactggctcaacggcaaggagtataagtgtaaggtgagcaacaaggccctgcccgcccccatcgaaaagacgatcagcaaggcaaaaggccagcccagggaaccccaggtgtacaccctgccccccagcagggaggagatgaccaagaaccaggtgagcctgacctgcctggtgaagggcttttatccaagcgacatcgcggtcgagtgggagtcgaatggccagcccgagaacaactataagaccaccccacccgtgctcgactccgacggcagcttcttcctgtatagcaagctgaccgtcgacaagagcaggtggcaacagggcaacgtgttcagctgcagcgtgatgcacgaggcgctgcataatcactatacccagaaaagcctgagcctgagccccggcaag

SEQ ID NO: 460 - DNA, 1404 bp, Artificial Sequence
  IPI_HC-CO15
atggagacgcccgcccagctcctattcctcctcctcctctggctacccgacacgaccggccaggtccagctcgtcgagagcggcggcggagtcgtccagcccggcaggagcctcaggctcagctgtgccgccagcggctttaccttcagctcgtacaccatgcactgggtaaggcaggcgccaggcaagggcctcgagtgggtcaccttcatctcctacgacgggaacaataaatactacgccgacagcgtcaagggcaggttcaccataagcagggacaacagcaagaacaccctctacctgcagatgaacagcctgcgggccgaggacaccgctatttattactgcgccaggacgggttggctgggccccttcgactactggggccagggtaccctggtgacagtgtccagcgcgagcaccaagggccccagcgtgttccccctggctcccagctccaagagcacctcaggggggaccgccgccctggggtgcctggtgaaagattatttccccgagcccgtaacggtgagctggaacagcggggccctgaccagcggcgtgcacaccttccccgcggtgctgcagagcagcggcctgtacagcctctccagcgtggtgacggtgcccagctccagcctgggcacccagacctatatctgcaacgtgaaccacaagccctccaacaccaaggtggataagcgggtggagcccaagagctgcgacaagacgcacacctgcccgccctgccccgcgcccgagctgctggggggaccgtccgtgtttctgttccccccgaaacccaaggataccctgatgatcagccggacccccgaagtgacctgcgtggtggtggacgtgagccacgaggatcccgaggtgaagttcaattggtacgtggacggcgtggaggtgcataacgcgaaaaccaagccccgggaggagcagtacaacagtacctatagggtggtgagcgtgctgaccgtcctgcaccaggactggctgaacggcaaggagtacaaatgcaaggtgagcaacaaggcgctgcccgcccccatcgagaagaccatctcgaaggccaagggccaaccccgggaaccccaggtgtataccctgcccccaagcagggaagagatgaccaaaaaccaggtcagcctgacctgtctggttaagggattctacccctccgacatcgcggtggagtgggagagcaacggccagcccgagaataactacaagacgaccccgcccgtcctggacagcgacggatccttcttcctctacagcaagctgactgtggacaagagcaggtggcaacagggcaacgtcttttcgtgctccgtgatgcatgaggccctgcacaaccactacacccagaagtccctgagcctctcccccggcaag

SEQ ID NO: 461 - DNA, 1404 bp, Artificial Sequence
  IPI_HC-CO16
atggagacacccgcccagctcctcttcctcctcctcctctggctccccgacaccaccggtcaggtacagctcgtcgagtccggcggcggggtcgttcagcccggcaggagcctcaggttatcctgcgccgccagcgggtttacgttcagctcctacaccatgcactgggtccggcaggcgcccggcaagggcctcgagtgggtcaccttcatcagctacgacggcaacaacaagtactacgccgatagcgttaagggcaggttcaccatcagcagggacaattccaagaataccctctatctgcagatgaatagcctgagggcggaagacacggcaatctattattgtgcacggaccggctggctggggcccttcgactattgggggcagggtaccctggtgaccgtcagcagcgcctccaccaaggggcccagcgtgttccccctggcccccagcagcaagtccaccagcggcggcacagccgccctgggctgcctggtcaaggattactttcccgagcccgtcaccgtgagctggaacagcggggcactgacgagcggggtgcatacctttcccgccgtgctgcaaagcagcggcctctacagcctgtcgagcgtggtgaccgtgcccagtagcagcctcggcacccagacctacatctgcaacgtcaaccataagccctccaacaccaaggtggacaagagggtggagcccaagagctgcgacaagacccacacgtgcccaccctgcccggcccccgagctgctgggcggaccctccgtgttcctgtttcccccgaagccgaaagacaccctaatgatctcgaggacgccagaagtgacctgtgtggtggtcgacgtgagccacgaggacccggaggtgaagttcaattggtacgtggacggcgtggaggtgcataatgcgaagaccaagccccgggaggagcagtacaacagcacctaccgggtggtgtccgtgctgaccgtgctgcaccaggactggctgaacggcaaggagtacaagtgcaaggtgtccaacaaggccctgcctgcccccatcgagaagaccatctccaaggccaaggggcaaccccgggagcctcaagtgtacacccttccccccagcagggaggagatgaccaagaaccaggtgtcccttacctgcctggtgaaggggttctacccctccgacatcgccgtggagtgggagagcaacggtcagcccgagaacaactacaagaccaccccgcccgtgctggacagcgacggcagctttttcctgtatagcaagcttaccgtggacaagagcaggtggcagcagggcaacgtgttcagctgcagcgtcatgcacgaggccctgcacaaccattatacccagaagtctctcagcctgtcccccggcaaa

SEQ ID NO: 462 - DNA, 1404 bp, Artificial Sequence
  IPI_HC-CO17
atggagacgcccgcccagctcctatttctcctactcttgtggctccccgacacgaccgggcaggtccagctggtggagtccgggggcggggtcgtacagcccggcaggagcctccgattaagctgcgccgccagcggatttaccttcagcagctataccatgcactgggtcaggcaggcccccggcaagggcctcgagtgggtcaccttcatcagctacgacggaaacaacaagtattacgccgactccgtcaaagggaggttcaccatcagcagggacaactcgaagaacaccctctacctgcaaatgaactccctgcgcgccgaagacaccgccatatactactgcgccaggaccgggtggctggggcccttcgactactggggccagggcaccctggtgaccgtgtcctcagcctcaactaagggcccctccgtgttcccgctggcccccagcagcaagagcaccagcggcggtaccgcggccctgggctgcctggtgaaggactacttccccgagcccgtgacggtgagctggaactctggcgccctgaccagcggagtgcacaccttccccgcggtgctgcagagcagcgggctgtactccctgagcagcgtggtgactgtgccctccagctccctgggcacccagacctacatctgcaacgtcaaccacaagccgagcaacaccaaggtggacaaacgggtcgagcccaagagctgcgacaagacccacacctgcccgccctgccccgcccccgaactcctgggtggcccatcggtgttcctcttccccccgaagcccaaggacaccctgatgatcagccgcacccccgaggtcacctgcgtcgtggtggacgtgagccacgaggaccccgaagtcaagttcaactggtacgttgacggggtggaggtccacaacgccaagaccaagcccagggaggagcaatacaacagcacctaccgggtggtgagcgtgctgaccgtcctgcaccaggactggctgaacgggaaggagtacaagtgcaaagtgagcaataaggccctgcccgcccccatcgagaagaccatctccaaggccaagggccagcccagggagccccaagtgtacacgctgccccccagcagggaagagatgaccaagaaccaggtgtctctgacctgcctggtgaagggcttctaccccagcgacatcgccgtcgagtgggagagcaacggccagcccgagaacaactacaagaccaccccgcccgtgctggacagcgacggcagcttcttcctctacagcaagctgaccgtggacaagagcaggtggcagcagggcaacgtattctcctgctccgtgatgcacgaagccctgcacaaccactacacgcagaagtcactgagcctgagccccgggaag

SEQ ID NO: 463 - DNA, 1404 bp, Artificial Sequence
  IPI_HC-CO18
atggagacacccgcgcagcttctattcctcctcctcctctggctacccgacaccacgggtcaggtccagctcgtcgagagcgggggcggagtggtccagcccggcaggtcactccggctctcctgcgccgcctccggctttacctttagcagctataccatgcactgggtcaggcaggcccccgggaagggcctcgagtgggtcaccttcatcagctacgacggaaacaacaagtattacgcggattccgtaaaaggcaggttcaccatctccagggacaatagcaagaacaccctctacctgcagatgaactccctgcgagccgaagacaccgccatatactactgcgccaggaccgggtggctcgggcccttcgactattggggccaggggaccctggtgaccgtcagcagcgccagcaccaaggggccctccgtgttccccctggccccctcatccaagagcaccagcggcgggaccgcagccctggggtgcctcgtgaaggactacttccccgagcccgtgaccgtgagctggaacagcggcgcgctcaccagcggcgtgcacaccttccccgccgtgctgcagtccagcgggctgtactccctgtcctcggtggtcaccgtccccagcagcagcctgggcacccagacctacatctgcaacgtgaaccacaagcccagcaacaccaaggtggataagagggtcgagcccaaaagctgcgacaaaacccacacctgcccgccctgccccgcccccgagctgctgggcggcccaagcgtgttcctgttccctcccaaacccaaggacacgctcatgatatccaggacccccgaggtcacgtgcgtggtggtggacgtgtcccacgaggaccccgaggtcaaattcaactggtacgtggacggcgtggaggtgcacaacgccaagaccaagcccagggaggagcagtacaactccacgtaccgggtggtgtccgtcctgacggtgctccaccaagactggctgaacgggaaggagtacaagtgcaaggtgtccaacaaggccctgccggcccccatcgagaagacgatcagcaaggccaaggggcaacccagggagccccaggtttacaccctgccccccagcagggaggaaatgaccaagaatcaggtgagcctgacctgtctggtcaaaggcttctacccgagcgacatagccgtggaatgggagagcaacggccagcccgagaacaactacaaaaccacccctcccgttctcgacagcgacggcagcttcttcctctacagcaagctcaccgtagacaagagccggtggcagcagggcaatgtgttctcctgcagcgtgatgcacgaggccctgcacaatcattacactcagaaaagcctgagcctcagccccggcaag

SEQ ID NO: 464 - DNA, 1404 bp, Artificial Sequence
  IPI_HC-CO19
atggagactcccgcccagctcctcttcctcctcctcctttggctccccgacaccaccggtcaggtccagctcgtcgagagcgggggcggcgtcgtccagcccggcaggagcctcaggctcagctgcgccgccagcggcttcaccttctccagctacacgatgcactgggtcaggcaagcgcccggcaaagggctcgagtgggtaaccttcatctcatacgacggcaacaacaagtactacgcggacagcgtcaagggccggttcaccatcagcagggataacagcaagaacaccctttacctgcagatgaactcactgcgcgccgaggacaccgccatatactattgcgcaaggaccggctggctgggccccttcgactactggggccagggaacgctggtcaccgtgagctctgccagcaccaagggcccctccgtcttccccctggccccctcctccaagagcacgtccgggggcacggcggccctggggtgcctggtgaaggactacttccccgagcccgtgaccgtgtcatggaacagtggcgcgctgacgagcggggtgcatacatttcccgccgtgctccagagctccggcctgtactcgctgtccagcgtggtgaccgtgccgtccagcagcctgggcacccagacatacatatgcaatgtgaatcacaagccctccaacaccaaggtggacaaaagggtggagccgaaaagctgtgacaagacgcacacctgcccaccctgccccgcccccgagctgctgggtggcccgagcgtgttcctgttcccgccaaaacccaaggacaccctgatgatcagccggacccccgaggtgacctgcgtggtggtggacgtgagccacgaagaccccgaagtcaagttcaactggtatgtggacggcgtggaggtccacaacgccaagaccaagccccgcgaggagcagtacaactcgacctacagggtggtgagcgtgctgacagtgctccaccaggactggctgaatggcaaggagtataagtgcaaggtgagcaacaaagcgctgcccgcccccatcgagaagaccatcagcaaggccaagggccaacccagggagccccaggtctataccctcccccctagcagggaggagatgaccaaaaaccaggtgagcctcacctgcctggtgaaggggttctatcccagcgacatcgccgtggagtgggaaagcaacgggcagcccgagaacaattacaagaccaccccacccgtgctggattccgacggctcgtttttcctgtacagcaagctgaccgtcgacaagagcaggtggcaacaggggaatgtgttcagctgcagcgtgatgcacgaagccctccacaatcattatacccagaaaagcctgagcctcagccccggcaag

SEQ ID NO: 465 - DNA, 1404 bp, Artificial Sequence
  IPI_HC-CO20
atggagacacccgcccagcttttgttcctcctcctcctttggctccccgacaccaccgggcaggtccagctcgtcgagtccggcggcggcgtcgtacagcccggccggagcctcaggctcagctgcgccgcctccggcttcacctttagctcctacaccatgcactgggtcaggcaagccccaggcaagggactcgagtgggtcacctttatttcctacgacgggaataataagtactacgcagacagcgtaaagggcaggttcaccatctccagggacaactcgaagaacaccctctacctccagatgaatagcctgagggcggaggacaccgccatctattactgcgcgcgcacgggctggctgggccccttcgactactggggccagggcacactggtgacagtgagcagcgccagcaccaagggcccaagcgtgttccccctggcccccagcagcaagtcaaccagcggcggcacagcggccctgggctgcctggtgaaggactacttccccgagcccgtgaccgtgagctggaactctggcgccctgaccagcggcgtgcacacgtttcccgcggtactgcagagcagcggactctacagcctgagctccgtggtgacggtgcccagcagctccctgggcacccagacctacatctgcaacgtgaaccacaagccctccaacaccaaggtggacaaaagggtggagccgaaatcctgtgacaagacccacacgtgcccgccctgcccggccccggagctcctgggcggcccctccgtgtttctgttcccgcccaagcccaaggacacccttatgatcagccggacgcccgaggtgacctgcgtggtggtggacgtgagccacgaagaccccgaggtgaagttcaactggtacgtcgacggcgtagaggtgcacaatgccaagacgaagccccgggaggagcaatacaactccacctaccgcgtggtgagcgtgctgacggtcctccaccaggactggctcaacggtaaggagtataagtgtaaggtgagcaacaaggccctgcccgcgcccatagagaagaccatttccaaggccaagggccagcccagagagccccaagtgtacaccctgccgccaagccgggaggagatgacaaagaatcaggtgtccctcacgtgcctggtgaagggattctacccctccgacatcgccgtggagtgggagagcaacgggcagccggaaaacaattacaaaaccacccctccagtgctggacagtgacggcagcttctttctgtactccaagctgaccgtcgataagagccggtggcagcagggcaacgtcttttcgtgcagcgtgatgcacgaggccctgcacaaccactacacccagaaaagcctgagcctgagcccgggcaag

SEQ ID NO: 466 - DNA, 1404 bp, Artificial Sequence
  IPI_HC-CO21
atggagacgccggcccagctcctctttctcctcctcctctggctccccgacaccaccggccaggttcagctcgtcgagagcggcggaggcgtcgtacagcccgggcggagcctcaggctcagctgtgccgcgagcggcttcaccttcagcagctacaccatgcactgggtccggcaggcccccggcaagggcctcgagtgggtaacattcatctcctacgacggtaataacaagtactacgccgacagcgtcaagggcaggttcaccatcagcagggataactccaagaacaccctctacctgcagatgaacagcctgcgggccgaagacaccgccatctattattgcgcgaggaccggctggctgggccccttcgactattggggccagggcaccctggtgaccgtgtcgagcgccagcaccaagggccccagcgtgttccccctggcccccagcagcaagtccaccagcggcgggaccgccgcgctgggctgtctagtgaaggactacttccccgagcccgtgaccgtgtcctggaacagcggtgccctgacctccggcgtgcatacctttccggccgtgctgcagagcagcggtctgtactccctctccagcgtggtgaccgtccccagcagcagcctggggactcagacctacatctgcaacgtgaatcacaaaccctccaacaccaaggtggataagagggtcgagccaaagagctgtgacaagacccacacctgcccgccctgccccgcccccgagctgctggggggccccagcgtcttcctgttcccgcccaagcccaaggacacgctgatgatcagccgcacccccgaggtgacgtgcgtggtggtcgacgtgagccacgaggaccccgaggtaaagttcaactggtacgtggacggggtggaggtgcataacgccaagaccaaaccccgggaggagcagtacaattcaacctaccgggtggtgtcggtcctgacagtgctgcaccaggactggctcaacggcaaggaatacaagtgtaaagtgagcaataaggccctccccgcgcccatcgagaagaccatctccaaggccaaaggccagcccagggagccccaggtgtacaccctgccccccagcagggaggagatgaccaagaaccaggtgtccctgacttgcctcgtgaaaggcttctaccccagcgatatagccgtcgagtgggaaagcaacggccagcccgagaacaactataagaccacgccgcccgtgctcgactctgacggcagcttctttctgtatagcaagctgaccgtggacaagagcaggtggcagcagggcaacgtgttctcgtgctccgtgatgcatgaggccctgcataatcattacacccagaaaagcctgagcctgtcccccgggaag

SEQ ID NO: 467 - DNA, 1404 bp, Artificial Sequence
  IPI_HC-CO22
atggaaaccccagcccaactcctcttcctcctcctcctatggctcccggacaccacaggccaggtacagctcgtagagtcgggcggcggcgtagtccagcccggaaggagcctccggcttagctgcgccgcctccggcttcaccttctcgagctacaccatgcactgggtccgacaggcccccggcaaggggctcgagtgggtcaccttcatcagctacgacgggaacaacaagtactacgccgacagcgtcaagggccggttcaccatctcgagagacaacagcaagaacactctctacctgcagatgaacagcctgcgagccgaggacaccgccatctactactgtgccaggacaggatggctgggccccttcgactattggggccaaggcaccctcgtgaccgtgtccagcgcgagcaccaagggccccagcgtgttcccccttgcccccagcagtaaatccacaagcgggggcacggccgccctcggatgcctggtgaaagactacttccccgagcccgtgactgtgagctggaacagcggggcccttaccagcggcgtgcacaccttccccgccgtgctgcagtccagcggcctgtacagcctgagcagcgtcgtgaccgtgccctcttcgtctctgggcacccagacctacatctgcaacgtcaaccacaaacccagcaatactaaggtggacaagcgagttgagcccaaaagctgcgacaagacccacacctgcccgccctgcccggcccccgagctcctgggcgggccgagcgtcttcctgtttcccccgaagccgaaggataccctgatgattagcaggacccccgaggtcacctgcgtggtggtcgacgtgagccatgaggaccccgaggtgaaatttaactggtacgtggatggggtggaggtgcataacgccaagaccaagcccagggaggagcagtacaacagcacgtatcgcgtggtgtcggtgctgaccgtgctgcaccaggactggctgaacggcaaggagtacaagtgcaaggtcagcaacaaggccctgccggcccccatcgagaaaaccatcagcaaggccaaggggcagccccgggagccccaggtctatactctccctccctccagggaagaaatgaccaagaaccaggtgtcgctgacttgcctggtgaaggggttctacccctccgacatcgcggtggagtgggagtccaacggtcagcccgaaaacaactacaagacgaccccacccgtgctggacagcgacggctccttcttcctgtactcgaagctgactgtggacaagtcccgctggcagcaggggaacgtcttttcctgcagcgtgatgcacgaggccctacacaaccactacacccagaaaagcctgtcgctgtcccccgggaag

SEQ ID NO: 468 - DNA, 1404 bp, Artificial Sequence
  IPI_HC-CO23
atggagacacccgcacagctcctcttcctcctcctcctttggctcccggacaccacggggcaggtccagctcgtcgagagcgggggcggcgtcgtacagcccggtaggtcccttaggctctcctgcgccgcctccggctttacgttttcgagctacaccatgcactgggtccgccaggcccccggcaagggccttgagtgggtcaccttcatcagctacgacggcaacaacaagtactacgccgatagcgtcaagggccgcttcaccataagcagggacaactccaagaacaccctctacctgcagatgaacagcctcagggcggaggacaccgccatctactactgtgccaggaccggctggctgggccccttcgactactggggccaggggacgctggtgacggtgagcagcgcctccaccaagggccccagcgtcttcccgctggcacccagctccaagtccactagcggcggcaccgccgccctgggctgcctagtgaaagattactttcccgaacccgtgacggtgagctggaacagcggcgccctgaccagcggagtgcacacgttccccgccgtcctgcagtcctcgggcctgtacagcctgagctccgtggtcaccgtgccctcctcgagcctgggcacccagacgtatatctgcaacgtgaaccataagccatcgaataccaaggtggataagagggtggaaccgaaaagctgcgacaagacccacacttgcccgccctgcccggcccccgagctgctgggcgggccctcggtctttctgttcccacccaagcccaaggacacccttatgatcagccggacccccgaggtcacctgcgtggtggttgacgtgagccacgaggatccagaggtgaagttcaattggtacgtggatggagtcgaggtgcacaacgccaaaaccaagccccgcgaggagcagtataacagcacctatcgagtggtgagcgtgcttaccgtgctccaccaggactggctgaacgggaaggagtacaagtgcaaggtgtccaacaaggccctgcccgcccccatcgagaagaccatttccaaggccaaggggcaacccagggagccccaagtgtacaccctgccccccagccgcgaggagatgacgaaaaaccaggtgtccctgacctgcctggtcaagggcttctacccctccgacatcgccgtggagtgggaatccaacggccagcccgagaacaattacaagacaaccccgcccgtgctcgactccgacggcagctttttcctgtacagcaagctgaccgtcgacaagagccgttggcagcaggggaacgtgttcagctgcagcgtcatgcacgaggccctgcacaaccattatactcagaaaagcctgagcctgagccccggcaag

SEQ ID NO: 469 - DNA, 1404 bp, Artificial Sequence
  IPI_HC-CO24
atggagacgccggcccaactcctcttcctcctcctcctctggctccccgacaccaccggccaggttcaactggtcgagtcgggcgggggcgtcgtccagcccggccggagcctcaggctctcgtgcgccgccagcggtttcaccttcagcagctacaccatgcactgggtccgacaggcccccggcaagggcctcgagtgggtcaccttcatcagctacgacggcaacaacaaatattacgccgacagcgtaaagggccggtttaccatcagcagggacaactccaagaacaccctctacctccagatgaacagcctgcgcgccgaagacaccgccatctactactgtgccaggaccggctggctcggccccttcgactactgggggcaggggaccctggtgaccgtgtcatcggccagcacgaagggccccagcgtcttccccctggcgccctccagcaagagcacctccggcggcaccgccgccctgggatgcctggtgaaggattacttcccggagcccgtgacagtgtcctggaactccggcgcactgaccagcggcgtgcatacctttcccgccgtgctgcagagcagcggcctgtattccctgagtagcgtggtgaccgtgccctccagcagcctcgggacccaaacctacatctgcaatgtgaatcacaagccgagcaacaccaaggtggacaagcgggtggaacccaagtcctgcgataagacccacacctgcccgccgtgcccggcccccgagctgctggggggtccgagcgtgttcctgttcccgccaaagcccaaggacacgctgatgatctcgcgcacgccagaggtgacctgcgtcgtggtggacgtgagccacgaggaccccgaggtgaagttcaactggtatgtcgacggggtcgaggtgcacaacgccaagaccaagccccgggaggagcagtacaattccacctacagggtggtgtccgtgctgaccgtgctgcaccaggactggctcaatggcaaggagtacaagtgcaaggtgagcaacaaggccctgcccgcccccattgagaagacaatctccaaggccaagggtcagccaagggagccccaggtgtacacgctcccgcccagcagggaggaaatgaccaagaaccaggtgagcctgacctgtctggtgaagggcttctacccaagcgacatcgccgtggaatgggagtccaacgggcagccggagaacaactacaagactaccccgcccgtgctggacagcgacggctcgttcttcctgtacagcaagctgaccgtggacaagagcaggtggcagcaggggaacgtatttagctgctccgtgatgcacgaggccctgcacaaccattacacccagaagtcactgagcctgagccccggaaag

SEQ ID NO: 470 - DNA, 1404 bp, Artificial Sequence
  IPI_HC-CO25
atggagactcccgcccagctactcttcctcctcctcctctggctcccggacaccaccggccaggtccagctcgtcgagagcggcggcggagtcgtccagcccgggcgcagccttaggctcagctgcgccgcctccggcttcacgttctcctcctacaccatgcactgggtcaggcaggcccccggcaagggcctcgagtgggttacgtttatctcctacgacgggaacaacaaatactacgccgactccgtaaagggcaggttcaccatctccagggacaacagcaaaaacacgctctacctgcagatgaacagcctgcgggccgaggacacggccatctactactgcgccaggacggggtggctgggtcccttcgactactggggccagggcaccctggtgaccgtgtcatccgcctccaccaaggggccctcagtgttccccctggcccccagcagcaagagcacctccggggggaccgccgccctgggctgcctcgtgaaagactactttcccgagccggtcaccgtgtcctggaacagcggagccctgacctcgggcgtgcacaccttccccgccgtcctccagtcctcaggcctctacagcctgtcaagcgtggtgaccgtgcccagcagcagcctggggacccagacttacatctgcaatgtgaaccacaagcccagcaataccaaagtggacaagagggtggagcccaaatcctgcgacaagacccacacgtgtcccccttgccccgcccctgagctgctgggcgggcccagcgtgttcctgtttccccccaagccgaaggacacgctcatgatctcacgaacccccgaagtgacctgcgtggtggtggacgtgagccacgaggaccccgaggtgaagttcaactggtacgtggatggcgtggaggtgcacaacgccaagaccaagccccgagaggagcagtacaattccacctaccgggtggtgtccgtgctaaccgtgctgcatcaggattggctgaatggcaaggagtataaatgcaaggtgagcaacaaggccctccccgcccccatcgagaagaccatcagtaaggccaaaggacaacccagggagccccaggtgtacacgctgcccccaagcagggaggaaatgaccaaaaaccaggtgagcctcacctgcctggtgaagggtttttaccccagcgatatcgcagtggagtgggagagcaacggccagcccgagaacaattacaagacgacccctcccgtgctggacagcgacgggagcttctttctctacagcaagctgaccgtggacaagagcaggtggcagcagggtaatgtgtttagctgcagcgtgatgcacgaggcgctgcacaaccactacacccagaaaagcctgagcctgtcccccgggaag

SEQ ID NO: 471 - protein, 288 aa, Artificial Sequence
  Human CD80, isoform 1 protein sequence
  SIGNAL (1)..(34)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 472 - DNA, 1056 bp, Artificial Sequence
  Human CD80, isoform 1 nucleic acid sequence
  sig_peptide (1)..(102)
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaag

SEQ ID NO: 473 - protein, 468 aa, Artificial Sequence
  CD80Fc construct, protein sequence
  SIGNAL (1)..(34)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - DNA, 1404 bp, Artificial Sequence
  CD80Fc, nucleic acid sequence
  sig_peptide (1)..(102)
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgatgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 475 - protein, 4 aa, Artificial Sequence
  amino acids of the TM domain
DKTH

SEQ ID NO: 476 - protein, 5 aa, Artificial Sequence
  amino acids of the TM domain
DKTHT

SEQ ID NO: 477 - protein, 6 aa, Artificial Sequence
  amino acids of the TM domain
DKTHTC

SEQ ID NO: 478 - protein, 7 aa, Artificial Sequence
  amino acids of the TM domain
DKTHTCP

SEQ ID NO: 479 - protein, 4 aa, Artificial Sequence
  amino acids of the CP domain
FAPR

SEQ ID NO: 480 - protein, 5 aa, Artificial Sequence
  amino acids of the CP domain
FAPRC

SEQ ID NO: 481 - protein, 6 aa, Artificial Sequence
  amino acids of the CP domain
FAPRCR

SEQ ID NO: 482 - protein, 7 aa, Artificial Sequence
  amino acids of the CP domain
FAPRCRE

SEQ ID NO: 483 - protein, 8 aa, Artificial Sequence
  amino acids of the CP domain
FAPRCRER

SEQ ID NO: 484 - protein, 9 aa, Artificial Sequence
  amino acids of the CP domain
FAPRCRERR

SEQ ID NO: 485 - protein, 10 aa, Artificial Sequence
  amino acids of the CP domain
FAPRCRERRR

SEQ ID NO: 486 - protein, 11 aa, Artificial Sequence
  amino acids of the CP domain
FAPRCRERRRN

SEQ ID NO: 487 - protein, 12 aa, Artificial Sequence
  amino acids of the CP domain
FAPRCRERRRNE

SEQ ID NO: 488 - protein, 13 aa, Artificial Sequence
  amino acids of the CP domain
FAPRCRERRRNER

SEQ ID NO: 489 - protein, 14 aa, Artificial Sequence
  amino acids of the CP domain
FAPRCRERRRNERL

SEQ ID NO: 490 - protein, 15 aa, Artificial Sequence
  amino acids of the CP domain
FAPRCRERRRNERLR

SEQ ID NO: 491 - protein, 16 aa, Artificial Sequence
  amino acids of the CP domain
FAPRCRERRRNERLRR

SEQ ID NO: 492 - protein, 17 aa, Artificial Sequence
  amino acids of the CP domain
FAPRCRERRRNERLRRE

SEQ ID NO: 493 - protein, 18 aa, Artificial Sequence
  amino acids of the CP domain
FAPRCRERRRNERLRRES

SEQ ID NO: 494 - protein, 19 aa, Artificial Sequence
  amino acids of the CP domain
FAPRCRERRRNERLRRESV

SEQ ID NO: 495 - protein, 20 aa, Artificial Sequence
  amino acids of the CP domain
FAPRCRERRRNERLRRESVR

SEQ ID NO: 496 - protein, 21 aa, Artificial Sequence
  amino acids of the CP domain
FAPRCRERRRNERLRRESVRP

SEQ ID NO: 497 - protein, 22 aa, Artificial Sequence
  amino acids of the CP domain
FAPRCRERRRNERLRRESVRPV

SEQ ID NO: 498 - DNA, 1404 bp, Artificial Sequence
  CD80_Fc-CO01
atgggccacacgaggcgccagggcaccagccccagcaagtgcccgtaccttaatttcttccaacttctcgtcctcgccggcctcagccacttttgctccggcgtcatccacgtcaccaaggaggtcaaggaggttgccaccctctcgtgcgggcacaacgtgtccgtcgaggagctcgcccagaccaggatctactggcagaaagagaagaagatggtcctcaccatgatgagcggcgacatgaatatctggcccgagtacaaaaataggaccatcttcgacatcacgaataatctttccatcgtgatcctggcgctgaggccgagcgatgagggcacctacgaatgcgtggtgctgaaatacgagaaggacgccttcaagcgggagcaccttgcggaagtgaccctgtccgtgaaggcggattttccgacccccagcatcagcgatttcgagatccctaccagcaacatccggaggatcatctgctccacctccggcggcttccccgagccccacctgtcctggctggaaaatggggaggagctcaacgccatcaacaccaccgtgtcccaggaccccgagacggagctgtacgccgtgagctccaaactggatttcaacatgaccaccaaccactccttcatgtgtctgatcaaatacggccacctgcgcgtgaaccaaaccttcaattggaacaccaccaagcaggagcacttccccgacgacaagacccacacctgcccgccgtgccccgcccccgagctgcttggagggccgagcgtgttcctgttcccgcccaagcccaaggacaccctgatgatctcccgaacccccgaggtcacctgcgtggtggtggatgtgagccacgaggaccccgaggtgaagttcaactggtacgtggacggcgtggaggtccacaatgccaagacgaagcccagggaggagcaatacaactccacttacagggtcgtcagcgtgctgaccgtgctccaccaggactggctcaacggcaaggagtacaagtgtaaggtcagcaacaaggccctgcccgcacccatcgagaagaccatcagcaaggccaaaggccaaccccgcgagccccaggtgtacaccctgccccctagcagggacgaactgaccaagaaccaggtgagcctgacctgcctggtgaaggggttctaccccagcgatatcgccgtggagtgggagtccaatggccagcccgaaaacaattacaagaccacgccgcccgtcctggacagcgatggcagcttcttcctgtacagcaagctgaccgtcgacaagtccaggtggcagcagggcaacgtgttttcctgcagcgtgatgcacgaggccctgcacaaccactacacccaaaaatccctcagcctgtccccgggcaag

SEQ ID NO: 499 - DNA, 1404 bp, Artificial Sequence
  CD80_Fc-CO02
atgggccacacccgcaggcaggggacctccccctccaagtgcccctacctcaactttttccagctactcgtactcgcagggctcagccacttttgctccggagtgatccacgtcaccaaggaggttaaagaggtcgccactctcagctgtggacacaacgtctccgtcgaggaactagcccagacaaggatctactggcagaaggagaagaagatggttctcaccatgatgagcggagacatgaacatctggcccgagtacaagaaccgtaccatcttcgacatcaccaacaatctcagcatcgtgatcctggccctcaggccctccgatgagggcacctacgagtgcgtcgtgctgaagtacgagaaagacgccttcaagagggaacacctggccgaggtgaccctgtccgtgaaggccgacttccctacccccagcattagcgacttcgagatcccaacctccaacatacggcgtattatctgcagcactagcgggggcttccccgagccccacctgtcctggctggaaaacggcgaggagctgaacgccatcaacaccaccgtcagccaggatcccgagacagagctgtacgccgtgagctcgaagctggacttcaacatgacgaccaaccactccttcatgtgcctgatcaagtatggccacctgagggtcaaccagaccttcaactggaacaccaccaagcaagagcacttcccggacgataagacccacacctgccccccgtgcccggcccccgagctgctcggcgggcccagcgtgttcctgttccctcccaaacccaaggacacgctgatgatcagccggacccccgaggtgacgtgtgttgtcgtggacgtgagccacgaggaccccgaagtgaagtttaactggtacgtggatggggtggaggtgcacaacgccaaaaccaagcccagggaggagcagtacaatagcacctatagggtggtatcggtgctgaccgtgctgcaccaggactggctgaacggcaaggagtacaagtgcaaggtgagcaataaggccctcccggcccccatcgagaagaccatcagcaaggccaaggggcagcccagggaaccccaggtgtacaccctgcccccatcccgggacgagctcaccaagaaccaggtgagcctgacctgcctggtgaagggattctacccaagcgatatcgccgtggagtgggagtccaacgggcagccggagaacaactacaagaccaccccacccgtgctggactccgacggcagcttcttcctgtactccaagctgaccgtggacaagagccgctggcagcagggaaatgtgttcagctgcagcgtgatgcacgaggccctgcacaatcactacacccagaaaagcctcagcctgagcccgggcaag

SEQ ID NO: 500 - DNA, 1404 bp, Artificial Sequence
  CD80_Fc-CO03
atgggccacaccaggaggcagggcaccagcccgagcaagtgcccatatctcaactttttccagctcctcgtactcgccggactaagccatttctgcagcggggtcatccacgtcaccaaggaggtcaaggaggtcgccacgctcagctgcgggcacaacgtcagcgtcgaggagctcgcccagaccagaatctactggcagaaagagaagaagatggtcctcactatgatgagcggcgacatgaacatctggccagaatacaagaaccggaccatcttcgacatcaccaacaacctcagcatcgtgatccttgcgctgcggccctccgacgaagggacctacgagtgcgtggtgctgaagtatgagaaggacgcctttaaacgcgagcacctggccgaggtgacgctgtccgtgaaggccgactttcccaccccgtccatcagcgacttcgagatccccaccagcaatatccgccggatcatctgctccacctccgggggctttcccgagccacacctgtcctggctggagaacggcgaggagctgaatgccatcaacaccacggtgagccaggaccccgagacggagctctacgccgtgagcagcaagctggacttcaacatgaccaccaaccacagcttcatgtgcctgatcaagtatggccacctgcgtgtgaaccaaacctttaattggaacaccaccaagcaggagcacttccccgacgacaaaacgcacacctgcccgccctgccccgcccccgagctgctgggcgggccgagcgtgttcctgttccctcccaagcccaaagacaccctgatgatcagcaggacgccggaggtgacctgtgtcgtggtggacgtgagccacgaggaccccgaggtgaagttcaactggtacgtcgacggggtggaggtgcacaacgccaagacgaagcccagggaggagcagtataacagcacctacagggtggtgagcgtgctgaccgtgctgcaccaggattggctgaacggcaaagagtacaagtgtaaggtgagcaacaaggccctgcccgcacccatcgagaagaccatcagcaaggccaaggggcagcccagggaaccccaagtgtataccctgccgccgtcccgggatgagctgaccaagaaccaggtgtccctcacctgcctggtgaagggattctaccccagcgatatcgctgttgagtgggagagcaatggccagcccgagaacaactacaagacgacgcccccggtgctggatagtgacgggagcttctttctgtacagcaaactgaccgtggataagtccaggtggcagcagggcaacgtgttcagctgctccgtgatgcacgaggccctgcacaatcattacacccagaagtccctgagcctgagcccgggcaaa

SEQ ID NO: 501 - DNA, 1404 bp, Artificial Sequence
  CD80_Fc-CO04
atggggcataccaggcgacaaggcacgagcccctcaaagtgtccctacctcaacttcttccagcttctcgtcctcgccggcctcagccacttctgcagcggcgtaatccacgtcaccaaggaggtcaaggaggtcgccactcttagctgcggccacaacgtcagcgtcgaagaacttgcccagacgaggatctattggcagaaggagaagaagatggtactcaccatgatgagcggcgacatgaacatctggcccgagtacaagaacaggacgatcttcgacataaccaacaacctcagcatcgtcatcctggccctgaggccaagcgacgagggaacctacgaatgcgtggtgctcaaatacgagaaagatgccttcaagcgggagcacctggccgaggtgaccctgtccgtgaaggccgacttccctacccccagcatctcggacttcgagatccccacgagcaacatccgcaggatcatttgcagcaccagcggggggttccccgagccccacctcagctggctggagaacggcgaagaactcaacgccatcaacaccaccgtgagccaggaccccgagacggagctgtacgcggtgtcctcgaagctcgatttcaacatgacgacgaaccatagcttcatgtgcctcatcaagtacggtcacctcagggtgaaccagaccttcaactggaacacgaccaagcaggagcacttccccgacgacaagacccacacctgcccgccctgccccgcccccgagctgctgggtggccccagcgtgtttctgttcccgcccaagcccaaggacaccctgatgatctccaggacccccgaggtaacctgcgtggtggtggacgtgagccacgaggaccccgaggtgaagttcaactggtacgtggacggcgtggaggtgcacaacgccaaaaccaagcccagggaggagcagtacaacagcacctaccgcgtggtatccgtgctgactgtgctgcaccaagactggctgaacggaaaggagtacaagtgcaaggtgtccaacaaggctctgcccgcccccatcgagaagacaatcagcaaggccaagggccagccccgggagccccaggtgtacaccctccctccctccagggacgagctcaccaagaaccaggtgtccctgacctgtctggtgaagggcttctacccgagcgacatagccgtggagtgggagagcaatggccagccggagaacaactacaagaccaccccacccgtgctggacagcgacgggagcttcttcctgtactccaagctcacggtggacaagagcaggtggcagcagggcaacgtgttcagctgcagcgtgatgcacgaggccctgcataaccactacacccagaagtcgctgagcctgtccccgggcaag

SEQ ID NO: 502 - DNA, 1404 bp, Artificial Sequence
  CD80_Fc-CO05
atgggccacaccaggcgacagggcaccagccccagcaagtgcccctatctcaacttcttccagctcctagtcctcgccggcctttcacacttctgtagcggggtcatccacgtcaccaaagaggtcaaggaggtcgccacactcagctgtggccataacgtatccgtcgaggagctcgcccagaccaggatctactggcagaaggaaaagaagatggtcctcaccatgatgagcggcgacatgaacatctggcccgagtataaaaaccggaccatcttcgacatcaccaacaacctcagcatcgtgatcctggccctcaggcccagcgatgaggggacctacgagtgcgtggtgctgaagtacgagaaggacgccttcaagcgggaacacctggccgaggtgaccctgagcgtgaaggccgatttccccaccccgagcatcagcgacttcgagatccccacctccaacatccggcgaatcatctgcagcacctcaggaggctttcccgagccccacctgagctggctggagaatggggaggagctgaacgccatcaacaccaccgtcagccaggaccccgagacggagctgtacgccgtgtcatccaaactggacttcaacatgaccacgaaccactcattcatgtgcctgatcaagtacgggcacctgcgcgtgaaccagacgttcaactggaacaccacgaaacaggagcacttccccgacgacaagacacacacctgcccgccctgccccgcccccgagctgctgggcggccctagcgtgttcctcttccccccaaagcccaaggacaccctgatgatctccaggacaccggaagtgacctgcgtcgtcgtagacgtcagtcacgaggaccccgaggtgaagttcaactggtacgtggacggcgtggaggtccacaacgcgaagaccaagccccgggaggaacagtacaacagcacgtaccgggtggtgagcgtgctgaccgtgctgcatcaggattggctgaacggcaaggagtacaagtgcaaggtgagcaacaaggccctgccggccccgatcgagaagaccatcagcaaggccaagggccagccccgcgagccccaggtgtacaccctgcccccttcccgcgacgagctcaccaagaatcaggtgtccctgacatgcctggtgaagggcttctacccgagcgacatcgcggtggaatgggaaagcaacggccaacccgagaacaactacaagaccacccctcccgtgctggactccgacggcagcttcttcctgtactccaagctcaccgtggacaagtccaggtggcagcaggggaatgtgttctcctgcagcgtgatgcacgaggccctgcacaaccactacacacagaaaagcctgagcctgagccccggcaag

SEQ ID NO: 503 - DNA, 1404 bp, Artificial Sequence
  CD80_Fc-CO06
atgggccacaccaggaggcagggcaccagcccctccaagtgcccgtacctcaatttcttccagctcctcgtcctcgcggggttaagccacttttgctcaggcgtcatccacgtcaccaaggaggtcaaagaggtcgccaccctcagctgcggccacaacgtcagcgtagaggagcttgcccagaccaggatatactggcagaaagagaagaagatggtactcaccatgatgagcggcgacatgaacatctggcccgaatacaaaaaccggaccatcttcgacattaccaacaatctctccatcgtgatcctggccctcaggccctccgacgaggggacctacgagtgtgtggtactgaagtacgagaaggacgccttcaagcgggagcacctggccgaagtcaccctgtccgtgaaggccgacttcccgacacccagcatcagcgactttgaaatccccaccagcaatatcaggaggatcatctgctcgaccagcggcggcttccccgagccccacctgtcatggctggagaacggcgaggagctgaacgccatcaacaccaccgtctcgcaggacccggagacagagctgtacgccgtgtccagcaagctggacttcaacatgaccacaaatcacagcttcatgtgcctgatcaagtacggccacctgagggtcaaccaaaccttcaactggaacacgaccaaacaagagcactttccggatgacaagacacacacctgcccgccctgccccgcccccgagctgctgggcgggcccagcgtgttcctcttcccgcccaagcccaaggacaccctgatgatctcccgcacccccgaggtgacctgcgtggtggtggacgtgtcccatgaggatcccgaggtgaagtttaactggtacgtggacggcgtggaagtgcataacgccaagaccaagcccagggaggagcaatataacagcacctacagggtggtgagcgtgctgaccgtgctgcatcaagattggctcaacggcaaggagtacaagtgcaaggtcagcaacaaggccctgcccgcgccgatcgagaagaccatcagcaaagccaaggggcagcccagggagccccaagtgtacacgctcccgcccagcagggacgagctgaccaaaaaccaggttagcctgacctgcctggtgaagggcttctacccctccgacattgccgtggagtgggagtcaaacgggcagccggagaacaattacaagacgacccctcccgtgctggacagcgacgggtccttcttcctgtatagcaagctcaccgtggataagagcaggtggcagcagggcaacgtcttctcgtgcagcgtgatgcacgaggccctgcacaaccattacacccagaaaagcctgtcgctgtcccccgggaag

SEQ ID NO: 504 - DNA, 1404 bp, Artificial Sequence
  CD80_Fc-CO07
atgggccacaccaggcgccagggcacaagccccagcaagtgcccctacctcaacttcttccagctcctcgtcctcgccgggctaagccacttctgctcaggcgtaattcacgtcaccaaggaggtcaaggaggtcgccaccctcagctgcggccacaacgtctccgtcgaggagttggcccagaccaggatctactggcagaaggaaaagaaaatggtcctcaccatgatgagcggggacatgaacatctggcccgaatacaaaaaccgcaccatcttcgacatcaccaacaacctcagcatcgtgatcctggcccttcggccgtccgacgagggcacctacgagtgcgtggtgctgaagtacgagaaggacgccttcaagagggagcacctggccgaggtgaccctgagcgtgaaggccgatttccccactcccagcatcagcgacttcgagatccccaccagcaacatccggaggataatctgcagcaccagcgggggctttcccgagccccacctcagctggctcgagaacggcgaggagctgaacgccataaacacgaccgtgagccaggaccccgagactgagctgtacgccgtcagcagcaagctggacttcaacatgacgaccaatcactcgttcatgtgtctgattaagtatggacatctgagggtgaaccagaccttcaattggaacaccaccaagcaggagcacttccccgacgataagacccacacctgcccgccctgccccgccccggaactgctggggggccccagcgtgttcctgttcccgcccaagcccaaggacaccctgatgatcagcaggacacccgaggtgacctgcgtggttgtggacgtgtcccatgaggatcccgaggtgaagttcaactggtacgtagacggggtggaggtgcacaatgccaagaccaagccccgcgaggagcagtacaacagcacctaccgggtggtgtccgtgctgaccgtcctgcaccaggactggctgaacggcaaggagtacaaatgcaaggtgagcaacaaggccctgcccgcgcccatcgaaaagacgatcagcaaggccaaagggcagccccgggagccccaggtgtacacgctgccgcccagccgcgatgagctgacgaaaaaccaagtgagcctcacgtgcctggtcaagggcttctacccctccgatatcgcagtggagtgggagagcaacggccagcccgagaacaactacaagaccacgcccccggtgctggactccgacggctcgttcttcctgtacagcaagctgacggttgacaagtccaggtggcagcaggggaacgtgtttagctgcagcgtgatgcacgaggccctccataaccactacacgcagaagtccctgtccctgagccccggcaag

SEQ ID NO: 505 - DNA, 1404 bp, Artificial Sequence
  CD80_Fc-CO08
atgggccacaccaggcggcagggcaccagccccagcaagtgcccctacctcaacttttttcagcttttggtcctcgccggcctaagccatttttgctccggggtcatccacgtgaccaaggaggtaaaggaggtcgccaccctcagctgcggacacaacgtcagcgtagaggagctcgcccagacccgaatctactggcaaaaggagaagaagatggtcctcaccatgatgtccggcgatatgaacatctggccggagtacaaaaataggacaatcttcgatatcaccaacaacctaagcatcgtgatcctggcgctgcggcccagcgatgaaggcacgtacgaatgcgtggtgctgaagtacgaaaaggacgcctttaagagggagcacctggccgaggtgaccctcagcgtgaaggccgacttccccaccccctccatcagcgacttcgagatacccaccagcaacatccgacggattatctgcagcaccagcgggggcttccccgaaccccacctgtcctggctggagaacggcgaggagctgaacgccatcaacaccaccgtgagccaggatcccgagacagagctctacgcggtgagcagcaagctggacttcaacatgaccacaaaccacagcttcatgtgcctcatcaagtatggccatctgagggtgaaccagaccttcaactggaacaccaccaaacaggagcacttcccggacgacaagacccacacctgcccaccctgccccgcccccgagctgctgggtggccccagcgtgtttctgttccccccgaagcccaaagatacactgatgatcagccgaaccccagaggtgacgtgtgtggtggtcgacgtgagccacgaggacccggaggtcaaattcaactggtacgtggacggcgtggaggtgcacaacgccaagaccaaacccagagaggagcagtacaacagcacgtaccgtgtggtcagcgtgctgaccgtgctgcaccaggactggctgaacggcaaggagtacaagtgcaaggtgagcaataaggcgctgcccgcccccatcgagaaaaccatctccaaagccaagggccaaccccgggagcctcaggtgtacaccctgccgcccagcagggacgagctgaccaagaaccaggtgtccctgacctgcctggtgaaaggcttctatcccagcgacatcgctgtggagtgggagtccaacgggcaacccgagaacaactacaagaccaccccgcccgtactggactcggatggcagcttcttcctgtactcgaagctgaccgtggacaaaagcaggtggcagcagggaaacgtgttctcatgcagcgtcatgcacgaggccctccacaaccactacacccagaaatccctgagcctgagccccggcaaa

SEQ ID NO: 506 - DNA, 1404 bp, Artificial Sequence
  CD80_Fc-CO09
atgggccacaccaggcgccaaggcaccagcccctcaaagtgcccctacctcaacttcttccagctcctcgtactcgcggggctcagccacttctgctcgggcgtgatccacgttaccaaggaggtcaaagaggtcgcgaccctctcctgtggccacaacgtctccgtcgaggagcttgcccagacccgaatctactggcagaaggagaaaaagatggtcctcacgatgatgagcggagacatgaacatctggccggagtataagaaccggaccatcttcgacatcaccaacaacctcagcatcgtcatcctggccctgcgtccatccgatgaggggacctacgagtgcgtggtcctcaagtatgaaaaggacgccttcaagcgggagcacctggccgaggtcaccctgagtgtcaaggccgacttccctacccccagcatcagtgacttcgagatccccacttccaacataaggaggatcatctgctccaccagcggaggcttccccgagccccacctgagctggctggagaacggcgaggagctgaacgccatcaataccaccgttagccaggaccccgagacggagctgtacgccgtgagcagcaagctggacttcaacatgaccaccaatcactcattcatgtgcctcattaagtacggccacctgagggtcaaccagaccttcaactggaacaccaccaagcaggagcacttcccggatgataagacccacacctgcccgccctgccccgccccagagctgctgggcggccccagcgtcttcctgttcccgcccaagcctaaggacaccctcatgatcagccggacccccgaggtaacctgcgtggtggtggacgtaagccacgaggatcccgaggtgaagttcaactggtacgtcgacggggtggaggtgcataacgcgaagaccaaaccccgcgaagaacagtacaacagcacctacagggtcgttagtgtgctcaccgtgctccaccaggattggctgaacgggaaagagtacaagtgcaaggtgtccaacaaagcactccccgcccccatcgagaagaccatctccaaggccaagggccagccgagggaacctcaggtctacaccctgccccccagcagggacgagctgaccaagaaccaggtgagcctgacctgcctggtgaagggcttctacccgagcgacatcgcggtggaatgggagtccaacggccagcccgagaacaactataagaccacgccccccgtgctcgactccgacggcagcttcttcctgtattccaagctgaccgtggacaagtcgaggtggcagcaaggtaacgtgttctcctgcagcgtgatgcacgaggccctccacaatcattacacccagaagtcgctgagcctgagtccgggtaaa

SEQ ID NO: 507 - DNA, 1404 bp, Artificial Sequence
  CD80_Fc-CO10
atggggcacacccggcgacagggcacgagccccagcaagtgcccctacctcaacttcttccaactcctcgttctcgccggcctctcgcacttttgctcgggcgtcatccacgtcaccaaggaagttaaggaggtcgccaccctctcctgcggccacaacgtctccgtcgaggaactcgcgcagacccgcatatactggcaaaaggaaaagaagatggtcctcacgatgatgagcggagacatgaacatttggcccgagtacaagaaccgcaccatcttcgacatcaccaacaacctctccatagtgatcctggccctgcggcccagcgacgaggggacctatgagtgcgtggtgctgaagtacgaaaaggacgccttcaagagggagcacctggccgaggtgaccctgagcgtgaaggccgatttccccacccccagcatcagcgacttcgaaatccccaccagcaacatcaggcggataatctgcagcaccagcggcggcttccccgagccccacctgagctggctggagaatggggaggaactgaacgccattaacaccacagtcagccaagatcccgagacagagctctacgccgtgtcctcgaagctggacttcaacatgaccaccaaccacagcttcatgtgcctgatcaaatacgggcacctgcgggtgaaccaaaccttcaactggaacaccaccaagcaggagcacttccccgacgacaagacgcatacgtgcccaccctgccccgcccccgagctcctcggcggccccagcgtgttcttattcccgcccaagcccaaggacaccctgatgatctcccggacgccggaggtgacgtgtgtggtcgtggacgtgagccacgaggacccggaggtgaagtttaattggtacgtggacggggtggaggtgcacaacgcgaagaccaagcccagggaggagcagtacaacagcacctaccgcgtggtgagcgtgctgaccgtactgcaccaggactggctcaatggcaaggagtacaagtgcaaggtgtccaacaaggccctgcccgctccgatcgaaaaaacgatcagcaaggcgaaagggcagcccagggaaccccaggtctacaccctgccgcccagccgcgacgaactgaccaagaaccaggtgtcactgacctgcctggtgaaggggttctatccgtcggacatcgcggtggagtgggagtccaacggccaacccgagaacaattacaaaaccaccccgcccgtgctggacagcgacgggagcttctttctgtattccaagttaacagtcgacaagagcaggtggcagcagggcaacgtgttctcctgcagcgtcatgcacgaggccctccacaaccactacacccagaaaagcttgagcctgtcccccggcaag

SEQ ID NO: 508 - DNA, 1404 bp, Artificial Sequence
  CD80_Fc-CO11
atggggcacacaaggaggcaaggcaccagccccagcaagtgcccgtacctaaactttttccagctcctcgtcctcgcaggcctaagccacttttgctccggcgtcatacacgtcaccaaggaggtaaaggaggtcgcaaccctaagctgcggccacaacgtgtccgtcgaggagttagcccagaccagaatctactggcaaaaagagaagaagatggtccttacgatgatgtcaggcgacatgaacatctggccggagtacaagaaccggactatcttcgacatcaccaataaccttagcatcgtgatcctggccctcaggccctccgacgagggcacctacgagtgcgtcgtgctgaaatacgagaaggatgccttcaagagggagcacctggccgaggtgaccctgagcgtgaaggccgacttcccgaccccgagcatctccgatttcgagatcccgaccagcaacataaggaggatcatttgcagcacctccggcggcttccccgagccgcacctgagctggctcgagaatggcgaggagctgaatgccatcaacaccaccgtgagccaggacccggagacggaactctatgcggtgagcagcaagctcgacttcaacatgacgacgaaccactccttcatgtgcctgatcaagtacggccatctgcgggtgaaccagaccttcaactggaacaccaccaagcaggagcacttccccgatgacaagacgcacacctgcccgccgtgccccgccccggagctgctggggggccccagcgtcttcctgttcccgcccaagcccaaggataccctgatgatctccaggacgcccgaggtgacctgcgtcgtggttgacgtatcccacgaggaccccgaagtgaaattcaactggtatgtggacggggtagaggtgcacaacgctaaaactaagccgcgggaggagcagtacaatagcacctatcgagtggtgagcgtgctgaccgtgctgcaccaggactggctgaacgggaaggagtataagtgcaaggtgtcgaacaaagccctgcccgcccccatcgagaagaccatctcgaaagccaagggccagcccagggagccccaggtctacacgctgcccccctcccgggacgagctcaccaagaatcaggtgagcctgacctgtctggtcaaggggttctacccctccgacatcgcggtggagtgggagagcaacggccaacccgagaacaactataagaccacgccgcccgtgctggactccgacgggtccttctttctgtactccaagctcaccgtggataagtcccgctggcagcagggcaacgtgttcagctgcagcgtgatgcacgaggccctccacaaccactacacccagaaaagcctgagcctgagcccgggcaag

SEQ ID NO: 509 - DNA, 1404 bp, Artificial Sequence
  CD80_Fc-CO12
atgggccacaccaggagacagggcaccagccccagcaagtgcccctatctcaacttcttccagctcctcgtacttgccggcctttcgcacttctgctccggagtcatccacgtaaccaaggaggttaaggaggtcgccaccctcagctgtgggcacaacgtcagcgtcgaggagctagcccagaccaggatctactggcaaaaggagaagaagatggtactcaccatgatgtccggagacatgaacatttggcccgagtacaagaataggaccatcttcgatatcacgaacaacctctccatcgtgatcctggccctcaggcccagcgacgaaggcacctacgagtgcgtggtgctgaagtacgaaaaggacgccttcaagagggagcacctggccgaggtgaccctgagcgtgaaggccgacttccccaccccaagcatcagcgacttcgagattccgaccagcaacatcaggcgcatcatctgcagcaccagcggcggctttcccgagccgcatctgagctggctggagaacggcgaggagctgaacgccatcaacacgaccgtgagccaggatcccgagacggagctgtacgccgtcagctccaagctggacttcaacatgaccaccaaccacagctttatgtgcctgatcaagtacgggcatctgcgggtgaaccagacctttaactggaacaccaccaagcaggagcattttccggacgacaagacccacacgtgtcccccctgccccgctcccgagctgctcggcggcccctccgtcttcctgttccctcccaagcccaaggacaccctgatgatctccaggacccccgaggtcacctgtgtggtggtggatgtgtcccacgaggaccccgaggtgaagttcaattggtacgtggacggcgtggaggtgcacaacgccaaaaccaagccccgggaggagcagtacaattccacctacagggttgtgagcgtcctcaccgtgctgcaccaggactggctcaatgggaaggagtacaagtgcaaggtcagcaacaaggccctgcccgcccccatcgagaagacgatcagcaaggccaaagggcagccccgcgagccccaggtctataccctgccccccagccgggatgagctgaccaagaaccaggtgtctctgacatgcctggtgaaggggttctatcccagcgacatcgccgtggagtgggagagcaacgggcaacccgagaacaactataagacgactccccccgtcctggactccgacggcagcttcttcctgtactccaagctgaccgtggacaagtccaggtggcagcaggggaacgtgtttagctgcagcgtcatgcacgaggccctgcacaaccactatacacagaaaagcctgagcctgtcacccgggaag

SEQ ID NO: 510 - DNA, 1404 bp, Artificial Sequence
  CD80_Fc-CO13
atgggccacaccaggcgccaaggaaccagcccctcgaagtgcccctacctcaacttctttcagcttctagtcctcgccggcttatcccatttctgcagcggcgtaatacacgttaccaaggaggtcaaggaggtcgcgaccctcagctgcggacataacgtgtccgtagaggagctcgctcagacccggatctattggcagaaggagaagaagatggtcctcaccatgatgagcggcgacatgaacatctggcccgagtacaagaacaggaccatcttcgacatcaccaacaacctaagtatcgtgatcctggccctgcggcccagcgacgagggcacctacgagtgcgtggtgctgaagtacgagaaggacgccttcaagagggagcacctggccgaggtgaccctgtcagtgaaggccgacttcccaacccccagcatcagcgatttcgagatccccaccagcaatatcaggcgcataatctgcagcaccagcggcggctttcccgagccgcacctcagctggctggagaatggcgaagaactgaacgccatcaacaccaccgtctcgcaggaccccgagacggagctctacgccgtgagctccaagctggactttaacatgacgaccaatcactcctttatgtgcctcattaaatacggacatctgcgcgtgaaccagaccttcaactggaacaccaccaagcaggaacactttcccgacgacaagacgcatacgtgcccaccctgccccgccccggagctgctgggcggccccagcgtgttcctcttcccgcccaagcccaaggacacgctgatgatctcccggacccccgaggtgacctgcgtggtggtggatgtctcgcacgaggacccggaggtgaagttcaactggtacgtggatggcgtggaagtccataacgccaagacaaagccccgggaggaacagtacaacagcacctatagggtggtgagcgtgctgacggtgctgcaccaggattggctgaacggcaaggaatacaagtgcaaggtgtccaacaaggccctgcctgcccccatcgagaaaaccatctccaaggccaagggccaaccccgagagccccaggtttacactttacccccctccagggacgagctgaccaagaatcaggtgagcctcacctgcctggtcaaggggttctaccccagcgacatcgccgtggagtgggaaagcaacggccagcccgagaacaactacaagacaaccccgcccgtgctggacagcgacgggagcttcttcctgtatagcaagctgaccgtggataagagccggtggcagcagggcaacgtgtttagctgcagcgttatgcacgaggccctgcacaaccactacacccagaaatccctgtccctgtcccccggtaag

SEQ ID NO: 511 - DNA, 1404 bp, Artificial Sequence
  CD80_Fc-CO14
atgggccacacgaggcgtcagggcaccagccccagcaagtgcccctacctcaatttcttccagctcctcgtcctagccggtctgagccacttctgcagcggggtcatccacgtaaccaaggaggtcaaggaggtcgccaccttgtcctgcggccataacgtctccgtagaggagctcgcgcaaacgcggatatattggcaaaaagagaagaagatggtcctcaccatgatgtccggggacatgaatatctggcccgaatacaaaaacaggaccatcttcgacatcacgaacaatctctccatcgtgatcctggccctgaggcccagcgacgagggcacctacgagtgcgtggtcctgaagtacgagaaggacgccttcaagagggagcacctggccgaggtgaccctgtccgtgaaggcagacttccccacccccagcatcagcgacttcgagatccccacctccaacatcagaaggatcatctgctccacctcgggcggtttccccgagccccacctgagttggctcgagaacggcgaggaactgaatgccattaacaccaccgtcagccaggaccccgagacggagctgtacgccgtctcatccaaactggacttcaacatgaccaccaatcacagcttcatgtgtctgattaagtacgggcatctgcgggtcaaccaaacctttaactggaacacaaccaaacaggaacatttcccggacgacaagacccacacgtgcccaccctgccccgcccccgagctgctcggcgggccgagcgtgttcctgttcccgcccaaacccaaggacactctgatgatctcccggacccccgaggtgacgtgcgtggtggtggacgtgagtcacgaggaccccgaggtgaagttcaactggtacgtggacggggtggaggtgcataatgccaagaccaagccgagggaggagcagtacaactccacctacagggtcgtgagcgtgcttacggtgctccaccaggactggctgaacgggaaggagtacaagtgtaaggtgagcaataaggcgctgcccgcccccatcgagaaaaccatcagcaaagccaaggggcagccccgggagccccaggtgtacaccctccccccatccagagacgagctcaccaagaatcaggtgagcctcacctgcctggtcaagggcttctatccctccgacatcgccgtggagtgggaatccaacgggcagcccgagaacaactataaaaccaccccaccggtcctggactcagatgggagcttcttcctgtacagcaagctcaccgtcgacaagtcgaggtggcagcaggggaacgtgttcagctgctccgtgatgcacgaagccctgcacaaccactacacccagaagtcgctcagcctgagcccagggaag

SEQ ID NO: 512 - DNA, 1404 bp, Artificial Sequence
  CD80_Fc-CO15
atgggccacacgaggaggcaggggacctccccctcaaagtgcccctatctcaacttcttccagctcctcgtccttgccggcctctctcacttctgcagcggggtcatccacgtcacaaaggaggtcaaggaggtcgccaccctctcctgcgggcacaacgtcagcgttgaggagcttgcccagaccaggatctactggcagaaggagaagaagatggtcctcaccatgatgtccggggacatgaacatttggcccgagtacaagaataggaccatcttcgatatcaccaacaacttgagcatcgtgatcctggccctgcggcccagcgacgagggcacctacgagtgtgtcgtgctgaagtacgagaaggacgccttcaagcgggagcatctcgccgaggtgaccctgagcgtcaaggccgacttccccaccccctccatcagcgatttcgagatcccgaccagcaacatccggcgtatcatatgcagcaccagcggcggattcccggagccccatctgtcctggcttgagaacggcgaggagctgaatgccatcaataccacggttagccaggacccggagacagaactgtacgccgtgtccagcaaactggacttcaacatgacaaccaatcactccttcatgtgcctgatcaagtacggccacctgagggtgaaccagacgttcaactggaataccaccaagcaggagcacttccccgacgacaaaacgcacacatgcccgccctgccccgcccccgagctgctgggcggtccctccgtgttcctgttcccacccaagccgaaggacacgctgatgatcagccgcacccccgaggtgacatgcgtggtggtcgacgtcagccacgaggaccccgaggtgaagttcaactggtacgtggacggcgtggaagtgcacaacgccaagaccaagccccgcgaggaacagtacaattcgacctacagggtggtgagcgtgctgaccgtgctgcaccaggactggctgaatggcaaggaatacaagtgcaaggtcagcaataaggccctgcccgcccccatcgagaagaccatcagcaaggccaagggccagcccagggaaccccaggtgtacaccctgcccccgagccgggacgagctgaccaagaaccaggtgagcctgacgtgtctggtgaagggcttctaccccagcgacatcgccgtggagtgggagagcaacggtcagcccgagaacaactacaagaccacccctcccgtcctggatagcgacggctccttcttcctgtacagcaagctgaccgtggacaaaagcaggtggcagcagggcaacgtgttcagctgcagcgtgatgcacgaggcgctgcacaaccactacacccaaaagagcctgtcgctgagccccggcaag

SEQ ID NO: 513 - DNA, 1404 bp, Artificial Sequence
  CD80_Fc-CO16
atgggccacaccaggaggcagggcacctcgccctcgaagtgcccctaccttaatttcttccagctacttgtactcgccggcctcagccacttctgcagcggcgtcatccacgttaccaaagaagtaaaggaggtcgcaaccctcagctgcggacacaacgtgagcgtcgaggagctcgcgcagacccggatctactggcagaaggaaaagaagatggtcctcacgatgatgtccggagatatgaacatttggcccgagtacaaaaaccgcaccatcttcgacatcaccaacaacctttcgatagtgatcctggcgctcaggcccagcgacgagggcacatacgaatgcgtggtgcttaagtacgagaaggatgccttcaagcgggagcacctggccgaggtgacgctgtccgtgaaggccgacttccccacccctagcataagcgatttcgagatccccaccagcaacatcaggcgcatcatctgcagcaccagcgggggcttccccgagccccacctgtcctggctggaaaacggcgaggagctgaacgccatcaacaccaccgtcagccaggaccccgagacagagctgtacgccgtgagctccaagctggatttcaacatgaccacaaaccattccttcatgtgcctgattaagtatggtcacctgcgggtgaaccagacctttaactggaacacgaccaagcaggagcacttccccgacgacaagacccacacgtgccccccttgccccgcccccgagctgctcggcggcccctccgtgttcctgttcccacccaagccgaaggacaccctcatgatcagccgcacccccgaggtgacctgcgtggtcgtggacgtgagccatgaggatcccgaagtgaagttcaattggtacgtggacggggtggaggtgcacaacgcaaagaccaagccgagggaggagcagtacaacagcacctacagggtggtgtccgtcctgaccgtgctgcaccaggattggctgaacgggaaggagtataagtgcaaggtgagcaataaagccctgcccgcccccatcgagaagaccatcagcaaggcgaagggccaaccccgggagccgcaggtctatacgctgccccccagccgggacgagctcaccaagaaccaggtgagcctgacctgtctggtgaagggattctatccctccgacatcgccgtggagtgggaatccaacggccagcccgaaaacaactacaagacaacgccccccgtgctggactccgacggcagcttcttcctgtatagcaagctgaccgtcgacaagtcgcgctggcagcagggcaacgtgttcagctgcagcgtgatgcatgaggccctgcacaaccattacacgcagaagtccctctcccttagccccggtaag

SEQ ID NO: 514 - DNA, 1404 bp, Artificial Sequence
  CD80_Fc-CO17
atgggccatacgaggcgccaaggcacgagccccagcaagtgcccctaccttaacttcttccaacttctcgtcctcgccggcttaagccacttttgcagcggggtcatccacgtgaccaaggaggtcaaagaggtcgccacgctcagctgcggtcacaacgtatcggttgaggagttagcgcagaccaggatctactggcagaaggaaaagaagatggtcctcaccatgatgagcggcgatatgaacatctggcccgagtataagaaccgaaccatcttcgacataaccaacaacctctccatcgtcatcctggccctgcgccccagcgacgagggcacctacgagtgcgtggtcctgaagtatgagaaggatgcctttaagcgggagcacctggcggaggtcacgctgagcgtgaaggccgacttccccacgcccagcatcagcgatttcgagatccctaccagcaatatccggcggattatctgtagcaccagcggcggctttcccgagccccacctgtcctggctggagaatggcgaggagctgaacgccatcaataccaccgtgtcgcaggaccccgagacggagctctacgccgtgagctccaagctggacttcaacatgaccacaaatcacagctttatgtgcctgatcaagtacggccacctgagggtaaaccagacgtttaactggaacaccaccaagcaggagcacttccccgatgacaagacccacacctgccctccctgccccgcccccgagttgctcggcggccccagcgtgtttctctttccccccaagcccaaggacaccctgatgatctccaggacccccgaggttacctgcgtcgtggtcgacgtgagccacgaggatcccgaggtcaagttcaactggtacgtagacggcgtggaggtgcataacgccaagacaaagcccagggaggagcaatacaactcgacctacagggttgtaagcgtgctgaccgtcctgcaccaggactggctgaacgggaaggagtacaagtgcaaggtcagcaacaaggccctgccggcccccatcgagaagaccatcagcaaggccaagggccagcccagggagccgcaggtgtataccctgccacccagcagggacgagctgaccaaaaaccaggtgagcctcacctgcttggtgaagggcttctacccctccgatatcgccgtcgaatgggagagcaacggccagcccgagaataactataagaccacacccccggtgctagacagcgacggcagcttcttcctgtactcgaagctgaccgtggacaagagccgttggcagcagggcaacgtgttcagctgctccgtgatgcacgaagccctgcacaatcactacacccagaaaagcctgtccctgagcccgggcaag

SEQ ID NO: 515 - DNA, 1404 bp, Artificial Sequence
  CD80_Fc-CO18
atgggccacactcggcggcagggcaccagcccctcaaagtgtccctaccttaacttcttccagctcctcgtcctagccgggctctcccacttctgctcgggcgtcatccacgtcacgaaggaggtcaaggaggtcgccaccctctcctgcggtcacaacgtctccgtcgaagaactcgcccagaccaggatctactggcaaaaagagaagaagatggtcctcaccatgatgagcggcgacatgaatatctggcccgagtacaagaaccggaccatcttcgacatcaccaacaacctaagcatcgtgatcctggccctgcgcccctcggacgaggggacctacgagtgcgtggtgttaaagtacgagaaggatgcctttaagagggagcacctggctgaggtcaccctcagcgtgaaggccgactttccgacccccagcatctccgacttcgagatacccaccagcaacatcaggaggatcatctgcagcaccagcggaggctttcccgagccccacctgtcgtggctggagaacggggaagaactgaacgccatcaacaccaccgtgagccaggacccggagacggagctctacgccgtgtccagcaagctggactttaacatgacgaccaatcacagcttcatgtgcctgatcaagtacgggcacctgagagtcaaccagaccttcaactggaacaccaccaagcaggagcactttccggatgacaagacccatacctgcccgccctgccccgcgcccgagctgctgggcggccccagcgtgtttctgttcccgcccaagcccaaggataccctgatgatcagccggacccccgaagtgacgtgcgtggtggtggacgtgagccacgaggaccccgaggtgaagtttaactggtacgtggacggcgtggaggtgcataacgccaagaccaagccccgcgaggagcagtacaacagcacctatagggtcgtctccgtgctgaccgtgctgcaccaggattggctgaacggcaaggagtacaagtgcaaggtgtcgaacaaggccctgcccgcgcccatcgagaaaaccatctccaaggccaagggccaacccagggaaccccaggtttacacgctcccgccctcccgcgacgagctcaccaagaaccaagtgagcctgacgtgtctggtcaaggggttttaccccagcgatatcgcggtggagtgggagagcaacggtcagcccgagaacaactacaagaccaccccgccggtgctggacagcgatgggtccttcttcctctacagcaagctgaccgtggacaagagcaggtggcagcagggcaacgtgttcagctgctccgtgatgcacgaggcgctgcacaaccactacacccagaagtccctgagcctgtcgcccggcaag

SEQ ID NO: 516 - DNA, 1404 bp, Artificial Sequence
  CD80_Fc-CO19
atgggtcacacacggaggcaggggaccagccccagcaagtgcccctacctcaacttctttcagctcctcgtcctcgcggggctctcccacttctgcagcggggtcatccacgtgaccaaggaggtaaaggaggtagccacactcagctgcggccacaacgttagcgtcgaggaactcgcgcagacgcggatctattggcagaaggagaagaagatggtcttaaccatgatgagcggcgacatgaacatctggcccgagtacaagaacaggaccatcttcgacatcacaaacaacctctccatcgtgatcctggccctgcgaccctcagatgagggcacctacgagtgtgtggtgctcaagtacgagaaagacgccttcaagagggagcacctggcagaggtgaccctgagcgtcaaggcggacttccccaccccaagcatctccgatttcgaaatccccaccagcaacattcggaggatcatctgcagcactagcggtggcttccccgagccccatctgagctggctggagaacggcgaggagctcaatgccatcaacaccaccgtgagccaggaccccgagacggagctctacgccgtgagctcgaagctggatttcaacatgaccacgaaccacagcttcatgtgcctgatcaaatatggccacctgcgggtgaaccagaccttcaactggaacaccacgaagcaggagcacttccccgacgataagacccatacctgcccgccgtgccccgcccccgagctgctgggcggtccgtccgtcttcctgttcccgcccaagcccaaggacaccctcatgatctccaggacgccggaggtgacctgtgtggtcgtggacgtgagccacgaggaccccgaggtgaagttcaactggtacgtggacggggtggaggtgcataacgccaagaccaagccgcgggaggaacagtacaacagcacctatcgggtggtgtccgtgctcacggtcctgcaccaggattggctgaatggcaaagaatacaagtgcaaagtgagcaacaaggccctgcccgcccccatcgaaaagaccatcagcaaggccaagggccagcccagggagccccaggtgtatacgctgccccccagccgggacgagctcaccaaaaaccaagtctcactgacctgcctggtgaagggcttctacccatccgatatcgccgtggaatgggagtccaatgggcagcccgagaacaactacaagaccaccccaccggtgctcgactccgacggcagcttcttcctctatagcaagctgaccgtggacaagagcaggtggcagcaaggcaacgtgttcagctgctccgtgatgcacgaagccctgcacaaccattacactcagaagtccctgagcctgagccccgggaag

SEQ ID NO: 517 - DNA, 1404 bp, Artificial Sequence
  CD80_Fc-CO20
atggggcacaccaggaggcaggggaccagcccctccaagtgcccctaccttaacttttttcagctactggtgctagccgggctcagccacttctgcagcggcgtcatccacgtgaccaaagaggtcaaggaggtcgccaccctctcctgcggccacaacgtctccgtcgaagaactagcgcagaccaggatatactggcagaaggagaagaagatggtcctcaccatgatgtccggggacatgaacatctggcccgagtacaagaacaggaccatcttcgatataaccaataacctcagcatcgtgatcctggccctgaggcccagcgacgagggcacctatgagtgcgtggtcctgaagtacgagaaggacgccttcaagcgtgagcacctggccgaggtcaccctgagcgtgaaggccgacttccccacccccagcatcagcgacttcgagatccccaccagcaacatccgccgtattatctgcagcaccagcggggggttcccggagccgcacctgagctggctggagaacggcgaggagctgaacgccatcaacactactgtctcccaggatcccgaaaccgaactgtacgccgtgtccagcaagctggactttaacatgaccaccaaccactcgtttatgtgcctgatcaaatacggacacctgcgggtaaaccagaccttcaactggaacaccaccaagcaggagcacttcccggatgacaagacccacacctgcccgccctgcccggctcccgagcttctgggcggccccagcgtgtttctgtttccccccaagcccaaggataccctgatgatctccaggacccccgaggtgacctgcgtggtggtggatgtgtcccacgaggatcccgaggtgaaatttaattggtatgtggacggggtcgaggtgcacaatgccaagaccaagcccagagaggagcagtacaacagcacctacagggtggtgagcgtgctgacggtgctgcatcaggactggctgaacgggaaggagtacaagtgcaaggtgtccaacaaggccctcccggcccccatcgagaagaccatctccaaggccaagggtcagccgcgcgagccccaagtgtacaccctgccccccagccgggacgagctgaccaagaaccaggtgagcctgacctgtctggtgaagggcttctaccccagcgacatcgccgtcgagtgggagagcaacggccagcctgagaacaactacaagaccaccccgcccgtcctggacagcgacggaagcttcttcctatacagcaagctgaccgtagacaagagcaggtggcagcagggcaacgtgttctcatgcagcgtgatgcacgaggccctgcataaccattacacccagaaaagcctctcgctcagccccggcaag

SEQ ID NO: 518 - DNA, 1404 bp, Artificial Sequence
  CD80_Fc-CO21
atgggccataccaggaggcagggcacgagccccagcaagtgcccctacctcaacttcttccagctcctcgtccttgccgggctcagccacttctgtagcggcgttattcacgtaaccaaggaagtaaaagaggtcgccaccctaagctgtggccacaacgtcagcgtcgaggagctcgcccagaccaggatctactggcagaaggagaagaagatggtcctcacaatgatgtcgggcgacatgaatatctggcccgaatacaagaaccggacaatcttcgacatcaccaacaacctcagcatcgtgatcctggccctgaggcccagcgacgaagggacctacgagtgtgtcgtgctcaagtacgaaaaggacgccttcaaaagggagcacctcgcggaggtgacgctgagcgtgaaggccgacttccccaccccatccatcagcgacttcgagattcccacgtccaacatccgtaggatcatttgcagcacctccggcggcttccccgagccccacctcagctggctggagaacggcgaggaactgaacgccatcaacaccaccgtgagccaggatcccgagacggagctgtatgccgtgagcagcaagctggatttcaacatgaccaccaaccattcattcatgtgcctgataaagtacggccacctgagggtgaaccagaccttcaactggaacaccaccaaacaggaacacttcccggacgataagacccatacctgcccgccctgccccgcccccgagctgctgggcggcccctccgtcttcctgttcccgcccaagcctaaggataccctgatgatttccaggacccccgaggtgacctgcgtcgtggtggacgtcagccacgaggatcccgaggtgaagtttaattggtacgtcgacggggttgaggtgcacaacgccaagacgaagcccagggaggagcagtacaacagcacctaccgggtggtgagcgtgctcaccgtgctgcatcaggactggctgaatgggaaagagtacaaatgcaaggtgagcaataaggccctgccggcccccatcgagaagaccatcagcaaagccaagggccagccgagggaaccccaggtgtacacgctcccgccctccagggacgagctgaccaagaatcaggtcagcctcacctgcctcgtgaaggggttttacccctccgatatcgccgtggaatgggagagcaacgggcagcccgagaacaactacaaaacgacgccccccgtcctggactcggacgggagctttttcctgtattctaagctgaccgtggacaaaagccggtggcagcagggcaacgtcttcagctgcagcgtgatgcacgaggccctgcacaaccattacacccagaaaagcctgagcctgtcgcccggcaag

SEQ ID NO: 519 - DNA, 1404 bp, Artificial Sequence
  CD80_Fc-CO22
atggggcacacccgcaggcaagggaccagccctagcaagtgcccctacctcaacttcttccagctcctcgtcctcgccggtctgagccacttctgcagcggcgtcatccacgtcaccaaggaggtcaaggaggtcgccacgctcagctgcggccacaacgtctccgtagaggagttggcccagaccaggatctactggcagaaggagaagaagatggtcttaacgatgatgagcggcgacatgaacatctggcccgagtacaagaaccgcaccatcttcgacattaccaacaacctctccatagtgatcctggccctccggccgagcgatgagggcacctacgaatgcgtggtgctgaagtacgaaaaggacgccttcaaaagggagcacctggcggaggtgaccctgtccgtgaaggccgactttcccacgcccagcattagcgatttcgagatccccacgagcaacatcaggcgcatcatctgcagcaccagcggcgggttccccgagccccacctgtcctggctggagaacggcgaagaactgaacgccatcaacaccaccgtgagccaggatcccgagacggagttgtacgccgtgagcagcaaactggactttaacatgaccaccaaccactcattcatgtgcctcatcaagtacggccacctgcgggtgaaccagaccttcaactggaacacgaccaagcaggagcacttccccgacgacaagacgcatacttgcccgccctgcccagcccctgagctgctgggcggtccttcggtattcctgtttccccccaagcccaaggataccctgatgatcagccggaccccggaggtgacctgcgtcgtggtggacgttagtcacgaagaccccgaggtgaagtttaattggtacgtggacggcgtggaggtccacaacgccaagaccaagccccgtgaggagcagtacaatagcacgtacagggtggtgagcgtgctcaccgtgctccatcaggactggctcaacgggaaggagtacaagtgcaaggtgagcaataaggccctccccgccccgatcgagaagaccatctcgaaggccaaggggcagccccgggaaccccaggtgtacaccctcccgcccagccgggacgaactgaccaagaaccaggtgtccctgacctgcctagtgaagggcttctacccctccgacatcgccgtggagtgggagagcaacggccagcccgagaacaactataagaccaccccgcccgtgctggacagcgatggcagctttttcctgtacagcaaactgaccgtggacaagtccaggtggcagcagggcaacgtgttcagctgcagcgtcatgcacgaggccctgcacaaccactacacccagaaaagcctgtccctcagccccggcaag

SEQ ID NO: 520 - DNA, 1404 bp, Artificial Sequence
  CD80_Fc-CO23
atgggccatacccgcaggcaaggcaccagccccagcaagtgcccctacctcaacttcttccagctcttggtcctcgccgggctcagccacttctgctccggcgtcatacacgtgaccaaggaggtcaaggaggtcgccaccctctcgtgcgggcacaacgtcagcgtcgaggagctcgcccagaccaggatctactggcagaaggagaagaagatggtcctcaccatgatgagcggggacatgaacatctggcccgaatacaagaaccggacgatcttcgacatcacgaacaacctcagcatcgtgatcctcgccctgcggcccagcgacgagggtacctatgagtgcgtcgtgctgaagtacgagaaggacgcgttcaagagggagcatctggcggaagtgaccctgagcgtcaaggcggacttcccgacgccctcgatcagcgacttcgaaattcccacctccaacatccgcaggatcatctgcagcacctccggaggcttccccgagccccacctctcctggctggagaacggcgaggagctgaacgccatcaacaccacggtgtcccaagacccagagacggagctgtatgccgtgtccagcaaactggacttcaacatgaccaccaaccactccttcatgtgcctcatcaaatacggccacctgagggtgaaccagaccttcaattggaacaccaccaaacaggagcacttccccgacgataagacccatacctgtcccccctgccccgcccccgagctgctgggcggccccagcgtgttcctgttcccgcccaagcccaaggacaccctgatgatcagtaggacccccgaggttacctgcgtggtggtggacgtgagccacgaggaccccgaggtcaagttcaactggtatgtggatggcgtcgaggtgcacaacgccaagaccaaaccccgggaggagcaatacaacagcacctatagggtggtgagcgtcctgaccgtgctccaccaggattggctcaatggcaaggagtataagtgtaaggtgtccaacaaggccctgccggcccccatagagaagaccatctccaaggccaagggccagcccagggagccccaggtatacaccctgcccccctcccgggatgagctgacgaagaaccaggtgagcctgacctgcctggtgaaggggttctaccccagcgacatagccgtggaatgggaatccaacggccagcccgaaaacaactacaagaccacgccgcccgtgctggacagcgacggcagcttcttcctgtatagcaagctgaccgtggacaagtcccgctggcagcagggcaacgtcttctcctgctccgtgatgcatgaggccctgcacaatcactacacccaaaagagcctgagcctgagccccggtaag

SEQ ID NO: 521 - DNA, 1404 bp, Artificial Sequence
  CD80_Fc-CO24
atggggcacaccaggcgccaggggacttctcctagcaagtgcccctacctcaacttcttccagctcctcgtcctcgccggcctctcgcatttttgcagcggggtcatccacgtcaccaaggaagtcaaggaggtcgccaccctcagctgcggccacaacgtcagcgtcgaggagctcgctcagacccggatatactggcagaaggagaagaagatggtcctcaccatgatgtcgggcgatatgaacatctggcccgaatataaaaaccggaccatcttcgacatcaccaacaatctctccatcgtgatcctcgccctgcggccctccgatgaaggaacatacgagtgcgtggtcctgaaatacgagaaagacgccttcaagagggagcatctggccgaggtcaccctgtcggtgaaagccgacttcccgacccccagcatctccgacttcgagatccccaccagcaacattaggcggatcatctgcagcaccagcgggggctttcccgaaccgcacctgagctggctggagaacggggaggaactgaacgccatcaacaccaccgtgtcccaagaccccgagacggaactgtacgcggtcagcagcaagctggacttcaatatgaccaccaaccactcgttcatgtgcctgatcaagtacggccacctcagggttaaccagaccttcaactggaacaccaccaagcaggagcacttccccgacgataagacccacacgtgccccccgtgccccgccccggagctgctgggcggccccagcgtgttcctgttccctcccaagcccaaggataccctgatgatcagcaggacacccgaggtgacctgcgtggtggtagacgtgtcccacgaggacccggaagtgaagttcaactggtacgtggacggcgtagaggtgcacaacgccaaaacgaagccccgcgaagaacagtacaacagcacctacagggtggtgagcgtgctgaccgtgctgcaccaagactggctgaacgggaaggagtacaagtgtaaggtgagcaataaggccctgcccgcccccatcgagaagaccatcagcaaggcgaaggggcagcccagggagccgcaggtgtacaccctgcccccctccagggacgagttgacgaagaatcaggtgtccctgacgtgcctggtgaagggcttctaccccagcgacatcgccgtggagtgggagagcaacgggcagcccgagaacaattacaagaccaccccacccgtgctggattccgacggcagcttttttctgtactccaagctgaccgtggacaaatcccgctggcagcaggggaacgtgttctcgtgcagcgtgatgcacgaggccctgcacaaccactacactcagaaaagcttgagcctgagccccgggaaa

SEQ ID NO: 522 - DNA, 1404 bp, Artificial Sequence
  CD80_Fc-CO25
atgggccatacccggcgtcaagggacctccccgagcaagtgtccctacctcaacttcttccagctcctagtcctcgccggcctctcccacttctgctccggcgtaatccacgttacgaaggaggtcaaagaggtcgcgaccctcagctgtggccataacgtctccgtagaggagttggcgcagacaaggatctattggcagaaggagaagaagatggtccttaccatgatgagcggcgacatgaacatctggccggagtacaagaatcggaccatcttcgacatcactaacaatcttagcatagtgatcctcgccctgaggcccagcgatgaggggacctacgaatgcgtggtgcttaagtacgagaaggacgccttcaagagggagcacctcgccgaggtgacactgagcgtgaaagccgacttccccaccccgagcatcagcgacttcgagatccccaccagcaacatcaggaggatcatctgtagcaccagcggaggctttcccgagccccacctcagctggctggagaacggggaggagctcaatgctatcaataccaccgtgagccaggaccccgaaacggagctctacgccgtctcctcgaagctggacttcaacatgaccaccaaccacagcttcatgtgcctgatcaagtacgggcacctgcgggtgaaccagaccttcaactggaacaccacaaagcaggagcattttccagacgacaaaacccacacgtgccccccgtgccccgcgcccgagctcctggggggacccagcgtgttcctgtttccccccaagcccaaagacaccctgatgatcagcaggaccccggaggtgacctgtgtcgtggtggacgtgagccacgaggaccccgaggtgaagttcaattggtacgtggacggcgtggaggtgcacaacgccaagaccaagccccgcgaggagcagtacaacagcacctaccgggtggtgagcgtgctgaccgtcctgcaccaggactggctgaacgggaaggagtacaagtgcaaggtgagcaacaaggccctccccgccccgatcgagaaaacaatcagcaaggccaaggggcaaccccgggaaccccaggtctacaccctgccccccagccgcgacgagctgaccaagaaccaagtgagcctgacctgcctggtgaaggggttctacccgagcgatatcgccgtggagtgggagagcaacggtcagcccgagaacaactacaagaccaccccgcccgtgctcgacagcgacggtagcttcttcctgtacagcaagctgaccgtcgataagagcaggtggcagcaaggcaacgtgttctcctgcagcgtgatgcacgaggccctccacaaccactacacccagaaaagcctgtcgctttcccccggcaag

SEQ ID NO: 523 - protein, 839 aa, Artificial Sequence
  TLR4, Toll-like receptor 4, isoform 1 (wtTLR4)
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 524 - DNA, 2520 bp, Artificial Sequence
  Nucleotide sequence of wt TLR4, isoform 1
atgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctga

SEQ ID NO: 525 - protein, 251 aa, Artificial Sequence
  Constitutively active TLR4 (caTLR4) construct, protein sequence
MAAPGSARRPLLLLLLLLLLGLMHCASAAMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 526 - DNA, 753 bp, Artificial Sequence
  Constitutively active TLR4 (caTLR4) construct, nucleic acid sequence
atggcggcccccggcagcgcccggcgacccctgctgctgctactgctgttgctgctgctcggcctcatgcattgtgcgtcagcagcaatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatc

SEQ ID NO: 527 - protein, 4 aa, Artificial Sequence
  amino acids of the EC domain
MPVL

SEQ ID NO: 528 - protein, 5 aa, Artificial Sequence
  amino acids of the EC domain
MPVLS

SEQ ID NO: 529 - protein, 6 aa, Artificial Sequence
  amino acids of the EC domain
MPVLSL

SEQ ID NO: 530 - protein, 7 aa, Artificial Sequence
  amino acids of the EC domain
MPVLSLN

SEQ ID NO: 531 - protein, 7 aa, Artificial Sequence
  amino acids of the EC domain
MPVLSLN

SEQ ID NO: 532 - protein, 8 aa, Artificial Sequence
  amino acids of the EC domain
MPVLSLNI

SEQ ID NO: 533 - protein, 9 aa, Artificial Sequence
  amino acids of the EC domain
MPVLSLNIT

SEQ ID NO: 534 - protein, 10 aa, Artificial Sequence
  amino acids of the EC domain
MPVLSLNITC

SEQ ID NO: 535 - protein, 11 aa, Artificial Sequence
  amino acids of the EC domain
MPVLSLNITCQ

SEQ ID NO: 536 - protein, 12 aa, Artificial Sequence
  amino acids of the EC domain
MPVLSLNITCQM

SEQ ID NO: 537 - protein, 13 aa, Artificial Sequence
  amino acids of the EC domain
MPVLSLNITCQMN

SEQ ID NO: 538 - protein, 14 aa, Artificial Sequence
  amino acids of the EC domain
MPVLSLNITCQMNK

SEQ ID NO: 539 - DNA, 753 bp, Artificial Sequence
  TLR4ca-CO01
atggccgcccccggttccgcccggcgcccactcttgctcctcctcctcctgctcctactcggcctcatgcactgcgccagcgccgccatgcccgtactcagcctcaacataacctgccagatgaataagaccatcatcggcgtgagcgtcctcagcgttctcgtcgtctccgtcgtagcagtactcgtttacaagttctacttccacctcatgctcctcgccgggtgtatcaagtacggccgcggggaaaacatctacgacgccttcgtcatctatagcagccaggacgaggactgggtccggaatgagctggtgaagaacctggaggaaggcgtcccgcccttccagctgtgtctgcactaccgggatttcatccccggggtggcgatcgccgcgaacatcatccacgagggattccacaagtcccggaaggtgatcgtggtcgtgagccagcacttcatccaaagccggtggtgcatcttcgagtacgagatcgcccagacctggcagtttctgtcctccagggcgggaatcatcttcatagtgctgcagaaggtggaaaaaaccctcctgcggcagcaggtggagctgtacaggctgttgagcaggaacacctatctggagtgggaggacagcgtgctgggacgccacatcttctggaggcggctgcggaaagctctgctggacgggaagtcttggaacccggaggggacggtgggcaccggttgcaactggcaggaggccacctccatc

SEQ ID NO: 540 - DNA, 753 bp, Artificial Sequence
  TLR4ca-CO02
atggccgccccaggctccgccaggcggccgctcctcctcctccttctactcctcctcctcggcttgatgcactgcgccagcgccgcgatgcccgttctcagcctcaacatcacgtgccagatgaacaagaccatcatcggagtctccgtcctcagcgttctcgtcgtcagcgtcgtagccgtcctcgtctacaagttctatttccacctcatgctcctggccgggtgcatcaagtacgggcgcggcgagaacatctacgacgccttcgtcatatactccagccaggacgaggactgggtcaggaacgagctggtgaagaacctcgaggagggggtcccgccctttcagctgtgcctgcactaccgggacttcatccccggcgtggccatcgccgccaacatcatccacgaggggttccacaagagcaggaaggtgatagtggtggtgagccagcacttcattcagagccggtggtgcatcttcgagtatgagatcgcccagacctggcaattcctgtcctcccgggcaggcatcatcttcatcgtgctgcagaaggtggagaagaccctgctgaggcagcaggtggagctgtacaggctgctgagcaggaacacttacctggaatgggaggacagcgtgctgggcaggcatatcttctggaggaggctgcggaaggccctgctggacggcaagagctggaaccccgagggcaccgtggggaccggctgtaactggcaggaagccacgagcatc

SEQ ID NO: 541 - DNA, 753 bp, Artificial Sequence
  TLR4ca-CO03
atggccgcccccggcagcgccaggcggcccctcctactcctccttttgctcctcctcctcgggctcatgcactgcgcgtccgccgccatgccggtcctcagcctcaacatcacctgccagatgaacaagacgatcatcggcgtctccgtcctctccgtcctcgtcgtctccgtagttgccgtcttggtctacaaattctacttccatcttatgctccttgccgggtgtataaagtacggcaggggggagaacatctacgacgccttcgtcatctacagcagccaggacgaagactgggttcggaacgagctggtgaagaacctggaggagggcgtgccccccttccagctgtgtctgcattaccgggacttcatcccgggggtggccatagccgccaacatcatccatgagggcttccacaagtcccggaaggtgatcgtggtggtgagccagcacttcattcaatccaggtggtgcatcttcgagtacgagatcgcgcagacctggcagttcctgagctcccgcgccgggatcatcttcatcgtcctccagaaagtggagaagacgctgctgcggcagcaggtggaactgtaccgtctgctctcccggaacacctacctggagtgggaggatagcgtcctgggccggcacatcttctggcggcggctccggaaggcgctgctcgacgggaaaagctggaacccggagggcaccgtgggcactggctgcaattggcaggaagcaacgtccatc

SEQ ID NO: 542 - DNA, 753 bp, Artificial Sequence
  TLR4ca-CO04
atggccgcccccgggtccgcgaggcggcccctactcctcctccttctccttcttctactcggcctcatgcattgcgccagcgccgccatgcccgtcctcagcctcaacatcacctgccagatgaacaagaccatcatcggggtgagcgtcctcagcgtcctcgtcgtcagcgtcgtcgcggtcctcgtatataagttctactttcatctcatgctcctcgccggctgcatcaagtacggcaggggcgagaacatctacgacgccttcgtcatctactccagccaagacgaggattgggttaggaacgagctggtgaagaacctggaggagggcgtgccccccttccagctctgcctccactaccgggactttatccccggtgtggcgatcgccgcgaacatcatccacgagggcttccacaagagcaggaaagtgatcgtggtggtgtcccagcacttcatccagtcccggtggtgcatcttcgagtacgagatcgcccaaacctggcagttcctaagctccagggccggcatcatcttcattgtgctccagaaggtggagaagaccctgctgaggcagcaggtggaactgtaccgcctgctgagcaggaacacctacctggagtgggaggatagcgtcctggggcggcacatcttctggaggcgcctgaggaaggcgctgctggacggcaagtcctggaaccccgaaggcaccgtcgggacgggctgcaattggcaggaggccacctccatc

SEQ ID NO: 543 - DNA, 753 bp, Artificial Sequence
  TLR4ca-CO05
atggccgcccccggcagcgccagacgacccctcctcctcttgctcctccttctcctcttgggcctcatgcactgcgccagcgccgcgatgccggtcctctcccttaacatcacctgccagatgaacaagacaatcatcggggtatccgtcctttccgtccttgtcgtcagcgtcgtcgccgtactcgtttacaagttctacttccaccttatgctcttggccgggtgcatcaaatacggccgcggcgagaatatatacgacgcgttcgtgatctacagctcacaggacgaggactgggtccgcaacgagctggtgaagaacctggaggagggggtgccccccttccagctgtgtctgcactacagggacttcatccccggcgtggccatcgccgccaacatcatccacgaggggttccacaagagcagaaaggtgatcgtggtggtcagccagcacttcatccagtccaggtggtgcatcttcgagtatgagatcgcccagacctggcagtttctgtcctccagggccgggatcatcttcatcgtgctgcagaaggtggagaagaccctgctcaggcagcaggtggagctctacaggctgctgagcaggaatacctacctggaatgggaggacagcgtgctgggtcgccacatcttctggaggcgcctgcggaaggccctgctggatggcaagagctggaaccccgaagggaccgtgggtaccggctgcaactggcaggaggccaccagcata

SEQ ID NO: 544 - DNA, 753 bp, Artificial Sequence
  TLR4ca-CO06
atggccgccccgggcagcgcccgcaggcccctcctcctcttgctcctcctcctcctcctcggattgatgcactgcgccagcgccgcgatgcccgtcctctccctcaacatcacgtgccagatgaacaagaccattatcggcgtttccgtcctcagcgtcctcgtcgtcagcgtcgtagccgtcttggtttacaagttctactttcacttgatgctcctcgccggctgtatcaagtacggccggggcgagaacatatacgacgccttcgtcatctacagcagccaggacgaggactgggtccgcaacgagctggtgaagaacctggaggagggcgtgcccccttttcagctgtgcctccattaccgggacttcattcccggcgtggccatcgccgccaacatcatccacgaaggcttccacaagtccaggaaggtgatcgtggtggtgagccagcacttcatccagagcaggtggtgcatcttcgagtacgagatcgcccagacctggcagttcctgagcagccgggccggcatcatcttcatcgtgctccagaaggtcgagaagaccctcctgaggcagcaggtggagctgtacaggctccttagccggaacacgtacctggagtgggaagactccgtgctgggccggcacatcttctggaggcgactgaggaaggccctgctcgacggcaagtcctggaaccccgagggcaccgtgggcaccggctgcaactggcaggaggccaccagcatc

SEQ ID NO: 545 - DNA, 753 bp, Artificial Sequence
  TLR4ca-CO07
atggccgccccggggagcgcccgccggcccctcctcctccttctccttctcctcctcctagggctcatgcattgcgccagcgccgcaatgcccgtactcagcctcaacatcacctgccagatgaacaagacgatcatcggcgttagcgtactcagcgttctcgtcgtcagcgtcgtcgcggtcctcgtctacaaattctacttccacctcatgctcctagccggctgcatcaaatacggcaggggagagaacatctacgacgccttcgtaatctacagcagccaggacgaggactgggtccgcaacgagctggtgaagaacctggaggagggcgtgccccccttccagctgtgcctccactacagggacttcatcccaggtgtggcgatcgccgccaacataatccacgagggcttccacaagtccaggaaggtgatcgtggtggtgagccagcactttatccagagcaggtggtgtatcttcgagtacgagatcgcccagacctggcagttcctcagcagtcgcgccggcatcatcttcatcgtgctccagaaggtggagaagaccctgctgcggcagcaggtggagctctaccggctgctgtcgcgcaacacctacctcgagtgggaggacagcgtgctggggcgacatatcttttggcgaaggctgaggaaggccctgctggacggcaagagctggaacccggagggcaccgtgggcaccggatgtaactggcaagaggccaccagcatc

SEQ ID NO: 546 - DNA, 753 bp, Artificial Sequence
  TLR4ca-CO08
atggccgcccccggcagcgccaggcggcccctcctcctcttgctactcctactcctcctcggccttatgcattgcgcctccgccgccatgcccgtcctcagccttaacatcacctgccagatgaacaagaccataatcggcgtctccgtcctctcggtcctagtcgtcagcgtcgtagccgtccttgtctacaagttctacttccaccttatgttgctcgccggctgcatcaagtacggcaggggcgagaatatctacgacgccttcgtaatctatagctcgcaagacgaggactgggttaggaacgagctggtgaagaatctggaggagggggtgcccccatttcagctgtgcctgcattacagggacttcatccccggcgtggccatcgccgccaatatcatccacgaaggcttccacaagtcccggaaggtgatcgtggtggtgtcgcagcactttatccagagcaggtggtgcatcttcgagtacgagatcgcccagacctggcagttcctgagcagccgcgccgggataattttcatcgtgctgcagaaggtggaaaagacgctgctcaggcagcaggtggagctctaccggctgctgagcaggaacacctacctggaatgggaggactccgtgctgggccgccacatcttctggcggaggctgcggaaggccctgctggatggcaagagctggaaccccgagggcaccgtgggcaccggctgcaattggcaggaggcgaccagcatc

SEQ ID NO: 547 - DNA, 753 bp, Artificial Sequence
  TLR4ca-CO09
atggccgcccccggctccgcccggcggcccctcctcctcctcttactcctcctcctcctcggactcatgcactgcgccagcgccgccatgcccgtcctctccttaaacatcacctgccagatgaacaagaccatcatcggcgtcagcgtcctcagcgtactcgtagtcagcgtcgtagcggtcctcgtctacaagttctacttccacctcatgttacttgccggctgcatcaagtacggcaggggcgagaacatctacgacgcgttcgtcatctatagcagccaagacgaggactgggtccgcaatgagctggtcaagaacctcgaagagggggtgccccccttccagctgtgcctgcactacagggacttcatccccggggtcgccatagcggccaacatcatacacgaaggctttcacaagagccggaaggtgatcgtggtggtgtcccagcacttcatccagtcccggtggtgcatcttcgagtacgagatcgcgcagacctggcagttcctgagcagcagagccggcatcatctttatcgtgctgcagaaggtggagaagaccctgctgcgccagcaggtggagctgtacaggctgctgagcaggaacacctacctcgagtgggaggactccgtgctgggccgacacatcttctggcggcgcctgcgcaaggccctgctggacgggaaaagctggaaccccgagggcaccgtgggcaccgggtgcaactggcaggaagcgaccagcatc

SEQ ID NO: 548 - DNA, 753 bp, Artificial Sequence
  TLR4ca-CO10
atggccgccccggggagcgccaggaggcccctactcctcctcctcctccttcttctactcggcttaatgcattgcgccagcgccgccatgcccgtccttagccttaacatcacttgtcagatgaacaagaccatcatcggggtcagcgtcctcagcgtcctcgtcgtatcggtagtcgccgtcctcgtctacaagttctatttccacctcatgctcctcgccggctgcatcaaatacgggaggggggagaacatctacgacgccttcgttatctacagcagccaggacgaggactgggtccggaacgaactggtgaaaaacctggaagagggggtgccccccttccagctgtgtctgcactacagggacttcatccccggtgtggccatcgcggccaacatcatccacgaggggttccacaaaagcaggaaggtgatcgtggtggtgagccagcacttcatccagagcaggtggtgcatcttcgagtacgagatcgcccagacctggcagttcctgtcgagcagggcggggatcatcttcatcgtgctccagaaggtggagaagaccctgctgcgacagcaggtcgagctgtaccggctgctgagcaggaacacctatctggagtgggaagacagcgtgctgggccgccatatcttctggaggcgcctgaggaaggccctgctggacggcaagagctggaatcccgagggcaccgtgggcacggggtgcaactggcaggaggccaccagcatc

SEQ ID NO: 549 - DNA, 753 bp, Artificial Sequence
  TLR4ca-CO11
atggcggcccccggctccgccaggcgccccctcctcctcctactcctcctcctcctcctcggcctaatgcactgcgccagcgccgctatgcccgtcctcagcctcaatatcacttgtcagatgaacaagaccatcatcggcgtcagcgtcctctcagtcctcgtagtcagcgtcgtcgccgttctcgtctacaagttctacttccatctcatgcttttggcgggctgcatcaagtacggccgaggggagaatatctacgacgcgttcgtgatctactccagccaggacgaggactgggtcaggaacgagctggtgaagaatctggaggagggggtgccccccttccagctgtgcctgcattaccgggacttcattcccggtgtggccatcgccgccaatatcatccacgagggcttccacaagtccaggaaggtgatcgtggtcgtgtcccagcacttcatccaaagccggtggtgcatcttcgagtacgagattgcgcagacctggcaattcctcagctccagggccggcatcatattcattgtgctgcaaaaagtggagaagacgctgctgcggcagcaagtggagctgtaccgcctgctgagcaggaacacctacctcgagtgggaggattccgtgctcggcaggcacatcttctggaggaggctccgcaaggccctgctggacggcaaaagctggaaccccgaggggacagtgggcacaggctgcaactggcaggaggcgaccagcatc

SEQ ID NO: 550 - DNA, 753 bp, Artificial Sequence
  TLR4ca-CO12
atggccgcccccggcagcgcccggcggcctctcctcctcctcctcttgctcctcctcctcggcctcatgcactgcgccagcgcagccatgcccgtactcagcttgaacatcacgtgccagatgaacaaaaccatcatcggcgtcagcgtactctcagtgctcgtcgtcagcgtcgtcgccgtactcgtatacaagttctactttcacttaatgctactcgccggctgcatcaagtacggccgcggcgaaaacatctacgacgccttcgtcatctactccagtcaggacgaggactgggtcaggaacgagctggtgaagaacctggaggagggcgtgccccccttccagctgtgcctgcattaccgggatttcatcccgggggtggccattgccgcgaacatcatccacgagggctttcacaagagcaggaaagtgatcgtggttgtgagccagcactttatccagtccaggtggtgcatctttgagtacgagatcgcccagacctggcagttcctgagcagcagggccggcatcatctttatagtgctgcagaaagttgagaagaccctgctgaggcagcaggtcgagctgtacaggctgctctccaggaacacctacctggagtgggaggactccgtgctcggacgccacatcttttggaggaggctgaggaaggccctcctggacgggaaaagctggaacccggagggcacggtgggaaccgggtgcaactggcaggaggccaccagcatc

SEQ ID NO: 551 - DNA, 753 bp, Artificial Sequence
  TLR4ca-CO13
atggccgcccccgggtccgccaggcggcccctcctactcctcctcttgctcctcctactcgggctaatgcattgcgcctccgccgccatgcccgtattgagcctcaacatcacctgccagatgaacaagacgatcatcggcgttagcgtcctcagcgttctcgtagtctccgtagtcgccgtcctcgtctacaagttctattttcatttgatgctcctggccggctgcatcaaatacggcaggggcgaaaacatctacgacgccttcgtgatctactccagccaggacgaggactgggtccgcaatgagctggtgaagaacctggaggagggggtgccccccttccagctctgcctgcactaccgtgactttatccccggcgtggccatcgcggccaacatcatacacgagggatttcacaagtcccgcaaggtcatcgtggtggtgagccaacacttcatccagtcgcggtggtgcatttttgagtacgagatcgcccaaacctggcaattcctgagctccagggccgggatcatcttcatcgtgctgcagaaggtcgagaagaccttgctgaggcagcaggtggagctctacaggctgctctcgaggaacacctacctggagtgggaggacagcgtcctggggcggcacatcttctggaggaggctgaggaaggccctgctggacggcaagagctggaaccccgagggcaccgtcggcaccgggtgtaactggcaggaggccaccagcatc

SEQ ID NO: 552 - DNA, 753 bp, Artificial Sequence
  TLR4ca-CO14
atggccgcccccgggagcgcccgtcgccccctcctcttgctactcctcctcttgctcctgggcctcatgcattgcgcgtccgcggccatgcccgtcctcagcctcaacatcacctgccagatgaacaaaacgatcatcggagtaagcgtcctcagcgtcctcgtcgtttccgtcgtggccgtactcgtctacaaattctactttcaccttatgttactcgccgggtgcatcaagtacggaaggggcgagaacatctacgacgccttcgtcatctacagctcccaggacgaggactgggtccgcaacgagctggtgaagaacctggaagagggcgtgccgccctttcagctgtgcttgcactaccgggacttcatacctggcgtggcaatcgccgccaatataatccacgagggcttccacaaaagccggaaggtgatcgtggtggtgagccagcactttatccagtcccggtggtgcattttcgagtacgagatcgcgcagacatggcagttcctgagcagcagggccggcatcatcttcatcgtgctgcagaaggtcgagaagacgctgctgcggcagcaggtggagctgtaccggctgctgagccggaacacctacctggagtgggaggatagcgtgctcgggcggcacatcttctggcggcgtctgaggaaggccctcctcgacggcaagagctggaacccggagggcacggtgggcacagggtgcaactggcaagaggccacgtccata

SEQ ID NO: 553 - DNA, 753 bp, Artificial Sequence
  TLR4ca-CO15
atggccgcccccggatccgccaggcggccgttactactcctactcctcctcctactcctcggcctaatgcattgcgcgagcgccgctatgcccgtcctcagcctcaacataacgtgtcagatgaacaagacgatcatcggggtcagcgtcctctccgtcctcgtcgtctccgtcgtcgccgttctcgtctacaagttctacttccacctcatgctcctcgccggctgcatcaagtacggcaggggcgagaacatctacgacgctttcgtcatctacagcagccaggacgaggactgggtccggaacgagctggtgaagaacctggaggagggcgtcccgcccttccagctgtgcctccactatcgggacttcatccccggcgtggccatcgccgccaacatcatccacgagggctttcacaagagccgaaaggtgatcgtggtggtgtcccaacactttatacagagccggtggtgcatcttcgagtacgagatcgcccagacctggcagttcctgtccagccgcgcagggatcatcttcatcgtcctgcagaaggtggagaaaaccctgctgcggcagcaggtggagctgtacaggctgctgtcccggaacacctacctggagtgggaggatagcgtgctggggaggcacatcttttggaggaggctgaggaaggccctgctggacggcaaaagctggaaccccgaggggaccgtgggaaccggctgcaactggcaagaggccaccagcatc

SEQ ID NO: 554 - DNA, 753 bp, Artificial Sequence
  TLR4ca-CO16
atggccgcccccggctccgcccggcgccccctcctcctcctcttgctcctcctactccttggcctcatgcactgcgccagcgcggccatgccggtcctctccttgaacataacctgccagatgaataagaccatcatcggcgtcagcgtcctcagcgtcctcgtcgtcagcgtcgtggcggtcctcgtttacaaattctacttccacctcatgttattggccggctgcataaagtacgggaggggcgagaacatatacgacgccttcgtcatctacagctcccaggacgaggactgggtcaggaacgagctggtgaaaaacctggaggagggtgtgccaccgttccagctgtgcctgcactaccgggacttcatacccggcgtggccatcgccgccaatatcatccatgagggcttccacaagtccaggaaggtgatcgtggtggtgagccaacacttcatccagtcccggtggtgtatcttcgagtacgagatcgcccagacctggcagttcctgtccagccgggccggcatcatcttcatcgtgctgcagaaggtcgagaagaccctgctgcgacagcaggtggagctgtatcgcctgctcagcaggaatacatacctggagtgggaggacagtgtgctgggccggcacatcttctggagaaggctcaggaaggccctgctggacggcaaatcgtggaaccccgagggcaccgtgggcactggttgtaactggcaggaggccacctccatc

SEQ ID NO: 555 - DNA, 753 bp, Artificial Sequence
  TLR4ca-CO17
atggccgcccccggcagcgccaggcgccccctccttctcctcctcctattgctcttgttgggcctcatgcactgcgccagcgccgcgatgcccgtcctctccttgaacatcacctgccagatgaacaagaccatcatcggggtcagcgtcctttccgtcctcgtcgtttccgttgtcgccgtcctggtgtacaagttctacttccatttgatgctactcgccggctgcatcaagtacggcaggggagagaacatctacgacgccttcgtgatctacagctcgcaggacgaggactgggtcaggaacgagctggtgaagaacctggaggagggggtgccccccttccagctgtgtctacattacagggacttcattccgggcgtcgccatcgccgccaacatcatccacgaaggcttccacaagagccgaaaggtgatcgtggtggtgtcccagcatttcatacaatcgcgctggtgcatatttgagtacgagattgcccagacctggcagttcctaagcagccgggcggggatcatctttatcgtgctgcagaaggtcgagaagaccctactgagacagcaggtggagctgtaccggctgctctcgaggaacacctacctggagtgggaggacagcgtgctggggcggcacatcttctggaggcggctgaggaaggccctgctggatgggaaaagctggaaccccgagggcacagtggggaccggctgcaactggcaggaggcgacgagcatc

SEQ ID NO: 556 - DNA, 753 bp, Artificial Sequence
  TLR4ca-CO18
atggcggccccgggcagcgccaggaggcccctcctcctcctcctcctcttattgctcttgggcctcatgcactgcgccagcgccgccatgccggtcctcagcctaaatatcacctgccagatgaataagaccatcatcggggtcagcgtccttagcgtcctcgtagtcagcgtcgtagcggtccttgtctacaagttttactttcacctcatgctcttagccggctgcatcaagtacggccggggggagaacatctacgacgccttcgttatctactccagccaagacgaggattgggttcgtaacgagctggtgaagaacctggaggagggcgtgccccccttccagctgtgcctgcactaccgggactttatccccggcgtggccatcgccgccaacatcatccatgagggcttccacaaaagccgcaaggtgatagtggtggtgagccagcactttatccagtccaggtggtgtatcttcgagtacgagatcgcccagacctggcagttcctgagctccagggccggaatcatcttcattgtgctgcagaaggtggagaaaaccctcctccgccaacaggtcgagctgtacaggctgctgtcccgcaatacctatctggagtgggaagacagcgtcctcgggcggcacatcttctggcgccgcctgcggaaggccctgctggatggcaagagctggaaccccgaaggaaccgtcggcacgggttgcaactggcaagaggccacctccatc

SEQ ID NO: 557 - DNA, 753 bp, Artificial Sequence
  TLR4ca-CO19
atggccgcccccgggtccgcgaggcggccactcctcctcctcttgctcctcctccttctcggcctcatgcactgtgcgagcgccgccatgccggtcctcagccttaacatcacctgccagatgaacaagaccataatcggggtcagcgtcctctccgttctcgtcgtctcggtagtcgccgtcttagtctacaagttctatttccacctcatgcttctcgcgggctgcatcaagtacggcaggggggagaacatctacgacgccttcgtcatctactccagccaggacgaggactgggtccggaacgaactggtgaagaacctggaggagggcgtgccccccttccagctgtgcctgcactaccgggacttcatccccggagtggccatcgccgccaacatcatccatgagggatttcacaagtcccggaaagtgatcgtggtggtgagccagcacttcatccagagcaggtggtgcatctttgagtatgagatcgctcagacctggcagttcctgtcctcccgggccggaataattttcatcgttctgcagaaggtggaaaagaccctgctgagacagcaggtggagctctacaggctgctcagcaggaacacctacctggagtgggaggactccgtactggggcggcacatcttctggcggcgcctgaggaaggcccttctcgacggcaagagctggaaccccgagggtaccgtcggcaccggatgcaactggcaggaggccaccagtatc

SEQ ID NO: 558 - DNA, 753 bp, Artificial Sequence
  TLR4ca-CO20
atggccgcccccggcagcgcgcggcgtcccctcctcctcctcctcctactcctcctcctcgggctcatgcattgcgcctccgccgccatgccggtcctcagcctcaacatcacctgccagatgaacaagaccatcatcggcgttagcgtcctcagcgtcctggtggtgtccgtcgtcgccgttctcgtctacaagttctactttcacctcatgctcctcgccgggtgcatcaagtacggcaggggcgaaaacatctacgacgccttcgtcatctactccagccaggacgaggactgggtccgtaacgagctcgtaaagaacctggaggagggcgtgcctcccttccagctgtgcctgcactacagggacttcatcccaggggtggccatcgccgccaacattatccacgagggcttccacaagagcaggaaagtgatcgtggtggtgagccagcacttcatccagtcccggtggtgcatcttcgaatatgagatcgcccagacctggcagtttctgtcctcccgggccggcatcattttcatcgtgcttcagaaggtcgaaaagaccctgctgaggcaacaggtggaactctataggctcctgagccgtaacacctacctcgaatgggaggacagcgtgctgggccgccacatcttctggaggaggctgaggaaggccctgctggacggcaagagctggaaccccgagggcaccgtgggtaccgggtgcaactggcaggaggccaccagcata

SEQ ID NO: 559 - DNA, 753 bp, Artificial Sequence
  TLR4ca-CO21
atggccgcgccgggctccgccaggaggcccctcctcctactcctcttgctcctactcctcggcctcatgcactgcgcgtccgcggcgatgcccgtcctcagcctcaacattacctgccaaatgaacaaaaccatcataggcgtcagcgtcctctccgtcctcgtagtcagcgtcgtcgccgttctcgtctacaagttctacttccacttgatgctactcgccggctgtataaagtacggccggggggagaacatctacgacgccttcgtcatctacagctcgcaggacgaggactgggtccggaacgagctggtgaaaaacctggaagagggcgttcccccattccagctgtgcctgcactaccgggactttatcccgggggtggccatcgccgccaatatcatccatgagggcttccacaagagccggaaggtgatcgtcgtcgtcagccaacacttcatccagtccaggtggtgcatcttcgagtacgagatcgcccagacctggcagttcctgtcctcccgcgccggcatcatcttcatcgtgctgcagaaggtcgagaagaccctgctgcggcagcaggtggagctgtatcgcctgctctcccgaaacacttacctcgagtgggaggatagcgtgctcggccggcacatcttctggaggaggctgaggaaggctctcctggacggcaagagctggaaccccgagggaaccgtgggcaccgggtgcaactggcaagaggccaccagcatc

SEQ ID NO: 560 - DNA, 753 bp, Artificial Sequence
  TLR4ca-CO22
atggccgcccccggcagcgcccggaggcccctcctcctcctccttctcctactcttgctcgggctcatgcattgcgcctccgccgccatgcccgtattgtccctcaacatcacgtgccagatgaacaagactatcatcggcgttagcgtactcagcgtcctcgttgtcagcgtcgtcgccgtactcgtctataagttttacttccaccttatgctcctcgccggctgcatcaagtacggcaggggcgagaacatctacgacgccttcgtgatctacagcagccaggacgaggactgggttaggaacgagctggtgaagaacctggaggagggcgtgcccccctttcagctgtgcctccactatagggacttcatccccggggtggccatcgccgccaacatcatacatgaggggttccacaagagcaggaaggtgatcgtggtggtcagccagcacttcatccagagcagatggtgcatattcgagtacgagatcgcccagacctggcagttcctgagcagcagggccggcatcatcttcattgtgctgcagaaggtagaaaagacgctgctcaggcagcaagtggagctgtaccggctcctgagcaggaacacctacctggagtgggaggacagcgtgctgggccggcacatcttctggcgacggctgaggaaggccctgctggacggcaagtcctggaaccccgagggcaccgtggggaccggctgtaactggcaggaggctactagcatc

SEQ ID NO: 561 - DNA, 753 bp, Artificial Sequence
  TLR4ca-CO23
atggcggcccccggcagcgcgcgccggcccctcctcctcttgttactcttgttgctcctcggtctaatgcactgcgccagcgccgccatgcccgtcctcagccttaacatcacgtgccaaatgaacaagactatcatcggggtcagcgtcctctccgtacttgtagttagcgttgtcgccgtcttagtctacaagttctacttccacctcatgctcctggccggctgcataaagtacggtaggggcgagaatatatacgacgccttcgtgatctactccagccaggacgaggactgggtcaggaacgagttagtgaaaaacctggaggagggggtgccccccttccagctgtgcctgcactaccgggacttcatcccgggcgtggccatcgccgccaacatcatccacgagggcttccacaaaagccggaaggtgatagtggtggtgagccagcacttcatccagtccaggtggtgcatattcgagtacgagatcgcccagacctggcagttcctgtccagtagggccggcatcatcttcattgtgctccagaaggtggagaagaccctgctgcggcagcaggtcgagctgtaccggctgctgtcccgcaacacctacctggaatgggaagacagcgtgctgggccggcacatcttctggaggcggctgaggaaggccctgctggacggcaagtcatggaaccccgagggcaccgtgggcaccggctgcaactggcaggaggccaccagcatc

SEQ ID NO: 562 - DNA, 753 bp, Artificial Sequence
  TLR4ca-CO24
atggccgcccccggcagcgcccgccgtccactcttgctcctcctccttctcctcctccttgggctcatgcattgtgccagcgcggccatgccagtcctcagcctcaatatcacctgtcagatgaacaagacgatcatcggcgtcagcgtccttagcgtactcgtcgtctcagtggtcgccgtccttgtctataagttttatttccacctcatgctactcgccggctgtatcaagtacggccggggcgagaacatctacgacgccttcgtcatctacagctctcaggacgaggactgggtaaggaatgagctggtgaagaacctggaggaaggggtgccacccttccagctgtgcctgcactaccgggacttcatccccggggtggccatcgccgccaacatcatccacgaagggttccacaagagcaggaaggtgatagtggtggtcagccagcacttcatccaaagcaggtggtgcatcttcgagtacgagatcgcccagacctggcagttccttagcagcagggccgggatcatcttcatcgtgctgcagaaggtggagaagacgctcctgaggcagcaagtggagctgtacaggctgctgtcaaggaacacctacctggagtgggaggacagcgtgctgggcaggcacatcttttggcggagactgaggaaggccctcctggacggcaagtcctggaacccggaggggaccgtggggacgggctgcaactggcaggaggccacctccata

SEQ ID NO: 563 - DNA, 753 bp, Artificial Sequence
  TLR4ca-CO25
atggccgcgcccggcagcgccaggcgccccctcctcctcctattactcctactcctcctcggcctcatgcactgcgcctcggccgccatgcccgtcctctccctcaacatcacgtgccagatgaataagaccatcatcggcgtcagcgtcctatccgtcctcgtcgtaagcgtcgttgccgtactcgtctacaagttctattttcacctaatgcttctcgccgggtgcatcaagtacgggaggggcgagaacatctacgacgccttcgtcatctactcgagccaggacgaggactgggtccggaacgagctggtgaagaacctggaggagggcgtgccccccttccagctctgcctgcactaccgggattttatccccggcgtggccatcgccgccaacatcatccatgagggcttccataagtccaggaaggtgatcgtggtcgtgtcccagcactttatccagagcaggtggtgcatcttcgagtacgagatcgcccaaacctggcagtttctgagctcccgggccggcatcatcttcatcgtactgcagaaggtggagaagaccctgctcaggcagcaggtggagctgtaccgcctgctctccaggaacacctacctggagtgggaggacagcgtcctgggaaggcacatcttctggcggcggctccgtaaggccctgctggatggaaagagctggaaccccgagggcaccgtggggaccggctgcaactggcaggaggcgacctccatc

SEQ ID NO: 564 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 565 - DNA, 579 bp, Homo sapiens
atggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagac

SEQ ID NO: 566 - protein, 189 aa, Homo sapiens
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 567 - DNA, 567 bp, Homo sapiens
atggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagac

SEQ ID NO: 568 - protein, 20 aa, Homo sapiens
MYRMQLLSCIALSLALVTNS

SEQ ID NO: 569 - protein, 20 aa, Homo sapiens
MAWTVLLLGLLSHCTGSVTS

SEQ ID NO: 570 - protein, 25 aa, Homo sapiens
MEICRGLRSHLITLLLFLFHSETIC

SEQ ID NO: 571 - protein, 35 aa, Homo sapiens
MDAMKRGLCCVLLLCGAVFVSPSQEIHARFRRGAR

SEQ ID NO: 572 - protein, 192 aa, Artificial Sequence
  Chimeric human construct
MDAMKRGLCCVLLLCGAVFVSPSQEIHARFRRGARYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 573 - DNA, 576 bp, Artificial Sequence
  Chimeric human construct
atggatgcaatgaagagagggctctgctgtgtgctgctgctgtgtggagcagtcttcgtttcgcccagccaggaaatccatgcccgattcagaagaggagccagatactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagac

SEQ ID NO: 574 - protein, 177 aa, Artificial Sequence
  Chimeric human construct
MYRMQLLSCIALSLALVTNSYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 575 - DNA, 531 bp, Artificial Sequence
  Chimeric human construct
atgtacaggatgcaactcctgtcttgcattgcactaagtcttgcacttgtcacaaacagttactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagac

SEQ ID NO: 576 - protein, 177 aa, Artificial Sequence
  Chimeric human construct
MAWTVLLLGLLSHCTGSVTSYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 577 - protein, 182 aa, Artificial Sequence
  Chimeric human construct
MEICRGLRSHLITLLLFLFHSETICYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 578 - protein, 193 aa, Artificial Sequence
  human mutant
MAAEPVEDNCINFVAMKFIDNTLYFIAEDDENLESDYFGKLESKLSVIRNLNDQVLFIDQGNRPLFEDMTSSDCRNNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 579 - protein, 192 aa, Artificial Sequence; identical to SEQ ID NO: 572
  tPA_IL18-WT amino acid sequence

SEQ ID NO: 580 - DNA, 576 bp, Artificial Sequence; identical to SEQ ID NO: 573
  tPA_IL18-WT nucleotide sequence

SEQ ID NO: 581 - protein, 177 aa, Artificial Sequence; identical to SEQ ID NO: 574
  IL2sp_IL18-WT

SEQ ID NO: 582 - DNA, 531 bp, Artificial Sequence; identical to SEQ ID NO: 575
  IL2sp_IL18-WT

SEQ ID NO: 583 - DNA, 576 bp, Artificial Sequence
  tPA_IL18
atggacgccatgaagaggggcctctgctgcgtcctattgctctgcggggccgtcttcgtctcccccagccaggagatccacgcccggtttaggaggggggcgaggtacttcgggaagctcgagagcaagctcagcgtaatcaggaacttgaacgaccaagtcctctttatcgaccagggtaaccgtcccctcttcgaggacatgaccgactccgattgccgcgacaacgccccgcggaccatctttatcatcagcatgtacaaggactcccagccgagggggatggccgtcacaatcagcgtcaaatgcgagaagatctcgaccctgagctgcgagaacaaaatcatctcctttaaggagatgaatcccccggacaacataaaggacaccaagtcggacatcatcttcttccagaggtcggtccctggccacgacaacaaaatgcagttcgagagctccagctacgagggctatttcctcgcctgcgagaaggagagggacctgttcaagctcatcctgaagaaggaggacgagctgggcgacaggtcgatcatgttcactgtgcagaacgaggac

SEQ ID NO: 584 - DNA, 576 bp, Artificial Sequence
  tPA_IL18
atggacgcgatgaagcggggcctctgctgcgtactcctactctgcggggccgtcttcgtgtccccgtcccaggagatccacgccaggttccggaggggggcgcggtacttcggaaagcttgagagcaagctctcagtcatccgaaatctcaacgaccaggtactcttcatcgaccagggcaaccgccccttgttcgaggatatgaccgactccgactgccgggacaacgccccccggaccattttcatcataagcatgtacaaggactcccagccccggggcatggcggtaaccatcagcgtcaagtgcgagaagatctccaccctgtcctgcgaaaacaagatcatcagcttcaaggagatgaaccctcccgacaacatcaaggacaccaagagcgacatcatcttcttccagaggagcgtccccggccacgacaacaagatgcagttcgagtccagtagctacgagggctacttcctggcctgcgagaaggagagggatctgtttaagctcatcctcaagaaggaggacgagctgggggaccgcagcatcatgtttacggtgcagaacgaggac

SEQ ID NO: 585 - DNA, 576 bp, Artificial Sequence
  tPA_IL18
atggacgccatgaagaggggcctctgctgcgtcctactcctctgcggcgccgtcttcgtgagcccctcgcaggaaatccacgcgaggttcaggcggggcgccaggtacttcggcaagctcgagtcgaagcttagcgtcatccgcaacctcaacgaccaggtcctcttcatcgaccagggcaaccgccccctcttcgaagatatgaccgacagcgactgcagggacaacgcccccaggaccatcttcatcatcagcatgtacaaggactcccagccccgggggatggccgttaccatcagcgtgaaatgcgagaagatcagcacccttagctgcgagaacaagatcatctccttcaaggagatgaacccgcccgataacatcaaggacaccaagtcggacatcatcttcttccaacgtagcgtgcccggccacgacaacaagatgcagtttgagagttccagctacgagggctacttcctcgcctgcgagaaggagcgcgacctgttcaagctcatcctgaaaaaagaggatgagctgggggacaggtccatcatgttcactgtgcagaacgaggac

SEQ ID NO: 586 - DNA, 576 bp, Artificial Sequence
  tPA_IL18
atggacgcgatgaagcgggggctctgctgcgtcctactcttgtgcggcgccgtcttcgtgtcccccagccaggaaatccacgccaggttcaggaggggcgccaggtatttcggaaagctcgagagcaagctcagcgtcatcagaaacctcaacgaccaggtcctcttcatcgatcagggcaaccggcccctcttcgaggatatgaccgacagcgactgcagggacaacgccccccggaccatcttcatcatctccatgtacaaggatagccagcccaggggcatggccgtcacaatctccgtgaagtgcgagaagatcagcaccctgagctgcgaaaataagatcatctccttcaaggagatgaatccccccgataacattaaggacaccaagtccgacatcatcttcttccagaggagcgtccccggacatgacaataagatgcagttcgagagctccagctatgagggctatttcctggcctgcgaaaaggaaagggacctgttcaagctgatcctgaagaaggaagatgagctgggggaccggtccatcatgttcacagtccagaacgaggac

SEQ ID NO: 587 - DNA, 576 bp, Artificial Sequence
  tPA_IL18
atggacgccatgaagcgcggtctttgctgcgtactccttctctgcggcgccgtcttcgtgtcgccgagtcaggagatccacgcgcgcttcaggaggggggcccggtacttcggcaagttggagagcaagctctcggtcatacgcaacctcaacgaccaggttctctttatcgaccagggcaataggcccctcttcgaagacatgaccgactccgactgcagggacaacgccccccggaccatctttatcatcagcatgtataaagacagccagccccgagggatggccgtcaccatctccgtcaaatgcgagaagatctccacgctgtcctgcgagaacaagatcatttccttcaaggagatgaacccccctgacaacatcaaggacaccaagtccgacatcatcttcttccaaaggagcgtgcccggccacgacaacaagatgcagttcgagagcagctcctacgaaggatacttcctcgcatgtgagaaggagcgcgatctgttcaagctgatcctgaagaaggaggacgagctgggggataggtccatcatgtttacggtgcagaacgaggac

SEQ ID NO: 588 - DNA, 576 bp, Artificial Sequence
  tPA_IL18
atggacgccatgaagcggggcctttgctgcgtcttgcttctctgcggcgccgttttcgtctcccccagccaagagatccacgccaggttcaggaggggggccaggtacttcggtaagctcgagagcaagctctcggtcatcaggaacttgaacgaccaggtcctcttcatcgaccagggcaaccggcccctcttcgaggacatgaccgacagcgactgcagggacaacgcccccagaacgatcttcatcatctcgatgtacaaggacagccagccccgcggcatggccgtcaccatctccgtcaagtgcgagaagatcagcacgctgtcctgcgagaataaaatcatctccttcaaggagatgaacccacccgacaacatcaaggacaccaagagcgacatcatcttcttccagcgtagcgtgcccggccacgacaacaagatgcagttcgagagcagcagctacgagggctactttctcgcctgcgagaaggagcgcgacctgtttaagctgatcctcaaaaaggaggacgagctcggcgacaggtccatcatgttcacggtgcagaacgaggac

SEQ ID NO: 589 - DNA, 576 bp, Artificial Sequence
  tPA_IL18
atggacgcgatgaagcggggcctctgctgcgtcctactcttgtgcggagccgtcttcgtttcaccgagccaggagatccacgcgcgtttccggaggggcgcccgatatttcgggaagctcgaaagcaagctcagcgtcatccgcaacctcaacgaccaggtcctcttcatcgaccaggggaacaggcccctgttcgaagacatgaccgactccgactgccgggacaacgccccccgcaccattttcatcatcagcatgtacaaagacagccagccccggggcatggccgtcacaatctccgtgaagtgtgaaaagatctccaccctgtcgtgcgagaacaagatcatcagcttcaaggagatgaacccgcccgacaacatcaaggacaccaagtccgatattatcttcttccagaggagcgtgcccggccacgacaacaagatgcagttcgaaagctcgagctacgagggctacttcctggcctgtgagaaggagcgtgatctcttcaagctgatcctcaagaaggaggacgagctcggcgataggagcatcatgtttacggtgcagaacgaggac

SEQ ID NO: 590 - DNA, 576 bp, Artificial Sequence
  tPA_IL18
atggacgccatgaagaggggcctctgctgcgtcctcctcctctgcggcgccgttttcgtgagccccagccaggagatccacgcccgtttcaggaggggagcccggtatttcggcaagcttgagagcaagctcagcgtcatcaggaacctaaacgaccaggttctattcatcgaccagggcaacagacccctattcgaggacatgaccgatagcgactgtcgggacaacgccccacggaccatcttcatcatcagcatgtacaaggatagccagcccaggggcatggccgtcaccatctccgtgaagtgtgagaagatctccaccctgagctgtgagaacaaaatcatcagcttcaaggagatgaacccgcccgataatatcaaggacaccaagagcgatatcatcttcttccagaggagcgtgccgggccacgacaacaagatgcagttcgagtcctccagctacgagggttacttcctcgcctgcgagaaggaacgtgacctgttcaagctcatcctcaaaaaggaggatgagctgggggacaggagcataatgttcaccgtgcagaacgaagac

SEQ ID NO: 591 - DNA, 576 bp, Artificial Sequence
  tPA_IL18
atggacgcgatgaagaggggcctctgttgtgtcctcctcctctgcggggcggtcttcgtcagccccagccaggagatccacgcccgcttccgccggggcgcccggtacttcggcaagctcgaaagcaagttgagcgttatcaggaacctcaacgaccaagtccttttcatcgaccaaggcaataggcccctcttcgaggacatgaccgacagcgactgccgggacaacgccccgcggaccatcttcatcatctccatgtataaggactcccagcccaggggcatggccgtcaccatctccgtgaagtgtgagaagatctccaccctgtcctgcgagaacaaaatcatcagcttcaaggagatgaacccgcccgataacatcaaagacacgaagtcggatataatcttcttccagaggagcgtgcccgggcatgacaataagatgcagttcgaaagcagctcctacgagggctacttcctcgcctgcgagaaggaacgggatctattcaagctgatcctgaaaaaagaggacgagctgggcgaccgcagcatcatgttcaccgtgcagaacgaggac

SEQ ID NO: 592 - DNA, 576 bp, Artificial Sequence
  tPA_IL18
atggacgccatgaaacgcggtctgtgctgcgttctcctcctctgcggggccgtcttcgttagccccagccaggagatccacgcccgcttcaggaggggcgcgaggtatttcggcaagttggaaagcaagctctcggtcatccgaaacttgaacgatcaggtcctcttcatcgaccagggcaacaggcccctcttcgaggacatgaccgacagcgactgccgggataacgccccccggaccatcttcatcatcagcatgtataaggacagccagccccgcggcatggccgtcaccatcagcgtgaagtgcgagaaaatcagcaccctgagctgcgagaacaagatcatctccttcaaggagatgaacccgcccgacaacatcaaggataccaaaagcgacataatcttcttccagaggtcggtacccggccatgacaacaagatgcagttcgagagcagctcctatgagggctacttcctggcctgcgagaaggagagggatctgtttaagctcatcctcaagaaagaagatgagctgggggaccgcagcatcatgttcaccgtgcaaaatgaggac

SEQ ID NO: 593 - DNA, 576 bp, Artificial Sequence
  tPA_IL18
atggacgccatgaagaggggcctctgttgcgtccttctcctctgcggcgccgtattcgtcagccccagccaggagatacacgccaggttccggaggggcgcccggtatttcggaaagctcgagagcaagctcagcgtcatccggaacctcaacgaccaggtcctcttcatcgaccaggggaatcggcccttgttcgaggacatgaccgattccgactgcagagataacgcgcccaggacgatcttcatcatctccatgtataaggacagccagccaaggggcatggccgtcaccatcagcgtgaagtgcgagaagatcagcaccctgagctgcgagaacaaaatcatctccttcaaggagatgaacccgcccgacaacatcaaggacaccaagtccgacataatctttttccagcgcagcgtgcccggccatgacaacaagatgcagttcgagagctcctcctacgaaggctacttcctggcctgcgagaaggagagggacctgttcaagctgatcctgaagaaggaggacgagctgggcgaccggagcataatgttcaccgtgcagaacgaagac

SEQ ID NO: 594 - DNA, 576 bp, Artificial Sequence
  tPA_IL18
atggacgccatgaagcggggcttatgttgtgtccttctcttgtgcggcgccgtattcgtgagcccgagccaggagatccacgcccgcttcaggcggggggcgcgatacttcggcaagctcgagagcaagctctcggttatccgcaacctcaacgaccaggtcctcttcatcgaccagggcaaccgtcccctcttcgaggatatgacggattcagattgcagggacaacgccccccgcacgatattcatcatcagcatgtacaaggacagccagccccgcggcatggccgtcacgataagcgtcaagtgcgaaaagatcagcaccctgagctgtgagaacaagatcatctccttcaaggaaatgaacccgccggacaacatcaaggacacgaaaagcgacatcatattcttccaaaggagcgtgcccggccacgacaacaagatgcagttcgagtccagcagctacgagggctactttctggcctgcgaaaaagaacgcgacctgttcaagctgatcctgaagaaggaggatgagctgggggacaggagcatcatgttcaccgtgcagaacgaggac

SEQ ID NO: 595 - DNA, 576 bp, Artificial Sequence
  tPA_IL18
atggacgccatgaaacgcggcctctgctgcgttctcctcctctgcggcgcggtcttcgtcagccccagccaggagattcacgcccgcttcagaaggggcgcccggtacttcgggaagctcgagagcaagctcagcgtcatcaggaacttgaacgatcaggttcttttcatcgatcaggggaacaggcccctcttcgaggacatgacagacagcgactgtcgggacaacgcccctagaaccatcttcatcatcagcatgtacaaggattcccagcccaggggcatggccgtcactatcagcgtcaagtgtgagaaaatctccaccctgagctgcgagaacaaaatcatctcgttcaaggagatgaacccacccgacaacatcaaagataccaagagcgacatcatcttcttccaacggtccgtgcccggccatgataacaagatgcagttcgagtcctccagctatgaaggctacttcctggcctgcgagaaggagagggacctgttcaagctgatcctgaagaaggaggatgagctcggcgacaggagcatcatgttcaccgtgcagaacgaggac

SEQ ID NO: 596 - DNA, 576 bp, Artificial Sequence
  tPA_IL18
atggacgctatgaagcggggcctctgctgtgtcctcctcctctgtggggccgtcttcgtgtccccgagccaggaaatccacgcccgttttaggaggggggcccggtacttcggcaagctcgagagcaagctcagcgtcataaggaatctcaacgaccaggtcctcttcatcgaccaaggcaaccggccactcttcgaagatatgacggactcagactgcagggacaacgctccccgcacgatcttcataatctccatgtataaggactcgcagcccaggggcatggccgtcaccatctccgtgaagtgcgagaagatctccaccctgagctgcgagaacaaaatcatcagcttcaaggagatgaaccccccggacaacatcaaagacacgaagtccgacataatcttcttccagcggagcgtgccgggccacgacaataaaatgcagttcgaatccagctcctacgagggctacttcctggcctgcgagaaggagagggacctgttcaagctgatcctgaagaaggaggacgagctgggggaccggtcgatcatgttcacggtgcagaatgaggac

SEQ ID NO: 597 - DNA, 576 bp, Artificial Sequence
  tPA_IL18
atggacgcgatgaagcggggcctctgctgtgtcctcctactctgcggggccgtcttcgttagcccgagccaggagatccacgccaggttcaggcgcggcgcccgatacttcggcaagctcgagtccaagctctccgtcatccggaacctcaacgaccaagtcctcttcatcgaccagggcaaccggccgctgttcgaggacatgaccgactccgactgtcgggacaacgcccccaggaccatcttcatcatcagtatgtataaggactcccagcccagaggcatggccgtcaccatcagcgtgaaatgcgagaagatcagcaccctgagctgcgagaataagatcatcagcttcaaggaaatgaaccccccggataatatcaaagacacgaagtcggacatcatcttcttccagaggagcgtccccggccacgacaacaagatgcagttcgagagcagcagctatgaggggtacttcctggcgtgcgagaaggagagggatctgttcaagctcatcctcaagaaggaggacgagctgggggacaggtcgatcatgttcaccgttcagaacgaggac

SEQ ID NO: 598 - DNA, 576 bp, Artificial Sequence
  tPA_IL18
atggacgccatgaagcggggcctatgctgtgttctcctcctctgtggcgccgtcttcgtgagccccagccaggaaatccacgcgaggttcaggcggggcgcccggtacttcgggaagctcgagtccaagctcagcgtaatccgaaacctaaacgaccaggtcttgttcatcgaccagggcaaccggcccctcttcgaggacatgaccgacagcgactgccgggacaacgcccccaggaccatattcatcatcagcatgtacaaggacagccagcccaggggtatggccgtcacgattagcgtcaagtgcgagaagatctccacgctcagctgcgagaacaagatcatcagcttcaaggagatgaatccacccgacaatatcaaggacaccaaaagcgacatcatcttctttcagcgttccgtgcccggccacgacaacaagatgcagttcgagtccagcagctacgaaggttacttcctggcctgcgaaaaagaaagggacctgttcaagctcatcctgaagaaagaggatgagctgggcgacaggagcatcatgtttacggtgcagaacgaggac

SEQ ID NO: 599 - DNA, 576 bp, Artificial Sequence
  tPA_IL18
atggacgccatgaagaggggcttatgctgcgtactcctcctatgcggcgccgttttcgtgagccccagccaggagatccacgcccggttccggaggggggccaggtacttcggtaagctggagtccaagctctccgtcatccggaacttgaacgatcaggtccttttcatcgaccagggcaacaggcccttattcgaggacatgacggactccgactgcagggataacgccccgaggaccatcttcatcatcagcatgtacaaggacagccagcccaggggcatggcggtcaccatcagcgtgaagtgcgagaagatttccaccctgagctgcgagaacaagatcatcagcttcaaagagatgaacccgccggacaatatcaaggacacgaagtccgacatcatctttttccagcggtccgtcccgggacacgacaacaagatgcagtttgagtcgagctcttacgaaggctatttccttgcctgcgagaaggagcgggatctcttcaaactgatcctgaagaaggaggacgagctgggggaccggtccatcatgtttaccgtccaaaacgaagac

SEQ ID NO: 600 - DNA, 576 bp, Artificial Sequence
  tPA_IL18
atggacgccatgaaacggggcctctgctgcgtcctcctactttgcggcgccgtcttcgtaagccccagccaggagatccacgccaggtttcggcgcggcgccaggtacttcgggaaactcgagtccaagctcagcgtcatcaggaaccttaacgaccaggtcctcttcatcgaccagggcaacaggccgctgttcgaggacatgaccgactccgactgccgcgacaacgccccgaggaccatctttattatcagcatgtacaaggactcccagccccgcggaatggccgtcaccatctccgtgaagtgcgagaaaatctccaccctgagctgtgagaacaagatcatcagcttcaaggagatgaacccgcccgacaatatcaaggacaccaagtcggacatcatcttctttcagaggtccgtccccggccacgataacaagatgcagttcgagtccagctcctacgagggttacttcctcgcctgcgagaaggagagggacctgttcaagctgatcctgaaaaaggaggacgagctgggcgatcgcagcatcatgttcacggtgcagaacgaagat

SEQ ID NO: 601 - DNA, 576 bp, Artificial Sequence
  tPA_IL18
atggacgccatgaagcgcggactctgctgcgtcctcctcctctgcggggcggtcttcgttagccccagccaggagattcacgcccggttccgtaggggcgcgagatacttcgggaagctcgagtccaagctatcagtcatcaggaacctaaacgaccaggtcctcttcatcgaccagggcaacaggcccctcttcgaggacatgaccgatagcgactgtcgcgacaacgcgccccggaccatctttatcatcagcatgtacaaggatagccagcccaggggcatggccgtcaccatctcggtgaagtgtgagaaaatcagcaccctctcatgtgaaaacaagatcatcagcttcaaagagatgaatccccccgacaacatcaaggacaccaagagcgacatcatcttcttccagcgttcggtgcccggccatgacaacaagatgcagttcgagtccagctcctacgagggctacttcctggcctgcgagaaggagagggacctgttcaaactgatcctcaagaaggaggacgagctgggcgacaggagcattatgttcacggtgcagaacgaggac

SEQ ID NO: 602 - DNA, 576 bp, Artificial Sequence
  tPA_IL18
atggacgcgatgaagagggggctctgctgtgtcctcttattgtgcggggcagtcttcgtctcccccagccaggagatccacgcccgatttaggaggggcgcccggtacttcgggaagctcgagagcaagttgagcgtgatccggaacctcaacgaccaggtcctctttatcgaccagggcaacagaccgctgttcgaggacatgaccgacagcgattgccgcgacaacgcccccaggaccatcttcatcatcagcatgtacaaggatagccaaccgcgggggatggccgtcaccatcagcgtgaaatgtgagaagatcagcacgctgagctgtgagaacaagatcatctccttcaaggaaatgaatccccccgacaacatcaaagacactaagagcgacatcatcttcttccagcgcagcgtgcccggccacgataacaagatgcagttcgagagcagctcctacgagggctacttcctggcctgtgagaaggagagggatctgttcaagctgatcctgaagaaggaggacgagctcggggatcggagcatcatgttcaccgtgcagaacgaggac

SEQ ID NO: 603 - DNA, 576 bp, Artificial Sequence
  tPA_IL18
atggacgccatgaaacggggtttgtgctgcgtcctcttgctctgcggggccgtattcgtttcccccagccaggagatccacgcccggttcaggcggggcgccaggtacttcgggaagctcgagagtaagctaagcgtcatccgtaacctcaacgaccaggtcctcttcatcgatcagggcaacaggcccctcttcgaggacatgaccgatagcgactgccgggacaacgccccccggaccatctttatcatcagcatgtacaaggacagccagcccagagggatggccgtcaccatcagcgtgaagtgcgagaaaatctccacactgtcatgcgagaacaagatcatctcctttaaggagatgaatccgcctgacaacataaaggacaccaagtccgacatcatcttcttccaacggagcgtacccggccatgataacaagatgcagttcgagagcagcagctacgagggctacttcctggcctgcgaaaaggagcgagatctcttcaagctgatcctgaagaaggaggacgagctgggcgaccgcagcattatgttcacggtgcagaacgaggat

SEQ ID NO: 604 - DNA, 576 bp, Artificial Sequence
  tPA_IL18
atggacgccatgaagaggggcctttgttgtgtcctcctcctctgcggggccgtcttcgtgagcccctcgcaagagatccacgcccggtttaggcggggcgcccggtacttcgggaagcttgaaagcaagctcagcgttatccgcaacctcaacgatcaggtccttttcatcgatcagggcaaccgccccctcttcgaggatatgaccgactccgattgcagggataacgcccccaggaccatctttatcatcagcatgtacaaggacagccagcccaggggcatggccgtaaccatcagcgtgaagtgcgaaaagatttccaccctctcctgcgagaacaaaatcatctccttcaaggagatgaatccccctgacaatatcaaggacaccaagagcgacatcatctttttccagaggtccgtgcccggacacgacaacaagatgcagttcgagagctccagctacgaaggctacttcctggcctgcgagaaagagcgggacctgttcaagctaatcctgaagaaggaagatgagctgggcgatcggagcatcatgttcaccgtccaaaacgaggat

SEQ ID NO: 605 - DNA, 576 bp, Artificial Sequence
  tPA_IL18
atggacgcgatgaagcgagggctctgctgcgtcctcctcctctgcggcgccgtcttcgtcagccccagccaggagatccacgccaggttcaggaggggggctaggtatttcgggaagcttgagtccaagctctccgttatcaggaacctcaacgaccaggtcctcttcatcgaccagggcaaccggcccctcttcgaggacatgaccgacagcgactgcagggacaacgcccccaggaccatcttcatcatcagcatgtacaaggattcccagccaaggggcatggccgtcacaatctccgtgaagtgtgagaaaatcagcaccctgagctgcgaaaacaagataatcagcttcaaggagatgaacccgcccgataacatcaaggacaccaagagcgatatcattttcttccagcgcagcgtgcccggccatgacaacaagatgcagttcgaaagctcgagctatgagggctacttcctggcctgcgagaaggagagggacctgttcaagctcatcctgaagaaggaggatgagctgggggacaggagcattatgttcacggtccagaacgaggac

SEQ ID NO: 606 - DNA, 576 bp, Artificial Sequence
  tPA_IL18
atggacgccatgaagagggggttgtgctgcgtccttctcctctgcggggccgtcttcgtgagcccgagccaggagatacacgccaggttcaggaggggcgcccgctatttcggcaagcttgaaagcaagctcagcgtcatccggaacctcaacgaccaggtcctctttatcgaccaggggaacaggcccttgttcgaggatatgacggactccgactgtagggacaacgccccccgaaccatctttatcatcagcatgtacaaggacagccagcccaggggcatggccgtcacgatcagcgtgaagtgcgagaaaatcagcacactcagctgtgagaacaagatcatcagctttaaagagatgaacccgcccgacaacatcaaggacaccaagagcgacatcatcttcttccagcgcagtgtgcccggccacgataacaaaatgcagttcgagtccagcagctacgagggctacttcctggcctgtgagaaggagagggacctgttcaagctgatcctgaagaaggaggatgagctcggcgacaggagcatcatgtttacggtgcagaacgaggac

SEQ ID NO: 607 - DNA, 576 bp, Artificial Sequence
  tPA_IL18
atggacgccatgaagaggggactctgctgcgtactccttctctgcggcgccgtcttcgtcagcccgagccaggaaatccacgcccggttccggcggggggccaggtacttcggcaagctcgagagcaagctcagcgtcatccggaacctcaacgatcaggtcctcttcatcgaccagggcaacaggcccctcttcgaggacatgacggacagcgactgcagagacaacgccccgaggactatcttcatcatcagcatgtacaaggacagccagccccgcggcatggcggtcaccatttcggtgaagtgcgagaagataagcacgctcagctgcgaaaacaagatcatctcctttaaggagatgaacccgccggacaacatcaaggacaccaagagcgacatcatcttcttccagaggagcgtgcccggccacgacaataagatgcagttcgagtcctccagctatgagggttacttcctggcctgcgagaaggagagggacctgttcaaactgatactgaagaaggaagacgagctgggcgataggtccataatgttcaccgtgcagaacgaggac

SEQ ID NO: 608 - DNA, 579 bp, Artificial Sequence
  IL18_WT
atggccgccgagccagttgaagacaactgcatcaacttcgtcgccatgaagtttatcgacaacacgctctactttatcgccgaggacgacgagaatctcgagtccgactacttcggcaaactcgagagcaagctcagcgtcatccggaacctaaacgaccaggtccttttcatcgaccagggcaacaggccgctgttcgaagacatgaccgactccgattgcagggataacgccccgaggaccatattcatcatctcgatgtataaggactcccagcccaggggcatggccgtcacgatctccgtgaagtgcgagaagatctccaccctctcctgcgagaacaagatcatctccttcaaggagatgaatccccccgacaacataaaggacaccaagtccgacattatcttcttccagaggagcgtgcctggccatgacaacaagatgcagttcgagtccagctcctacgagggctacttcctggcctgcgagaaggagcgggacctgttcaagctgatcctcaagaaggaggacgagctgggggataggtccatcatgttcaccgtgcagaacgaggac

SEQ ID NO: 609 - DNA, 579 bp, Artificial Sequence
  IL18_WT
atggccgccgagcccgtcgaggataactgcatcaacttcgttgccatgaagttcatcgacaacacgctctacttcatcgcggaggacgacgagaacctcgagtccgattacttcggcaagcttgagtccaagcttagcgtcatcaggaatctcaacgaccaggttttgttcatcgaccagggcaacaggcccctattcgaagacatgaccgattcagactgtcgggacaacgcccccaggaccatcttcataataagcatgtacaaggattcccagcccaggggcatggccgtcaccatctccgtgaagtgcgagaagatctccaccctcagctgcgagaataagatcatctccttcaaggagatgaacccgcccgacaacatcaaggacactaagtccgacatcatcttcttccagaggagcgtccccggccatgataacaagatgcagttcgagagcagcagctacgaggggtacttcctggcctgcgagaaggagagggatctgttcaagctcatcctcaaaaaggaggacgagctgggggacaggtccatcatgttcaccgtgcagaacgaggac

SEQ ID NO: 610 - DNA, 579 bp, Artificial Sequence
  IL18_WT
atggcggccgagcccgtcgaagacaactgcatcaacttcgtcgccatgaagttcatcgacaacacactctacttcatcgccgaggacgacgagaacctcgagagcgactacttcgggaaactcgagagcaagctatccgtcatcaggaacctcaacgaccaggtcctcttcatcgaccagggcaacaggcccctcttcgaggacatgacggatagcgattgcagggataacgcccctaggaccatcttcatcatctccatgtacaaggacagccagccgagaggcatggcggtcaccatttccgtgaagtgcgagaagatcagcaccctgagctgcgagaacaagatcatcagctttaaagagatgaacccgccggacaacataaaagacactaagagcgacatcatcttcttccagaggagcgtccccggccacgacaacaagatgcagttcgagtccagcagctacgaggggtacttcctggcctgcgagaaggagagggatctgttcaagctgatcctcaagaaagaggacgagctgggtgaccgaagcatcatgttcaccgtgcagaacgaggac

SEQ ID NO: 611 - DNA, 579 bp, Artificial Sequence
  IL18_WT
atggcggccgagccagtcgaggacaactgcatcaatttcgtcgccatgaagttcatcgacaacaccttgtacttcatcgccgaggacgacgagaacctcgagagcgattacttcggcaagctcgagagcaagttgagcgtaatcaggaacttgaacgaccaggtcctcttcatcgaccagggcaacaggccccttttcgaggatatgaccgacagcgactgcagggacaacgcgcctcgcaccatctttatcatcagcatgtacaaggattcccagcccagggggatggccgtcaccatatcggtgaagtgcgagaaaatctccaccctgagctgcgagaacaagatcatcagctttaaggagatgaatccccccgacaatatcaaggacaccaagtccgacatcatcttcttccagaggtcggtccccggtcacgataataagatgcagtttgagtccagctcctacgagggctactttctggcctgcgagaaggagcgggacctgttcaaactgattctgaagaaggaggacgagctgggggataggagcatcatgttcaccgtccaaaacgaggac

SEQ ID NO: 612 - DNA, 579 bp, Artificial Sequence
  IL18_WT
atggccgccgagcccgtagaggataactgcatcaacttcgttgccatgaagttcatcgacaacacgttgtacttcatcgccgaggacgacgagaacctcgagtccgattacttcggcaagctcgagagcaaactttccgtcattaggaatctcaacgaccaggtcctcttcatcgaccagggcaataggcccctcttcgaggacatgaccgactccgactgcagggacaacgcccccaggaccatcttcatcatctccatgtacaaggacagccagccccggggcatggccgtcaccatcagcgtgaagtgcgaaaagatcagcaccctgagctgtgagaacaagatcatcagcttcaaggagatgaacccgcccgacaacatcaaggacacgaagtccgatatcatcttcttccaacgctccgtgcccggccacgacaacaagatgcagttcgaatccagctcatacgaggggtacttcctggcgtgcgagaaggagagagatctgttcaagctgatcctgaaaaaggaggacgagctgggcgacaggagcatcatgttcacggtccagaacgaggac

SEQ ID NO: 613 - DNA, 579 bp, Artificial Sequence
  IL18_WT
atggccgccgagcccgtcgaggacaactgcatcaacttcgtagcgatgaagttcatcgacaataccctctacttcatcgccgaggacgacgagaacctcgagagcgactacttcggcaaactcgagagcaagctcagcgtcatcaggaacttgaacgaccaagtcctcttcatagatcagggcaacaggcccctcttcgaggatatgaccgatagcgactgccgggacaacgccccgaggaccatcttcatcatcagcatgtacaaggacagccagcccaggggcatggcggtcaccatctcggtgaagtgcgagaagatctccaccctgagctgtgagaacaagatcatcagcttcaaggagatgaaccctcccgacaacatcaaggacaccaaaagcgatataatcttctttcagaggagcgtgcccggccacgacaacaagatgcagtttgagtcctcgagctacgagggctacttcctggcatgcgaaaaggaacgggacctgttcaagctgatcctgaagaaagaggacgagctgggggaccggagcatcatgttcaccgtgcagaatgaggat

SEQ ID NO: 614 - DNA, 579 bp, Artificial Sequence
  IL18_WT
atggccgccgagcccgtagaagataactgcatcaacttcgtcgcgatgaagtttatcgacaatacgctatacttcatcgccgaggacgacgaaaacctcgagtccgactacttcggaaagcttgagagcaagctcagcgtcatccggaacctcaacgaccaggtcctctttatcgaccagggcaaccggccgctgttcgaggacatgaccgactccgactgccgggacaacgccccgcgaaccatattcatcatcagcatgtacaaggacagccagccccgcggcatggccgtaactatcagcgtcaagtgcgagaagatcagcaccctgagctgcgaaaataagatcatctcctttaaggagatgaacccgcccgataacatcaaggataccaagtccgacatcatctttttccagaggagcgtgcccggccacgataataagatgcagttcgagagcagcagctacgaggggtacttcctggcctgcgagaaggagagggatctcttcaagctgatcctgaagaaagaggatgaactgggcgacagaagcatcatgttcaccgtgcaaaacgaggac

SEQ ID NO: 615 - DNA, 579 bp, Artificial Sequence
  IL18_WT
atggccgccgagcccgttgaggacaactgcattaacttcgtcgcgatgaagttcatcgataacaccctctacttcatcgccgaggacgacgagaacctcgagagcgattacttcgggaagcttgaatccaagctcagcgtaatcaggaaccttaacgaccaggtcctctttatcgaccagggcaacaggccgctgttcgaggatatgaccgacagcgactgcagggacaacgcccccaggaccatcttcatcatctccatgtacaaggacagccagcccaggggcatggccgtcaccatcagcgtgaagtgcgagaagatcagcaccctgtcctgcgaaaacaagatcatctccttcaaggagatgaacccgcccgacaacatcaaggatacaaagtccgacatcatctttttccagcggagcgtgcccggccacgacaacaagatgcagttcgagagcagcagctacgaggggtacttcctggcgtgcgagaaggagcgggatctgttcaagctgatcctgaagaaggaggacgagctcggcgaccggtccatcatgttcactgtccagaacgaagac

SEQ ID NO: 616 - DNA, 579 bp, Artificial Sequence
  IL18_WT
atggccgcggagcccgtcgaggacaactgtatcaacttcgtcgcgatgaagttcatcgacaataccctctacttcatcgccgaggacgacgagaacctcgaaagcgactacttcggcaagctcgagtccaagctctccgttatcaggaacctcaacgaccaggtcctctttatcgaccagggcaacaggcctctcttcgaggacatgaccgactcggattgtcgggacaacgccccgcggaccatctttatcatcagcatgtacaaggattcgcagcccaggggcatggccgtcaccatcagcgtgaaatgcgagaaaatttccaccctgagctgcgagaacaagataatcagcttcaaagagatgaacccgcccgacaacatcaaggacacaaagagcgacatcatcttctttcagcgcagcgtgcccggccacgacaacaagatgcagttcgagagcagcagctatgaggggtactttctggcctgcgagaaggagagggatctgttcaagctcatactcaagaaggaggatgagctgggggacaggagcattatgttcaccgtgcagaacgaggac

SEQ ID NO: 617 - DNA, 579 bp, Artificial Sequence
  IL18_WT
atggccgccgagcccgtcgaggacaactgcatcaacttcgtcgccatgaagttcatcgacaacacgctctacttcatcgcggaggacgacgagaatctcgagtccgattatttcggtaagctagagtccaaactcagcgtaatcaggaacctcaacgatcaggttctctttatcgaccaggggaacaggcccctcttcgaggatatgaccgacagcgactgcagggataacgccccgcggaccatcttcatcatctccatgtataaggactcccagcccaggggcatggccgtcaccataagcgtcaagtgcgagaagatcagcacgctcagctgtgagaacaagatcatctccttcaaggagatgaatccccccgacaacatcaaggacaccaagagcgacatcatctttttccaaaggagcgtgcccggccacgacaacaagatgcagttcgagtcctcttcctacgaggggtattttctggcctgcgagaaggaacgggacctgtttaagctgatcctgaaaaaggaggatgagctgggcgacaggagcatcatgttcacggtgcagaacgaggac

SEQ ID NO: 618 - DNA, 579 bp, Artificial Sequence
  IL18_WT
atggccgccgagccggtcgaggacaactgtatcaacttcgttgccatgaagtttatcgacaataccctatacttcatcgcggaggacgacgagaacctcgagtccgattacttcggcaagctcgagagcaaactctccgtcatccggaacctcaacgaccaggtcctcttcatcgaccagggcaacaggccgctattcgaggacatgaccgatagcgattgcagggacaacgcgccgaggaccatcttcatcatctccatgtacaaggacagccaaccccgcgggatggccgtcaccataagcgtgaagtgcgaaaagatcagcacactgtcatgtgagaacaaaatcatctcgttcaaggagatgaacccacccgacaacatcaaggacacgaagtccgacatcatctttttccagcggagcgtgcccggccacgataacaagatgcagttcgagagctccagctacgaaggttacttcctggcgtgcgagaaggagcgggatctgtttaagctgatcctgaaaaaggaggatgagctgggggaccgcagcatcatgttcaccgtgcagaatgaggac

SEQ ID NO: 619 - DNA, 579 bp, Artificial Sequence
  IL18_WT
atggccgcggagcccgttgaggacaactgcatcaacttcgttgccatgaagttcatcgacaacacgttgtacttcatagccgaggacgacgagaacctcgagtccgattacttcggcaaactcgagagcaagctcagcgtcatcaggaatctcaacgaccaggtattattcatcgaccagggcaacaggcccctcttcgaggatatgaccgacagcgactgtcgggacaacgccccgaggaccatctttatcataagcatgtacaaggactcccagccccgaggcatggcagtcaccatcagcgtaaagtgcgaaaaaatctccaccctgagctgcgagaacaagatcatctccttcaaggagatgaaccctcccgacaacatcaaggataccaagagcgacatcatcttcttccagaggtccgtgcccggccatgacaacaagatgcagttcgagagctccagctacgaggggtacttcctggcctgcgagaaggagagagatctgttcaagctgatcctcaagaaggaggacgagctgggggaccggagcatcatgttcacagtccagaatgaggac

SEQ ID NO: 620 - DNA, 579 bp, Artificial Sequence
  IL18_WT
atggccgccgagcccgtcgaggacaactgcatcaacttcgtcgccatgaagtttatcgataataccctctactttatcgccgaggacgacgagaatctcgaaagcgattacttcggaaagctcgaatccaagctaagcgtcatccggaacctcaacgaccaggttctctttatcgaccagggcaaccgccccctcttcgaggacatgaccgacagcgattgcagggacaacgcaccccggacgatcttcatcatcagcatgtacaaggacagccagccccggggcatggccgtcaccatcagcgtgaagtgtgaaaagatctccaccctcagctgcgagaacaagatcatctccttcaaggagatgaaccccccagacaacatcaaggacaccaagtccgacatcatcttcttccaaaggagcgtgccgggccacgacaacaagatgcagttcgagtccagctcatacgaggggtacttcctggcgtgcgagaaggagcgggacctgttcaagctcatcctcaagaaggaggatgagctcggggacaggtccataatgttcaccgtccagaacgaagac

SEQ ID NO: 621 - DNA, 579 bp, Artificial Sequence
  IL18_WT
atggccgccgagcccgtcgaggataattgtatcaacttcgtcgcgatgaagttcatcgacaacaccctctacttcatcgccgaggacgacgagaacctcgaatccgactacttcggcaagctcgagtccaagctcagcgtcatcaggaaccttaacgaccaggtcctcttcatcgatcaagggaatcgacccctattcgaggatatgaccgacagcgactgtcgggacaacgccccccggaccatcttcatcatcagcatgtacaaagactcccagccgagggggatggccgtcaccatcagcgtgaagtgcgaaaaaataagcaccctgtcgtgtgagaacaaaatcatcagcttcaaggagatgaaccccccggacaacataaaggacaccaagagcgacatcatcttcttccagaggagtgtccccgggcacgacaacaagatgcagtttgagagctccagctacgagggctacttcctggcttgcgagaaggagagggacctgttcaagctcatcctcaaaaaggaggacgagctgggcgacaggagcatcatgttcaccgtccagaacgaagac

SEQ ID NO: 622 - DNA, 579 bp, Artificial Sequence
  IL18_WT
atggccgccgaacccgtcgaagacaactgcatcaacttcgttgccatgaagttcatcgacaacaccctctactttatcgcagaggacgacgagaacctcgagagcgactacttcggaaagctcgagagcaagctcagcgtaatcaggaacctcaacgaccaggtcctgttcatcgaccagggcaacaggcccctcttcgaagacatgacggactccgattgccgcgataacgcccccaggaccatcttcatcatcagcatgtacaaggacagccagccccgaggcatggccgtcaccatatccgtcaagtgcgagaagatctcgacgctgagctgcgagaacaagatcatcagcttcaaggagatgaacccacccgacaacatcaaggacacgaaaagcgatatcatcttcttccagaggtcagttcccgggcacgacaataagatgcagttcgagtcgagcagctacgaggggtacttcctggcgtgcgagaaggagagggacctgttcaagctcatcctgaagaaggaagatgagctgggtgacaggagcatcatgttcaccgtgcagaacgaagac

SEQ ID NO: 623 - DNA, 579 bp, Artificial Sequence
  IL18_WT
atggccgccgagcccgtcgaggataattgcatcaacttcgtcgccatgaaatttatcgacaacaccctctactttatcgccgaggacgacgagaacctcgaatccgattacttcggcaagctcgagagcaagctctcggtcatccggaacctcaacgatcaagtactcttcatcgaccagggcaacaggcccctcttcgaggatatgaccgactccgactgcagggacaacgcccccaggaccatcttcatcatcagcatgtacaaggacagccagcccagggggatggccgtaaccatctccgtgaagtgcgagaaaataagcaccctgagctgtgagaacaagatcatcagcttcaaggagatgaaccccccggacaacatcaaggacacaaagagcgacattatcttcttccagaggagcgtgccagggcacgataacaagatgcagttcgaatcctcctcctatgaggggtacttcttggcgtgcgagaaggagagggacctcttcaagctgatcctcaagaaagaggatgagctgggggataggagcatcatgttcaccgtccagaacgaggac

SEQ ID NO: 624 - DNA, 579 bp, Artificial Sequence
  IL18_WT
atggccgccgagcccgtcgaggacaactgcatcaacttcgtcgccatgaagtttatcgacaacaccctctacttcatcgccgaggacgacgagaacctcgaaagcgactacttcgggaagctcgagtccaagctcagcgtcatcaggaacctcaacgaccaggtcctgttcatcgaccagggcaacaggcccctcttcgaggacatgaccgacagcgactgcagggacaacgcccccaggaccatcttcattatcagcatgtacaaggacagccagccgcgcggcatggccgtcaccatcagcgtgaagtgcgagaagatcagcaccctgagctgtgagaacaagatcatcagcttcaaggagatgaacccgcccgacaacataaaggacaccaagtcagatatcatctttttccagaggagcgtgcccggccacgacaacaagatgcagttcgagagctccagctacgaagggtatttcctggcctgcgagaaggagagggacctcttcaagctgattctgaagaaggaggacgagctgggggacaggagcatcatgttcaccgtgcagaacgaggac

SEQ ID NO: 625 - DNA, 579 bp, Artificial Sequence
  IL18_WT
atggccgccgagcccgtagaggacaactgcatcaacttcgtggccatgaagtttatcgacaacaccctctacttcatcgccgaggacgacgagaacctcgagtccgactacttcgggaaactcgagagcaagctctcggtcatccggaatctcaacgaccaggttctcttcatcgaccagggcaataggcccctcttcgaagacatgaccgatagcgactgtcgggacaacgccccccgtaccatcttcatcatctccatgtacaaggattcacagccccgaggcatggcggtcacgatcagcgtgaagtgcgagaagatcagcaccctgagctgcgaaaataagatcataagcttcaaggagatgaacccgccggacaacatcaaggacaccaaaagcgacatcatcttcttccagcgaagcgtccccggccacgacaacaagatgcagttcgagtcctcctcctacgaagggtactttctggcctgtgagaaggagagggatctgttcaagctgatcctcaagaaggaggatgaactgggcgacaggagcatcatgttcaccgtccagaacgaggat

SEQ ID NO: 626 - DNA, 579 bp, Artificial Sequence
  IL18_WT
atggcagccgagccagttgaggacaattgtatcaacttcgtggcgatgaaattcatagacaataccttgtacttcatcgccgaggacgacgaaaacttagagagcgactacttcggcaagcttgagagcaagctcagcgtcatccggaatctcaacgaccaggtcctcttcatcgatcaggggaacaggcccctcttcgaggatatgaccgactcggactgcagggacaacgcccccaggacgatcttcatcatctccatgtacaaggattcccaaccccgcgggatggccgtcacgatcagcgtgaagtgtgagaaaatcagcaccctttcctgcgagaataagatcatctcctttaaggagatgaacccgcccgacaacatcaaggacaccaagtccgacatcatctttttccagcgcagcgtgcccggccacgacaacaagatgcagttcgagtccagctcctacgagggctacttcctggcctgcgagaaggagagggacctctttaagctaatcctcaagaaggaggacgagctcggggacaggagcatcatgttcaccgtgcagaacgaggac

SEQ ID NO: 627 - DNA, 579 bp, Artificial Sequence
  IL18_WT
atggcggcggagcccgtcgaggacaattgcatcaatttcgtggccatgaagttcatcgacaatacactctactttatcgccgaagacgacgagaacctcgagtccgactacttcggcaagctcgagagcaagctcagcgtcatcaggaacctcaacgaccaggtcctcttcatcgaccaggggaacaggcccctattcgaggacatgaccgactcggactgcagggacaacgcccccaggacaatcttcatcatcagcatgtacaaggactcccagcccaggggcatggccgtcaccattagcgtgaagtgcgagaagatctccaccctgagctgcgagaacaagatcatctccttcaaggagatgaaccctcccgacaatatcaaggacacgaaaagcgacatcatcttcttccagaggagcgtgccgggtcacgataacaagatgcagttcgagtcctcgagctacgaggggtactttctggcctgcgaaaaggagagggacctgttcaaactgatcctgaagaaggaggacgaactgggcgaccggagcatcatgttcaccgtccagaacgaggac

SEQ ID NO: 628 - DNA, 579 bp, Artificial Sequence
  IL18_WT
atggcagcggagcccgtcgaggacaactgtatcaacttcgtggccatgaagtttatcgacaatacgctatacttcatcgccgaggacgacgagaatctcgagtccgactacttcggcaagctcgagagcaagctcagcgtcatcaggaatctcaacgatcaggtcctatttatcgaccaggggaacaggcccctcttcgaggacatgaccgactccgactgcagggacaacgcccccaggaccatctttatcattagcatgtacaaggacagccagcccagggggatggccgtcacaatcagtgtcaagtgcgagaagatcagcacgctgtcatgcgagaataagatcatcagctttaaagagatgaacccgcccgacaatataaaggataccaaatccgacatcatcttcttccagaggagcgttccgggccacgacaacaagatgcagttcgagtcctcctcctacgagggctatttcctcgcctgcgagaaggagagggacctgttcaagctcatactcaagaaggaggacgagctcggcgacagaagcatcatgttcaccgtgcaaaacgaggat

SEQ ID NO: 629 - DNA, 579 bp, Artificial Sequence
  IL18_WT
atggccgccgagccggtcgaggacaactgcataaatttcgtcgccatgaagttcatagacaacaccctatacttcatcgccgaagacgacgagaacctcgagagcgactacttcggaaagctcgagagcaagctttcggttatcaggaatttgaacgaccaggtcctcttcatcgatcagggcaataggcccctcttcgaggatatgaccgactcggactgcagggataacgcccccaggacaatcttcataatcagcatgtacaaggacagccagcccagaggcatggccgtcactatttctgtcaagtgcgagaagatcagcacgctgagctgcgagaacaaaatcatcagctttaaagagatgaacccgcccgacaacatcaaggacaccaagagcgacatcatcttcttccagaggagcgtccccgggcatgacaacaagatgcagttcgagagcagctcctacgagggctattttctcgcctgcgagaaggagagggacctgtttaagctcatcctgaagaaggaggacgagctgggggacaggtccatcatgtttacggtgcagaacgaggac

SEQ ID NO: 630 - DNA, 579 bp, Artificial Sequence
  IL18_WT
atggccgccgagcccgtcgaagacaactgcatcaacttcgtagccatgaagttcatcgacaacacactctacttcatcgccgaggacgacgagaacttggagtccgactacttcggcaagctcgagagcaagttgagcgtcatcagaaacctcaacgaccaggtcctcttcatagaccaggggaacaggcccctcttcgaggacatgaccgacagcgactgccgggacaacgcccccaggaccatattcatcatcagcatgtataaggacagccagcccaggggcatggccgtcacgatcagcgtcaagtgcgagaagatcagcacgctgtcctgcgagaacaagatcatcagcttcaaggagatgaaccccccggacaacatcaaggacaccaaatccgacatcatcttcttccagcgaagcgtgcccggccacgataacaagatgcagtttgagagcagcagctacgaggggtacttcctggcctgcgagaaggagagggacctcttcaagctgatcctgaagaaagaggacgagctgggcgacaggagcatcatgttcactgttcagaacgaggac

SEQ ID NO: 631 - DNA, 579 bp, Artificial Sequence
  IL18_WT
atggccgccgagccggtggaggataactgcatcaacttcgtcgccatgaagttcatagacaataccctctacttcatcgccgaggacgacgaaaacctcgagtccgattatttcgggaagctcgagagcaagctcagcgtcatcaggaacctcaacgaccaggtcctctttatcgaccaggggaaccggcccttgttcgaggatatgaccgactcagactgcagggataacgcgccccggaccatcttcatcatttccatgtataaggacagccagccgcggggcatggccgtcaccatcagcgtaaagtgcgagaaaatcagtaccctgagctgcgagaacaagatcatcagcttcaaggagatgaacccgccggacaacatcaaagacaccaagtccgatatcatcttcttccaacggtccgtccccggacacgacaataagatgcagttcgagagcagctcctacgaggggtacttcctggcctgtgaaaaggagcgagatctgttcaagctgatcctgaagaaggaggatgagctgggcgacagaagcattatgttcacagtccaaaacgaggac

SEQ ID NO: 632 - DNA, 579 bp, Artificial Sequence
  IL18_WT
atggccgccgagcccgtcgaagacaactgcatcaacttcgtggccatgaaattcatcgacaataccctttactttatcgccgaggacgacgaaaacctcgaaagcgactacttcggcaagctagagtccaagctcagcgtcattaggaacctaaacgatcaagtcctcttcatcgaccagggcaataggcccctcttcgaggacatgaccgatagcgactgcagggacaacgcccccaggaccatcttcataatcagcatgtacaaggacagccagcccaggggcatggccgtcaccatcagcgtcaagtgtgagaagatctccacgctgagctgcgaaaacaagatcatctccttcaaggagatgaacccgcccgacaacatcaaggataccaagtccgacatcatcttcttccaacggagcgtgcccggccacgacaacaagatgcagttcgagagcagcagctatgagggctacttcctggcgtgcgagaaagagagggacctcttcaagctgatcctgaagaaggaggacgagcttggggacaggagcatcatgttcaccgtccaaaatgaggat

(The sequence listing continues in the following parts.)

What is claimed is:

1. A method for treating cancer in a subject by inducing or enhancing an anti-tumor immune response, comprising administering to the subject a first messenger RNA (mRNA) encoding an IL-23 polypeptide comprising an IL-12p40 polypeptide operably linked, with or without a linker, to an IL-23p19 polypeptide, a second mRNA encoding an IL-18 polypeptide, and a third mRNA encoding an OX40L polypeptide, thereby treating cancer in the subject by inducing or enhancing an anti-tumor immune response.

2. The method of claim 1, wherein the IL-23 polypeptide comprises an IL-12p40 polypeptide operably linked via a linker to an IL-23p19 polypeptide, and wherein the linker is a Gly/Ser linker.

3. The method of claim 1, wherein the IL-23 polypeptide comprises the amino acid sequence set forth in SEQ ID NO: 983, wherein the IL-18 polypeptide comprises the amino acid sequence as set forth in SEQ ID NO: 581, and wherein the OX40L polypeptide comprises an amino acid sequence selected from the group consisting of SEQ ID NOs: 1160 and 1161.

4. The method of claim 1, wherein (i) the first mRNA encoding an IL-23 polypeptide comprises an open reading frame, wherein the open reading frame comprises a nucleotide sequence at least 90% identical to the nucleotide sequence as set forth in SEQ ID NO: 984;

(ii) the second mRNA encoding an IL-18 polypeptide comprises an open reading frame, wherein the open reading frame comprises a nucleotide sequence at least 90% identical to the nucleotide sequence set forth in SEQ ID NO: 582; and (iii) the third mRNA encoding an OX40L polypeptide comprises an open reading frame, wherein the open reading frame comprises a nucleotide sequence at least 90% identical to the nucleotide sequence as set forth in SEQ ID NO: 1163.

5. The method of claim 4, wherein the first mRNA, second mRNA and third mRNA each comprise a 3' untranslated region (UTR) comprising at least one microRNA-122 (miR-122) binding site.

6. The method of claim 5, wherein the miR-122 binding site is a miR-122-5p binding site, and wherein the miR-122-5p binding site comprises the nucleotide sequence as set forth in SEQ ID NO: 26.

7. The method of claim 4, wherein the first, second and third mRNA comprise a 5'UTR comprising the nucleotide sequence set forth in SEQ ID NO: 1216 and a 3'UTR comprising the nucleotide sequence as set forth in SEQ ID NO: 1253.

8. The method of claim 1, wherein the first, second and third mRNAs are chemically modified.

9. The method of claim 8, wherein the first, second and third mRNAs are fully modified with chemically-modified uridines.

10. The method of claim 8, wherein the first, second and third mRNAs are fully modified with N1-methylpseudouridine.

11. The method of claim 1, wherein the first, second and third mRNAs are formulated in separate lipid nanoparticles.

12. The method of claim 11, wherein the lipid nanoparticles are administered simultaneously or sequentially.

13. The method of claim 1, wherein the first, second and third mRNAs are formulated in the same lipid nanoparticle.

14. The method of claim 1, comprising administering a checkpoint inhibitor polypeptide, wherein the checkpoint inhibitor polypeptide inhibits PD1, PD-L1, CTLA4, or a combination thereof, and wherein the checkpoint inhibitor polypeptide is an antibody or antigen-binding fragment thereof.

15. The method of claim 14, wherein the antibody is an anti-CTLA4 antibody or antigen-binding fragment thereof that specifically binds CTLA4, an anti-PD1 antibody or antigen-binding fragment thereof that specifically binds PD1, an anti-PD-L1 antibody or antigen-binding fragment thereof that specifically binds PD-L1, or a combination thereof.

16. The method of claim 15, wherein the anti-PD-L1 antibody is atezolizumab, avelumab, or durvalumab, wherein the anti-CTLA-4 antibody is tremelimumab or ipilimumab, and wherein the anti-PD1 antibody is nivolumab or pembrolizumab.

17. The method of claim 3, wherein (i) the first mRNA encoding an IL-23 polypeptide comprises an open reading frame, wherein the open reading frame comprises a nucleotide sequence at least 90% identical to the nucleotide sequence as set forth in SEQ ID NO: 984;

(ii) the second mRNA encoding an IL-18 polypeptide comprises an open reading frame, wherein the open reading frame comprises a nucleotide sequence at least 90% identical to the nucleotide sequence set forth in SEQ ID NO: 582; and (iii) the third mRNA encoding an OX40L polypeptide comprises an open reading frame, wherein the open reading frame comprises a nucleotide sequence at least 90% identical to the nucleotide sequence as set forth in SEQ ID NO: 1163.

18. A method for treating cancer in a subject by inducing or enhancing an anti-tumor immune response, comprising administering to the subject a lipid nanoparticle comprising a first messenger RNA (mRNA) encoding an IL-23 polypeptide comprising an IL-12p40 polypeptide operably linked, with or without a linker, to an IL-23p19 polypeptide, a second mRNA encoding an IL-18 polypeptide, and a third mRNA encoding an OX40L polypeptide, thereby treating cancer in the subject by inducing or enhancing an anti-tumor immune response.

19. The method of claim 18, wherein the IL-23 polypeptide comprises the amino acid sequence set forth in SEQ ID NO: 983, wherein the IL-18 polypeptide comprises the amino acid sequence as set forth in SEQ ID NO: 581, and wherein the OX40L polypeptide comprises an amino acid sequence selected from the group consisting of SEQ ID NOs: 1160 and 1161.

20. The method of claim 18, wherein, (i) the first mRNA encoding an IL-23 polypeptide comprises an open reading frame, wherein the open reading frame comprises a nucleotide sequence at least 90% identical to the nucleotide sequence as set forth in SEQ ID NO: 984;

(ii) the second mRNA encoding an IL-18 polypeptide comprises an open reading frame, wherein the open reading frame comprises a nucleotide sequence at least 90% identical to the nucleotide sequence set forth in SEQ ID NO: 582; and (iii) the third mRNA encoding an OX40L polypeptide comprises an open reading frame, wherein the open reading frame comprises a nucleotide sequence at least 90% identical to the nucleotide sequence as set forth in SEQ ID NO: 1163.

21. The method of claim 20, wherein the first, second and third mRNAs comprise a 5'UTR comprising the nucleotide sequence set forth in SEQ ID NO: 1216 and a 3'UTR comprising the nucleotide sequence as set forth in SEQ ID NO: 1253.

22. The method of claim 21, wherein the first, second and third mRNAs are fully modified with N1-methylpseudouridine.

23. The method of claim 19, wherein, (i) the first mRNA encoding an IL-23 polypeptide comprises an open reading frame, wherein the open reading frame comprises a nucleotide sequence at least 90% identical to the nucleotide sequence as set forth in SEQ ID NO: 984;

(ii) the second mRNA encoding an IL-18 polypeptide comprises an open reading frame, wherein the open reading frame comprises a nucleotide sequence at least 90% identical to the nucleotide sequence set forth in SEQ ID NO: 582; and (iii) the third mRNA encoding an OX40L polypeptide comprises an open reading frame, wherein the open reading frame comprises a nucleotide sequence at least 90% identical to the nucleotide sequence as set forth in SEQ ID NO: 1163.

* * * * *